United States Patent 9,487,797 (GENOMIC PLANT SEQUENCES AND USES THEREOF) - sequence listing, part 47

SEQ ID NO: 65824 - DNA, 61470 bp, Oryza sativa
  unsure (1)..(61470): unsure at all n locations
aaaaagtcaacggcgccatctattaaaaaacggagggagtagtagtttaaaatgttatatttcatctaaatattatcagtataactttaaaggttgtatattgctagcaggatataaaggtgatgtcacgctttctagtatcattaaatcatcatcgtacttcactgagaacttgcccaaaaccaaaactaagaaaaagtacagactaaacagaaagaattagtaatgtgtatacaccacaagtacaaaatacaccacgatcaaataaaagtataattgatgctttagaatattaaactggtaaaattagtttgcataaaatacacaatttcttgaagatttaaactgatggaatatctttagtttgaaatggaaatcttggagctttgtctactcaataaagagagaatcaaggataaagcagagtaaaatcaaccattccatgcagattcagtcatttgaatataaattaaatttgaaccggctcaaagctgagttcatcagttttatcccaacttaactaccaaacctaactcccatcagaatcccaatttattttctataaacacaagaaatcaaacatagtgagacttgtattgatgtggtagaaactaactcatgattaataaaaatatttggtggattatacataagcttgagactgaagactatcaaaggctactgacttgtattgacattgaaaaacaaattggcagttcagccctgtcagggttatggataccacatacctaatagtagttgactaaatctcggcaggacccaccacataccatgtcctatacggaaacaacctacggatataggagggagttccggataaggaaagacaaccagagttctacatggaaacgacaaggactacttgaattgtatccatattggtttccctagttctacttggacaaggggacacctatgggtataaatacaagcccccctaggaggacagggggacacacacccaccatggaggatcaacacgatcgacccccaccatgagatgatcaacaccaatcatgagacgatcaacacccaccacgagacaatcaactcccaacacaatcaacatagaagcctacatacgccaagacaagccgccggatatcgacatcagagatacgcttggatcgaccctatccggtaccttcagaggctggccgtagggatctagcactgtctctgattccgtcgggcgcgagctcgaggaggaaggctaccctgttgtcgactacgagtcagaccttcagaccgccatatcgacaacagttagataggctacccacatattgtactggtgtgattatggtgaataagagcaataccagcttcggccaacaggatgtagggttattacctgacaactcaggggctcgaacctgtataaaaatccatgtctccatctcttttacctcagtctcgcgtatatcctagcaccaacgatccccatactgtccaaataccgtagtcgtgacatcaaacgtcgacagtggcgcgccaggtagggggattttggtgctttaggatttcgacgagatgggtttaagagatggactctccgacaacaagctactcgacgacttcggctgtggggagatccaacctaaccagatcggaaccatcatcgtcatcgacaacttggtctatcgagatcatccaagcctcaagatacgcggcgtaccaaaagatgtcagatcatatgatgtcgaacgagtacgcaataaggtaattggtagattggtttttcaaattgatctactaatttcgtagatacatccagcatgtatctacaaaggtacgcaatattttatctacaatttatcgtacctattctgatcatacaacattgtcagatctataatttattatgtttacctagagcatgttctttatacaataatatctgttgcgcgggtgtccccgatgttaaatcgactacgatctaacgctgggggctcgctctgtcttcttctgtataaatcatgcttgtttatggtttacataatgcctgatatttacatctgctcgttatatcctgataatactagaagacccatgcagtttttcgaatacatattcgatattatctgctatatatcttgccttctagaaaatatttttcaggaacagttgagcactcgagtaggtgatggtcgagtacactccattaccgagaacattctcgacaaatgcggagttatcgcacccaacctaccaacgaagaccgacgacctatctcatagcaccggccatcgctggactactcgagaaaaggttgttaacggataattcctcgtgaacgtcgtcggcttgatcacccgacatgattgcgagcggacatccgaatatgctataagttgggtatgtacgtcatgctggccacatgatatgcacatgtaataaaccaactttagcgcccctttaggtgattaagagattcctactcctggttcttgaaccagtaaaacgtagtgatctctctcgccccactttaagtggtcgagttacgactactgcctggtcctcgaccagcgatgtagcgtttctcccactacttctactttcagtggtcgagttacgactactgcctggtcctcgaccaacgatgtagcgtctctcccactacttccacttcaagtggtcaagttatgactactgcctggtcctcgaccagcgatgtagcgtttctcccactattttcacttcaagtggtcgagttacgactactccctggtcctcgaccagcggtgtaacgattctcccactatttccactttaagtggtcgagttacgactactgcctggttctcgaccagcgatgtagcgtttctcccactacttccattttaagtggtcgagttacgactactgcctggtcctcgactagcgatgtagcgtttctcccactatttccacttcaagtggtcaagttacgactactgcctggtcctcgaccagcgatgtagcgtttctcccactatttccacttcaagtggtcgagttacgactactccctggtcctcgaccagcggtgtagcgattctcccactatttccactttaagtggtcgagttacgactactacctggtcctcgaccagcggtgtagcgatttctcctactacctctacttcaacaaagttgatagtaggtacacaatatcgccaagtgttttacccagagatcccttaccacgacgacacctagcattgaaacctatcctactgtccctttacgccgtcttgacaaggcctccgaggaacctaagggatcttcggctggggacgcccagagccgataaggccttgtcggatcctgtagagacaaaaggccatgtaagatctggccgtgtaatcagaaattgacttttccaacttcacggctgggggctaggatcagtgcttattcaaccaaggcaggtcaagggtccaagagccttatcctccgagaacgattctccgacgacaaggctgggggctagggagagtgtatgactctacaaactgactgatcgaagtcggtaagagagaagaccctcatacacaaaacattggtcggtaaatttaattcattttcaatttaccatacatattataacattgtcaccttttgagcgttcgctcgggggctatttctatctaatattcttttctgagtattgatttcaggaaaattctattcgacattgttgaagactccatgtctctgtggttctacaccaagatcgactaaggcgagtacgacaaatgtcgacaaagctccgtcgcagactctacgccttcttgatcgctcgagaacggttgctggatctcgacaaggaatacggaataaagacatggtgtacccgccgagataaaatttcttgacttcaattcaaattctcgattacagcaagacgggagacttagttgtacgctatgtactttctcggtcgacatcaaagattgacttagacaaaccctttcggtgcccgcacgaggctgacaaaggaagtctaacgttatctctgaactcaccgaaaacgttcacatgagctcgataatagttactccaaagtctgcgcgcgattgataatatgaattcgttcatttgcattgaagtcggggactactgtcagggttatggacgatcaacaccgatcatgagacgatcaacacccaccacgagacaatcaactcccaacacaatcaacatagaagcctacatatgccaagacaagccgccggatatcgacatcagagatacacctggatcgaccctatccggtaccttcagaggccggccgtagggatctagcactgtctctgattccgtcgggcgcgagctcgaggaggaaggctaccctgttgtcgactacgagtcagaccttcagaccgccatgtcgacaacagttagataggctacccacatattgtactggtgtgattatggtgaataagagcaataccggcttcggccaacaggatgtagggttattacctgacaactcaggggctcgaacctgtataaaaatccatgtctccatctcttttacctcagtctcgcgtatatcctagcaccaacgatccccatactgtccaaataccgtagtcgtgacatcaaacgtcgacagtggcgcgccaggtagggggattttggtgctttaggatttcgacgagatgggtttaagagatggactctccgacaaccagctactcgacgacttcggctgtggggagatccaacctaaccagatcggaaccatcatcgtcatcgacaacttggtctatcgagatcatccaagcctcaagatacgcggcgtaccaaaagatgtcagatcatatgatgtcgaacgagtacgcaataaggtaattggtagattggtttttcaaattgatctactaatttcgtagatacatccagcatgtatctacaaaggtacgcaatattttatctataatttatcatacctattcagatcatacaacattgtcagatctataatttattatgtttacctagaacatgttctttatacaataatatctgttgcgcgggtgtccccgatgttaaatcgactacgatctaacgctgggggctcgctctgtcttcttctgtataaatcatgcttgtttatggtttacataatgcctgatatttacatctgctcgttatatcctgataatactagaagacccatgcagtttttcgaatacatattcaatttgatatttaatttttttccaacgatagagctattgtggagccatctgatgctttaaagttgatgccaacaacttaaaaatttgcatccaaaatagcagagctatattcggctactccacccaaggaacaattagaaatacacaattcgctcatatttcagatgtgtcaaactatcatcatgagtaaaggacccaaatttaaatactttattaatacaacacatatcaaattatcaatgtattgtctacctcacatttctccagtgatacaccgtatagtcaggataatcgactgttggtatcattcccaaagtgaagaaaactatatctttaagcgctttgtgctcattaaaatgagtttgaatcattttggacagttgttaatcctctatcaacaaacataatagataagtaaccatggcgaataaaaagttcagatgcctaaatattttcatcataccatcaccatatgttataggaattaatatagccttatgaatttgcaatatgctaattgtgagcatataacaaaacatagtgttagaatatataatgattccataccgttaaatctttaacaatttttatcagaaccacctaattgttccaaccactatgatttagctgcactgcatcccaacaagctaatttcaattttagacaattattaatggatagacatctccaacggacatcaagctagttgagtagattctgattcttggtgattctaattctaattcaccctaaaatcagaaactaaaaaaatcaggatcaattagataatgtgtttggtgagaaaagtttgattgactcaaaatacaattaaaattacaataattttataaacaatctctcttgcaagaaaacaatcaacaagatcttatataaatgtacttccaatgcagtaacacaaattactgaagaactaaagatgacttgatcgtaatcattaaaccatagaaagtcgctacaaggcagtcaaataatattattacctctccattacatatgtttcgtgttctagaattaagcaatgatgcattagaggtacagtttactctctatttgtttgaagcgatgcatttctagtaagactggttatattgggccttaggtaaggatcaacattgtaagtactaaatgcaccacaccaactagcatatttttggcatcctttgcatacagtgaaaaggagaaaagataagaagataggggatgcaaatacactaatatagagtactctattcatcacagcccaacagtagtccattcaagcacttagctagcctagcctagcaggcagcagtgtaaccctacttcaatcacacacaacataaactatatgcaaatatctataatgtttacttctatcatctagtagcaagtaggcaggaaacaatattgtcgtgaccttaggtcacggacaagatttgggatagaggggaaagtgtatattctccgtctatcctgaatatgagctcgaatgtaaatgccaagaattgaagtttgtattcctcttcctcctcctctgttacaaggttagggttgggttatatagccctcaactatacatatgagattacaaatttgccctcaaatgcttacaaggagttactataatacccctataaagcttataaccctaagggtatattggtacatttttgtggttcctaaagatttttggcgccaacttgcaagagtagttgaagtggtccgcatggaatcttctatgcttgagagcattttccttgatcttctattgccttgggtgaaagacatttcccatgcgaggactcgaacacactcctccgttggctagctccttgggtgtctgtctgctataagtaaaaaatctccccgactgtatataatagctcgaatgtgatttgccatgaccaaacgcctcattggctatgtaaaatagctcgaatacagttttccatgaccaaacacctcatcagctatgtaaaatagcttgaatgaagtttaccatgactagagaccgccttgatcaggctcattgagtcgaaaagtatttgccaagagtaaaagatcactttgacttgttcgccaagggtgtttagactgaatagggggatggagtttaccctgcctcaatacctcatggacctcatttctttttatcccaaaatcacaatattacatagcaaaccaaagtaaaagaaaatatctgttaccaacatgatgcatacaaaataaaatgcaatcattgctcatctccttaaccaaaataaagaaaaggtggcaaaaagaactatttatccatgaagcaaatttaccattctttcacgctgtagttggtatgcaggatggaaggaaagatgtgaaccgagggaaagcggctttggtggctcttgtcgagacgaagtaggatggtcccagtggcacttggggatgaaaagggatgattagcggctaacgagatagcggaaagcggcggcgggcacgggtgagatcgagataggggtgggacggcggtggacgcatcaactgcgtgctcgtttgcacgcgcacgcccccatgccgacgtgtggatgataggaaaaggaataactctactttacctccctcaactcatgccattagttgaatagcatccctcaaccgcaaaaccggatataacccatcctccaactcacaaaaccatcacaaattgactcctcgggtggtttgggaggcggtttcgtctgacgtggtatctttgaccccttgactagctgagtcaacacatgggcccaatatgtcagtgtcttgtagtacaaaaagtctactttacctctcccagattcttcctcctccagccgatctcttgttcgtgcccatgcactgtagcgtaacctcaccttccaagtctggcctccccatcacctctctttccaaattacttgcagaaacggattcttctcgatctcctctccttttctctccaagaaagcctcatcaatatcatgttaaatcccgcgaattttggccatattcttatcccgacgaactcaggatgaaccctagttttccacactgaatccatctgtttctagaccggtcttcctctcctccgcctatatatatataaccctggtttgaactcatgccctagccgcctccccgagcgctttatctctatgttcgcccaaggccaccgctctagccgagccgcaccgccgcaaccgtcgtcgcctgaggtggctgtcgccactgtcgggttcgcaagacgaaggagaagctcggcctcacctctgcttcacttggacatcatcggagcgctgtcgtcgacatcaacccgaggtcgtcgccttttgaagctcgccgccggccactcccgtcgcctctcgttgtcgtaattgcgtcggtaaggtccatcgtgttcccctcttcttgcctatgcccttggtttccaccgccacacctttgttcgccgtcatgccatggccaccgccgtgcaccactaccaggcaccgccaccgcctctgcaagacactgacatatgtggtccgatccacatgctgacgcagctagtcaacggggttgcagatgccacgtcggacgaaaccacctcccaaatcgtctgaagagttgatttgcaacgattttgtgagttggaggacgggttatagccggttttgcggttgagggatacgattcaactagggtatgagttgagggaggcaaagtagacttatttccttcctatactttattgggtgaaaactgtgtgcaaaacaatacggttagttttactatagcccacttgaagctacatgggtttgggccttgaggcccgttccaaaatgggctggatttctcaaagcccaacaaggcaacagctggtctccacaactcagccgtttcgtttcgacaagatgtctccagtatttcacatttcgaaaaccactttcgtcaaaatcacccgctcaaaccaaaaaaaaaaaaaatccccaattcgaaacgcgattcgtcagccgtcgccatggtcgccgccgccgtcggcgaggcgacccctccgccgggcgggccaccctcccgcgtgtccgtgtcctcttcttcgtccaccccgcggcgccggtgcgccgccctcacgagccgcttccgcgagccggcgagcccgcggcggcacgcgtgggtgtcgctgcagggccgcctcgtcggcgccgaggaggcgacgtccgccgcctcggccgcgccggggctccctccggatgaggcggtggcgtgggagctcttcagcccgctccaccgcgtgctcctggtcgccaccgtcgcggctgcctcctcccgctcccacgaggcccgccgcgtcgagcaactccagcgatcgattcatattagggtttggttttactgatctcatatatttcgccttatcccagatttattagtcacatagctaatacttaatagattgaagtgttgaacccctttgttgattttagtgatctcatatatactgaagcctgtgtgttcttgtcatttcggccaagtgctatgcgtatatgacttttattatagtacctcgtaggtgattaggttccacttgaatgttgcatattctaatgtttgcggtaatgtgctatatgcacgatatctcggcttttacatgctgttcttgcagccttaagtaatcgtatgaagaaatgtttatggtatgcaggatgaggtgcttcaaagcatgcagcagaagcttgatgatctgtttgacgagatgaactccctgcaacagcagtatgtcaagtgcaacaccttcatttcctcggagcagggaaaatctgagttggtgggtagcaagaaggtaggagattatgacggagctagatgctgtgcgtgtgcaaagccagagattgctgctactcctcacaagacaaaggtattatgtctttacagagagcttgttccatgaggtattttcatctcacttccttttcatatggtggacgagtgcaggatatctgtggaatggacgatgcaaaatctgatgttgttgataggtccagcgtgagtcatatggaccatgaagagcgccgaatgtcagacctctcagacttttgctggagtgttgtgtcatcggtggataatcatgtaaatggggacaatcaggtaaatcctactccattctgtggtgaaagcatcttatttatgcgcaacgtcatcattgttaattgttcatgtacagtttttttttcaatgtacgaattattgatcaacatttcagtattaccttcattatggagcggagtgctttgataaaatctgaacatttctcgtgctttaaatgttgctgactggtgacactctggtcaattgcatccagctaagttccctggcggcagaacaggaattgtacaaccttcagaaagaatgcgaagagaaggatgcaatcataaaggaactggctgcaactgcacatacatctagcactgctgatgccaaggtacaaattgtcgtggtggtatgccaaccatgtgaattatatatacttatgttatccatctgtctatatgcagagaatagcagagctgcaagaaattcttaaaagaaaaaacatggtgatatctaaactgaagaaggacatgtcagctttaaagcagatggtatgtggtccattgctacttacatcttgtgatttttctttgtgtgttctggtaaagttgtaacatgtcttgtttcaatgtttcatactcaaggttgttgaattaacaagggctaaaagaacatcttctgtcaatttaagtactagctgctctgaactgccagtgatgtcaagtaatgttctttatgatatgagcagcactagcccatcatcatcggattctgagtctcctgtagcaccaagagaataccttgatgatcatcttaaggttgatgatggcattgctggagactctgaatacaagggtagttctagattctcaatggaaagcgcatgttttcccacaaaaaactcatcagctggcaagcttcggtcgactagtccattaaaagagaaccgtatagatccgaatgttgaaacaagtttggtcggtagacagaagcaacgtatatccaccaatggagactttaaaaggactagacggcaaagccagcaagactcaaggaacagagctacaaagagatggatgtagagtttagactgcagttattaccaattacaggtacactgaatacatgactaaattcagttccacagcttttgttaaatttattctactatcaaatatgtgactttattcagtgcacctttcttccatgtatattctttttctttgtactgtgtacttttgtcttcctcttccatcatctttgctgttgctagtcctcagaaccgtagccaatattagtgcaatactccctccgtcccaaaaaaaaaagacaaaccctggacatgttcagattcatagccagggtttgcctttttttaggatggagggagtacatctctaggtgataggctgacagcctttgccagatcagcagatacagcaaattgatattctatatttcattttgatttgtgtattaactgtaattcagtattctgttaccagatacactgtagatatctgtttattctctagatctttatttctttttgttagttgtttctttattactgaaagacttttggacgttaaattacatctgagaacacatcggctgcaacttttcagtttgtccgctttttagggatcaaatacagtcagcttctttgatactatatatccatagtatttcttttaagatgcacatcgtgtaaaacgtcagttaacttcatgtccccttttctttaaccgggtgcagcagctctttttttttcttttaaaaacttggttgatacgctgaccaatccattgtttcggcatttcagagcaggaagagacgaaattggtagcttcatcctggctcctgctgtttctgtaaacaaaaaatatcgatgcaagttgctacatactttatttatgtctatgatgaaaccgaccaattcaagctgttcatcttcgtcattggtatctgctccgatgtataatatgccatttggatctgcacagtcagcgtctctctgctcttgaatctatcgctcttttttaattagtggcttaatttatcaaacggaatccagcagttcatacgtgcacatttttcctatattacttgtttaccaggtacacaaaaaattcttcatacgagttgccagatggttagatatatatactcctggattctgtccatcaggagctcctgattctttttcttccagtagtacaacttatgtgcctatgtatttgcaatttgtcgcacaatttgatacctggattgcttgccgctggcgggctctgcatatgccattgcttccaagcttcatcatcgtttatacatatagccattgggttgggaagtccacaggggcaatctgatgaagttgactccatttgggagctctccaatcgcatctaaccaacaaagtcttagcttggaaatttggaacatatgtgatcaataggaaatagtagtcaaatttacaaaggaatcagctctgaatcgattatggattatctggtttttgagataatattcaagggtgtacaaatgaataaattagctaccccaattacgtagaactaattagacatcatatggtacttcgaattatctagatttatagtaccggattaagtgttcaatctagtattaggcttctatattttagaacgtagagtactttaaaattgaaattttgtttcgttaagaaaaaaaaggtattataagaaacttagtttttgcagaactcgcaacgtttaagaagcttgcaagcatacacgtaatagtttgcaagcattactcttaaatcggtaagaggaaaagaacaggagtcaaaatcaactcgtgaccataaaaaaacggagtaatcaaaacacgccctgcactgtacgaacaacctgaacaagtgaacaggaattcaccgaatcgcattcaattcggaggtggacacatcaaatccaaaggccagataatccaacgaggcggccgccgatcccatcaatccatcaaaattccaactgtactccatctaaaagtttaaattataagagtactgtatttcttttattactaaaagtagaaaggaattcactcgtggatcatatgaaaaaaccaagaaactaataatatacatacatgtaaccaataagtattaaaataatttcttaagttatgatcaataatttaatctaattatctagaacatagatgttgtaaatatattaatctcatttgaaaaaaactaaaaaaataaaatatgcacgaagtgagcgtaacttaactgtggtggtggaatcagcctacccaggtagcaagacgtctgtggtaatagggctattgtatacgtgttgtgtgagactgcgtttatactatgtatttttaaaaatagaaaaaaaattgaaatatgcagtgacattttggatagagagagtactatgcaatacccccctctccctctgacatgtgggccacgcagcaacggatcgagcggccctcgcgcgcgcgagaggtgagaaacgaaacgaaacgtgacgcggcgcgattggtcgtcgtcgtcaaccacctcgacggcgacttgcccccttctcctctcctcttctttaacccctcccccctctcgccgcgcgcgccgccgcggccgcgcggggcgcaaagtctgcgaggagcacgaggccgcgcagagtattctagagaaagtcgccgccccacttggcccacgcgatcgttgcagaggttgatcactcgaggtcgagggcgatcgatgatggagcaggaggacgcgaggaggaagatggcggcggcggcgggggagcgggggcaggtggtggtgctggagtgcgtggcggggagctccaaggcggaggagtggggcggcggcggaggggtggtgcaggaaggggacgtggtggaggcggtccgggtggggcgcggcggcggccccggccccggcgccgcggtgctggaggcgccgttcaagggggggcgcgccgcgctgcacaaggcgatgcacgccgcgttcaagcgcggggacacctccgtcgaggtgcgcgtccgcggaggcagcgagctgcaggcctgcatcctccctcactccggcggcggcggcggcggcggaggcggtggcggaggcggaggaggaggcggcggcggaggtgggaataagcagtacgtgctgcgttccctgcacgaccccaactacgttcttggcttcgtcgaccgcctcgaaagcgagtgcctcttgttgcaaggtaaactacttcgctcactgctcatcgctctgaaatctgaatagttcatccgttttgccgcgcattttgcaattttgctgttccagacgaattcaaccaaaaaatatattactgtttcaagttgattcaagtatagaaatgttctgccgcttcagctcatccttggtgttatgaactgaacctttttgctgatcaaatcgatttcagagaagttcggtgtgttcatttcattacgagaattttttcttgtgtgtgttcattcaatgtgttggtaaaatataaacaagagtgaaacgaacgaaacaggagtatcaacaagacagatgcggcatttaatcttgttttcattttgtgcctttcttggcctctacatgtgtttttacacctgttgtgaaaaagacaagtttgctgtcaactctttgaggttcaaaacccccaccaagaatattctgataagctgatctttcagcgcgttgttgcaggcctaatttccttgcataagtgtgtgtctttctctcacggagagaaaactaatctgcctgtagttatcaatgataagaacgatagctacatgacaaaagataatggaagcaaagtggaaagaaaatagtgataaagtatgggagaatatggaagacgtttcggaaacaatgtcaggccaattgctttggtagagattggtcgtttgtctagatggtgatcaatttctagatacctcgtaatgttcactcgttttctcaattctcatatccccggggaagatggaatttctatggtggactagactttgtagtcgttataaacagtcatcgtttgtggcctcctgattagttggttcattactgttgggacataactaccgcactcttatctgattaggctggtctggacatatatggcttttgatctacctggctagaagttataactgttagtgccctggtgcaacttttctttgtcaagcatgtgcgttttcctgtagaattcagcgcttctgaacaactggtagatgcttccatccctgactttaagttttaagtaagaaacagataatctatttcgttgtgaacttttgggtaatgaaacatataatctcttttgttgtggttttttggattatctttctatggaaagtatgtgactttcccttgattcatgaaggcactaggagcacaagagtggcatcagccctgagcagggcacaacttcaggatggttatgttgcatacccatgggagaagaagatgcgtgactcgttgcgcatgcccaactccagcagctacctctcgatgctcgtcctccccaaagctctggacctgaattcatgtcgatacgagtcctttgaggacacccttgcccgtgccaacgcgtggatctactcctcgcaggtctcaggaatccccatcgagttcatgaatgtgcagagtgaggctcttctcaccaaggtgcagatacaatctccctgcttcaggctttttgcagcctaaatttcctgttgcttaactgaaccttcagtagattgaacctgagtatgaacataaaaccccagataagagttgatttggttaactctacttattaagatgtgatctttgcacttcaaaatgtacagatatctggagagacagcgtctgcaactgttaactcaggttctttgtctgatctgtctaacgtcacgaatgcgaccctgtatggttttgaggattaccatggggtagatattggggtggtgaaagcagcccgactttggtacagctccatagcagaagagatgccgctggagattccacttgaagaaggtgacacgaggctaggattcgccatcagccgtactgaagaggtactttgtcacttgacactgtacacaatgccgacaatagtgtacctgaacaattagaactacacatggaacacactgtgacacatttctttctggcagggttttatcttcatatcttcagtggttgacaatgacaaggacaatgaggcgccatcgacacggtcagggctccgcgatctgttcaaccaggcaagggaggcatcaaaactgctagttatctcaagggtgtccaatgagaaggtccttccctggatgatctccagctcaggagcgatccgctgcttcgacaccatctccctcagccaaaagctttccttgcaccgccttgcggtgcgccccatccagctccacctgctcatgtgggagaaacctagtggtcctgtagaaaggatcattcgctctccgaaacttcccccacaatctgagctacctcaagtaccctggaatctaattgagagcattgaacctagagtagatgttgatgaggactatgtgggggatttgtcatttcggattgatgatctttcagtgggaaccagctgggtgtgatcctttcatgctgcaagcttctaatgtgcatatgtatgtcttcatttacatagttctcttgggcagtatgctcagttttgttccatttaagtgtagaagcctggctagaaatgtccagagccttactaggtttctggatataccaagggcgaggctttcataacatctgaaacattatgttgtgatgcaatgtttttgttgatcatagcataccattggaggaatacataagcatttcaataattatctaaggattatcccaattatgggcctgttaagttactcccaaacatattgttcaacactgacatttctgtactttgtactgaacataaagtttgttacacttaaaccacacaagctattggtcaatgagagctaagccatgaatctcaattatgctacttatcaagttgtgagcactctacacttgagcactcgatattggacatagaaccccggcattaccatgatctttacctgacaaggattgtgcagctgctgcttgtcaggtaggatgtcctccatgtacatctgatcgaatacgcggctctcttcgacccgcatgatcgtcagcgcgggggtgaaggagaaggccaggaggtggagcagccagacgcacttggcagcgacgaagaagcactgcagcagctgctccggccatggccgggaccaattcttcagggtggacacaatgcagctcatcttctggtcgcagaaccggctgaagtcctcgctgtagtacttggtgcccttcctgagcacctcgttccagctcaggttgcgcagtgcgacgaaggaggcgaagctctcctgggatccttgcttgggatcgaggcaccgtggcgagccgttcttctggaacgtgcagttctcgaagtcctggtacattgcctggttcatcagagcttccagatggtacagcaccagcttggagcaatgcttgttgtcagtgatcatgagctggtaaggttggagaagaatgtttagtttttctatcaaaccattgtcaggttcttcgacctgctggatcaatgccttgcagaattgcttcaccgaaagccgcgcctcggaggcgatctgcaagaagccttccaccatggcttcatggctgaccggccccgggagctcctggcttgctccgatcgatcgcgttgatctcctcgacatggaggatgatgatggttgagcgttgctggttgagctcgtcgctagtcgcagtgccttcttgagctccgagcagtaggcctcgaggccggcgagcttggtggtgagctctcccagggacgacctcatctcggcggcttcctgcagcgcggcgtcgcggtgcgcgttcgcgtcggcgagctctcgccggagcgagtcgagcgacagcaacccccactccttgagcagctgcgacatgttctcccgctcgatggcgctcggcgacatcggcttcgccttcttcttcgccctcgggaagagccacgagaggatctgcgcccttctgtgcttcgccggccggggctgcgccgccgccgccgccgccgagagcggcgcgccgctgctggcgaggaacttgagggccccgacgtcgatgccgtggtcccggccgatcgtcgccggccggaacgcgctgccgcacgtcgacggcgccttgagcagctccgccgtgccggccatggtcgccctccccgccgacgcgaggaaacggtcggccgacggcgcggagtgcaagaacgccgggtggaccttgtgccgccggtgatggtcggtggacgacgggaagcggagctcgctgttcgaggacgagaaggcgttgaggttgtcgtagtcggagaaggccgcgtcgtcgtcgtcgtcgccgctgccgccgccgcccaacgcgatgccgctccagttctccgaccggctccggttgtcctggcaaatgtggctgagtccggccatttgctcctcatcgtaagcctgaccaatttaacaagaaattcaagccaaaaattagccaaaaaaatcttgcaaaagaacagaacaaattcagggacagtgagattgaaaaaaaaaagtgaagaaatccaaacagaatggcacattgcaacccacatttctgcaatctgcatggagttgctactgaaagtttccaatttttaccatttaccaaggcaaagtacaggttgctgctataggttaaagcacagcaagagattactccacagatgtgtcatcaagcttctttcagaaaaaggtgagaatgtgacatcaaaagaatctgagataacgcaacttttactgttgcttaactgcattacatgtcctattaattgcagagtaatagtaggagcatctgggattagctgtcaagaagaggaagaacatgctagcagcaagaagagcatgcaagttaaggagaactaatgaatggctcaagttcatcaccaacgaatgacccttgaaaacgagaagagatgaaccaagaaggcacatcgccatggcagcatcaaagatagcagtgacagggtgactgtacgcaagaaaagctcgctcaccggagtaaacaccgggtagtcctcgtcgacggtggccaccgccgccgccgccgcccccgccctggagagcgcgggggacgcggccggcgggaggcggatgatggccgggctgcggctggcgctggcgccgccgcctacgccgccgccgccgcgctgcagcagcgcggcgtggagcgcccgcagctcgaccgccttggcgatggcggcctgcacgtcctgccgcgtcgcctgcaccggcggcgtcgacgtcgccgccgccgtgccgaacgcctcggctgcggcggccgccatggccatgtcaggcgagtcaaaggctgcttcgccttcgcttgccccaaggattcttggaacgcagagcgaggcaagcgagcacgggtgaggagaagcaatggagggggaaatgaacagtagattcttgagagagagagagtggttgttgcagaggagagtgacagattgagagagagattgaggaggtggagggaactgcacatttgaagagatttgccagtgcttgctgcaagcaaggccctcttttcttttgagcttttttttggctttcttttcttttcttttctttttgcttttagctgcattatgtagattcgctgctgctttgtgtatactttgcttgattggtaggagtaccacctcaaattcgggcctcctttgccaaaaatcttgtaaaggtgtattacatgctaccgaccaatgttaaagaaacagccgacaagttggtgattaaggttacgtttttttctgtttattcatcggcttcttgggacaaagattatcagaatctcgatccatatgctagtaccttacaatactactacgattctaccaaatcaaagcggtaccgatccacctagtatttgcattatgctttaaaaaaaatgttttctcgaaaactttcttctactgcagtgctgagtagtgaaatacacttgaaatagagttttatatttgcacaaatttccctccgaaatttttctacacatacaaacttctaacttttccatcacatcgttttaatttcaaccaaacttttaattttgaccgtgaactaaacacacctctatatctgcacaaatttcgagccattgtcactatttttcacctgtttatggctggtagttggaggtaggtcaaaaatctcaatgccaacactacctctatctgcaacaacccggccattaatggacatctctgttgcgatgccctgcaggctttcttgcttgcttgcttgccccgcggtggcggatttgctgtccaaccgaggcggcgacggcgcattaaattcccggccgtcgctctcctctccggcggcggcggccaccgcgatcgccgccggtgacacacgctgccgtgtcaggctaagctcgtgacaacattctggttggagctcggactgaacattttcttttctttttttatggttagctcagacacgagacagacattctgcttagctcagctagctatcacgcgcgacgcggacggaatactgataagcttttttttatcttttgaaagataaactattaaaaggttggacctttcgtcaggaatgcaacctggctttaactaccatttctaaaaagaatgaagcgtataagatgcagttgttgttgttattggtatttttttgggtagatgcagttgttgctgatgatccatttcctcaaaacttaaaatgtactctgaaatctctccatgtcagtataccataaagaattttacaaacattaaggtactatttttcttagtgtaaaatttagtatctttacataccttcttaagcgaatatacaacaaccagacaaatttgctaacatgatatagatgagagtagagagaaatgttgttataagattaatatgggcttaacaatgatttttattgtttataaaagaaaattgtgctgtgtaagagtagggaagaggaaagaatgtaataaaaaaatccgtatactaatagttagagcatttgttatctcaatcgttatatgatgataatctctaactgagttgtgctttaagagccacatcaggttctacatttgatcatgccctaatgggctgtgtacatccttttttgggtgtagaggccggtttaatccattatctaaaaaatttgatcatgccctaatggctttaaaaatcatagtatcctctggaacttatgaactgctgaagcagagacagagatttagatgttcctttttccttgattgtttttttaaggggaggatctcaaggagtctgtcattcttcgcattgttttgagcttagtgcaggattggtcaaaagttagctgtaaaaaggtttacaagatccaagttatacacctatcttgaatcttaaattaaaccctcagggaagtgtcaagcagagagcatactagatgtaaagctcaaggtcctagctgtacatatgtccaatccaaaaggcccaagaatcttatgccaggactcaagatatgttaagggggtaggttgatcattcttaactttatccatggaaatttctcaacaagtgatctgtgaaaggttttttgcaagagacaacacaaccaacaaaaaggtgatctatccattccttttctcctctttacacctttactgaattttcctttgtatcggagtgcttttccaatggcatctagctagatggatctttgcacattgagctcaccatggccatgcatacatgcatggaaggaacaagattggacgtctcattgtcaagttaaccacaggggctgcgtgctactaaagcctaaaaaggcactaaaccaaacactttgagcgtatcttatcttaaccttttacaaccccattgattgagtaagagctgattataaacttatcaacataataaaattatttgtgagtaaaccttctctatatatgtgttcttagcaattttaaagccaatgctggaaaaataaactacaatgaaaaaaaaaacttaaaatcaacttcaaaattattttcttttggcagtggcatatataaccttttatgtgaacccttctattgtcttgcatgcatctgatctgcaaatttttaaaaggagttttcagagcaagaaaacgaaaccaggcaggcaatacccccaaagaggcctttgtcttggcacaaagcaaggaacaaaatactccagctagggggcagtatgcgaagccaagggtagctgcagattgttgcagattgtatacctggaagggatggatgtctgtgtccatgatggtgtttgtttaatccaaaatggcatccagtgatgcccatccattatactagggatgtgtgagtccattttgtttgagggttattaatttattaatccattgtgattgattttacaaatcacaacaaaatagccttagaatccatttttgtccgggctgttgttcaggacaaggtggtgttaaggtcatttggaattcaccccttagtttaagtatgacaggtgcatgtgagctcctagtcctttctggctttctgtccactcttggttaggttaggttaattatctcttccctcttatccttcaatcatcggtcgttttgctaaaataaaagaaaaacatagtaacctttcctaatagcttatatgagcctgaatgcaataagaaaaatacaagtgcagaaactgatttagggcatatttggtttgctactatcttcaaccttaccaaattttaatactcctattgccaaattttttaccctgtttgaaacatattattcactggataattgccatgggttatctacatgtagagataaattaaacatttttataaacaaacttaacaaatagtttagaacaagtagtgtaagcaatgaaataaaatttatgagaaaacatactttagagatgcataattttcccttaacttattcacataactctgcacaaaaatctgataatgtatcaaaccaaactaacagagttattaagggggtgtttggnactctcaaaaacataagtccctcccaaacaccccctaattttggcatcaaactgaacacgcctttaatcgaacagaaaagcagtgtatctttcaggccagaagagtacagggaagcacaacttgtgagtgtttgctgctgcaaaagattgcagcgtgcacagtactaggggtgaaaacggagcggatattatccgatccgatccgctccgaatccgtccgaagtgaggatatggtaagggtctgtagatatccgtccggatgcggatgcggatgcggatagatgcatgcggatgcggatgcggatatggtatcggtaatatccggcggatacggattatccgctattttaaacggattatccgataaacgttttggcggataatccgaatttcacagcccatataaccactcaatttggcccatttgacatgagcattttcatcgtgtaaagattcagcccatccatgtccaccttatccatcaatctatccaggagttcagtccgtgactcaaacgacgtcgcgtcaaccaatttttttatcgagacttctcttctttcagtcctcccacgccgccacctgacgccctgacttacgtgtggaacttctatgtcttatgtgatactgttttttctaacaattgtgaaacttttatgtcttgcgtgttatgtgaatgcgatatatcgtgatgtcaatactgtatgtgtcgattacatgcttttggacagaagacaaatcaatgttaacaacttgacattatattatgatgtgattggtgctttcatgagtcatgtgaattgtgatattggtacctcattgttgctcattgcacagatgataagatgttatatcgattgtatatacatatcacatccgattattttcatccgtttccgagccgagtccgcaccgagtccgcatcatttccgacacccgaaataatccgttccgcatccgcatccgcacattatccgtaccgcctccgaatccgattaaaaaatatggtataggatatggtatgactactatccatccgaatccgatccgttttcacctctacacagtacaatggttgcatatataggactgacaaaagctacagccgcgagtgcgaagccaaagcaggtccaggagacagatataactgcattctgtgagaggcggacaagatcagcggcggtggcaccactgcacgacccggtcggtggccatgcaattgcagatgcaggtcaggtgcatttgcaattgcaacgcaaagaggtgtgtttggttggtgcagcttcttttccgcggcgcctttcgccgcctggtccagagagagagagactcccattgtttcccccattcagcatttgttgttaaattttgaatttagaagttaaaatttaaagttgatttttgattttttttttcatcaaattttattttttatcattagtatttaagtcgttaagaacacatatatgacagttttatctataaattattattattttgttaatacgtcgtatggtgtattatccgtattcggccaaacaatggtggcctaggaggatctgcacgagagcttctaacggttgttgtttcttttaaattaaaagctcacttaaatggtttaatttgtcactctagattttaacaagttgtagttatgggataaaaaataaactaaaaacaagaagttagttttttttcccttgcttctcctgattctccttctcgaaacctaaaattcctcacagacattatagatcatgtttaagtagctgaagattttgataagcaactagtaagaataccaaaataattttttttagcctcttccttttagtttataacctttagtatctgaatcaaaaccagactcttcgaaagagtagagagatttaggaagagttgtagctgtcaaaaactcttctaaacagggccacatgtgtgcagtggttcagggacagagatatcaggatgctgccgaaagacaaggtgccaaaagaattaatgctaatggctgtcttgacagtcctactgtccactgtggttaagctattacgcatggcagggcaggctttgaggctactgttactaatgggccctattatattgtttttttcttgttcatcttttcttcctctttctttgcaactgtagtaggagtacagtactccatttgtgcgtctcaagagaatggatgcccagtcagtgtcgttcttgggagttggaaacagtaagataagtgtactaggggctggtttggttttgctaccatgccaaaatattggcaatgccaaatcataggcaaaatttgatagtgccaaatgttttggcaacttatgtaccttataggcacattttgttagcaaaccaaacactagccaaactactatttaaaatgccaacaatttgatagggcacattttggcatcaaaccaaaatggccctagattagtaggagtataccagaacgtctttgcaatccttccaagggaatgaattggaatagtaagataatatgtgttgtgtaattagccggtaggttaggtccgagcttccaggatggtggtgtggtgtgagcacatcgtgctagcatgctaacagctaatgccactcattatgcaaggcccacaagtttaacctgagtaatactccctccgtcccaaaatataacaacttttaacccctagaatttatcttaaaatataatacttcatccctttcacaatgtaagttattctagcatttcccatattcatattgatgttaatgaatttagatagatatatatgtctagattcattaacatcaatatgaatgtggaaaatgatagaatgacttacattgtgaaaaggagagagtaacttctccaccaacattctcttcccaaccaatcgcaactctccaccattcatttttcccatctaccttcactactcatctaatcacaaccctttacaatttacatctacctactttcttaataaccgtgtccaactctaaaacttattatattctgatacgggggagtagatcattatgctcgagggtttttttcccctctgaatagatatgtcaatatctaataagtttcagacttcagacgacttattcattattggaagtaaaatctttgctgctgctcaacacagtagtctactgcttatgtagctcactactgtttgcagttgaacaatctgatacatgaaaataatgtcaaatctgacaggcagccataggggtgggcagaaaaaaaccgaaccgaaaagactgagaccgagaccgagaaattcggtcctaggtagtgaaagaccggattttgttcggtcaattcggttagtcccctcgggtaaccgaatagaccgaaaagaccgaattaccaaaaaaaatatctaaatgcaacatacaatccactatatttaataggattaatctctaattttcacatcctacttcttctaggcatgcaacctattaagagtctttactcataagtgcttacgaatttttttttgatttttgtgttgaaaatttctattgtttctttgcatatatgaaaatattgttgaatttcggtcaggactgagaccgagaccgagaccgaatttgtcggtcctgacattttttactgaaattcggtcttcacttttcaaagaccgaaaagaccgaagaccgagaccgaaattttcggttagaccgaatacccacccctagacagccataccccaagaccacaaaaaaggggggaaatgtactcactggcagacatacattgtacgctcaatttatgcataatagcatcgatggcattgccggtgtgtatacatgatgcagaggacagggatgtgacccccttctgtctaaaacagcattgatcacctcatgtagagaaacactgaaaataaccttactgataattgttgggaaaatgggaccccatctgcaaatgggttgtaataagcccacaggaattgaacatgaatcttgcaggagcaataaatccaaccctccaagctcaatgctcaagcatcagaggttaccagaaggtacatcgtcattgttacatttggtatagtagcaactacatgtttagtcataacaggggaagtaacaatgtacatctgcaatagtatggccacatccatgcaatagtggatgctaaatcaaaaggttctgtcaggttttccaaggtcccgtggtccggttctgctgtacaaagaccagaatgtgacgctatgaaccctttgaaggtacaacagttgaacgccaccaaaagctaacagagaaactaatagaaagagatctgacgtaatgccaccattttggtggaatgtaaagcaagtcaccctcctccaatatacagtccaagaaatcaagattttctacccgtgggaactccttcagatcaacgttgtcaagatctacctgcacaaacatttgagctgtgttgataaatgggcagttaggagaaactataggcagtgctaaaattatcatggggctagaacactctgtatcctcacatcgcacacaacagaattggacataatgcttttaaccaaataatctgagaaatggttatgactagcaggtaactgaaaaggttgacctagaaaatggaagtcaagcatatttattgtttcctaatttagctctttaaaatgctctgataagtagatccagcttgcaatttcatgcttaagagtaatcaagaagaggatactaacgctgagttcttttcagcaactcattggcaacttactcattttccgttagcacgcatccaaactgctaaacggtgtgtttcgtgcaaaagttttttatataaaagtttctttagaaaaatcaaacaaatccattttttaagtttgtaataattaatactcagtcaatcatgcgctaatcgcttgtctcatttcgggtcacatccaaaatttccgccaaactgcccaattgaatggcccaagaatgcaaatctttggctcacgatccatatatattaaatggtgatgacctgcaaatatatattttttccaaatatgtaaccaatcgaacggagttatgtacctgactggtgttacttagcatagtttctgtgtgtgggtacaagtcctcagatatggaagcaggatatagtctaatatacttccttcccaatacctatcaaggagaaagcaaagatattattaaccaataactgttgataaaagttaccaaaagaaactgctgagtactgatagttatgaactatgatagtactatgcaaacatctcaaatgggtcagccgtccaccatcaatggattaatgatgtgcagaaaggcatttgaatttgtcagctaaactcttaaatatgtatcagatcgctatttttttttggaaaaggagtatcagatggatttgaatgtttggacactcgaatcctttgcaccgcaaagtttcatttacaaagattgattcgctaatattagctttttcttgactgctccaatcaattaaacttatcagatgatcattgttgccaattttgaagaaccgtttcaattatttcaatcaattaaacttatcagattatcattgttgccaagtttgaagaactgtttcaattatatctacctggtagctgactacggaattctgagtagatttatgcatttagacattacatagatgacatgtcaatcagcacctaatcataacgtgatgagtaacatgatagcataaacagtgtgaacagttgaacttgctcatagaaaaaagagtatttactctagaaaaaattattgacaacagatccaaacggggaaaaaatatgaaaaggagtactcacactatacctgagctaaaatgttgtgatgtggatcatggtgcaatggtgtcactgtcccgtgtggaccaaaccatgcattaagtgactgaagctcccctccaccagcataacagtagtcaggaaccattatatcttcatggagctcttttatctgcaaatggcacaaaaaaaaaactgacaattgggcttatacttactagagaatccacaatgatagcatggttacctgttcaaacaagggatgctgagccagatatgtcaagtttgaaggacagccagctgaccacatcctctcaaggaactgagagaaagtgattagctcctgcttccactcactgcacacataattttttccaacctgacagatattcaattacattagtgctatataagtattcagaggtaggtcaatacaggaggaactttcatcataaaatgtcttcgagcaagcataattactcgatgcatgaaaaaggtaactacgggagaataaatgctgcatactaattggattagccatgtaattcagttgaataaatagcatttttgagacactaaattaatgggtaaatatgttacgacacaactattctactgtgatcaaatttcaggaaaatgttccatcacatagaagtcttgtgaataataataataatctatgtatgaaaagattgttcatgcaagagcgccgtagagttaatctagctgtacatgttaaacaatcacacaatcatataaaccaaatctttcggcaaaataagttcatacagaaagagcattgaacataatatgagtaagttaaaatactgaaccaaataccatggcaatatggcatcaaactgaaaccaacaaatatgaacggaacagcttaaaataggttcaatctacctactgttctgatcaccaaggcaaaagattagtgttccaacttgcaaccggaagaatacattgtaacacatttctcaaaattgcacctttgtacaagcaagttgagtcagagacaaatacaagatacaaaaataatctactgtaacttaatgttacttgcagacagctggccaagttcactaaatatcatattttgatgtatataggttgtttgttacaaataagtaataaaacttagcaccaaatttagatgcacttgtttattttacttcaattgaaaagggcataatattggcgctcgaatttgttactatgatcattaatgcactataaaaactataagcatcgaatagtttaaacaaagttaactaaacagaaatggcttgtttccatataatagtcttccagatctagtgtaaagagcaaaaggcatttacttcaacaggaacagttcgatctccagcaatcttcttcaggtattggatgtctttccactttgtccttgcaggccaatgatcgatgcttccactgattataacaggggactcgcgtaaaaagtaatcacatataaattcctccaaagaaatgcatgatcgcctctcaaccttcttacaagataaagactttgccggaagaatattaagtgcctggaaaaagtactgtcagtagtaatacaagatgagcagaaggtaatgattatgaatgcccttatccatacaacaaattcagaaaatgagtaagcgaagtggtaactagaatgaacggtacaaaccataaggagtaatctacaaatcttcactgatcattccagaaaaaaagatattcctacaatttatgagttgatatacggcagttcacccctaacagtttttcgccaccagtttgttccttagccggatctaactatatatgaaattatatagttgcagccatagttaattacgcatactgcaatgagctcctaaaaaattaagctaagttggaacccgcattgccgcagaaaagcgcgcaaaacaaacacggaatcctacaaaggcaacagcgatctcacatcggcgacgtctcgattcctctcgagcccttccctccacctccgggtctcctcgtcgacggcctccgcgtcgccgccgccgccggggtcggcgacgatgcgcgctatggcggcctcgaggtcggcgcggaggaggttcccccccatgatgaggcccatgtcgagcgccctgagcgcggcgcggcggtcggcggcggccgcccccagccgccggagccgcgcgacgtggaggcaggcgagcgcgtaggcgtccctccacgcggcgcccacctcgctccacggccccgagtggagctgctcccacgccatctcccgcgccgcctccgcggcgcggaggtcgccgcacgccgccttctccgccgacgccacgaacgcgaacccgccctcctcggttatctcccgcagcagcgccgccctccgcccctcctccgcctccgtcgccggcgccggcggctcgccgccggccatcggggtggaaagagaaaaaaaaaagcgcaaaaagcggaggagatatttttctggtcgtcgttgcttttgctccggatgcttcctcaacggggatatttgcttactccgtttggtatgctaatatcacgaaatgactttctaatttgggacagataatggttgggttcggcccatatgctttgggcccactagtagacaacatagcaatatatttgggccctgctgataggcctatgtttttggccccaatatatggtagggccatgtcagctggtaccaacagatcgttaatgggctaaaaaattgggccagtaatatatcgatcataatcggcccagaaaatttagattaaggcccaatttcaaacgcacacttgaatttcacattatttttcttatgagcttcacataattcagaacaaaaaaaaaatcaatgtttcttgcattcttttcagcttatggcccatgagttatatgcggataatttgtgtcgtgtttcaaaaaaaatacaatttattcaagaaccttttacattagcattaacaacatcattgtttcatttattcatttgcttatttgaatcacttattagcaaataaaagatccatttgtcagtaaaagttttatatacatatccttatcgactcaaaagcaaatacactaaagtaaactagggtgaaaaaacaaaaaaaaattcaaaattaaattctaaaatgcaaattttagcttataagcaagcaccaagcaatgagatcctaattgtttagataacttattctaaccaaaatatgttatatacttttataatcggttcaaatcatccatttcaaaatgcccccgactgctggatattcgtcggatcgaaggtttcaaaaacgaaaattaatcttgaaaaacctcacgttgcaaacgcggtttgatcgagggagcatgcacactcctacagattaaacgaattaacaacgactgcaggttgcgttttcatcaggaaaaagtttgattgagctgcatcaacacttgatgaaccagctgctgaggtaagatccgctaattcaagatcctatcgacagagatctcgatcgatcgaccaagcagtcaaacacgcctactttgtttacatcaaagggttaatgcccaaacacagtacacatcggttcatccatccatccatccatccattccatggggggtttcacagtcgtcgtcctctctcgatcgatcgcttaatttctgatctctcgatatctctaagctgctagctaagagctacggtgtttgcatgcgttgccggcggcggtgatctcaggtgtggggggcggcggagtgcggcggcggctggtggtcgtgaggcgggtgcctggggcgggtgacccagagggagctgagggtgcggaggcggtggaagtagtcggagacggcgagcagcgaccgcgccatctgcctcgtcgtcagcacctgctgcagccggtgcagcgtctgctgcctcaggttctcagcctgcatatatccagttaattaattacattagaattaaatctactaatcatgcacgagctatttagagtaagtataatagagcgctataagaagactgaatgctgagatagatgagagaggaaaggagagagagagatgagaaacgggactgtaagcttacagccgacttaggcaaaaaaaactaaaaaaatctatgagacagacaggtggactatatatctatagtgaagagctaaccactttataagtaagctgagatatagaccataaagatctatacagtaaacaactaaataactggttgtcttattagccttgctcttagcttgtcggaatgtctgatgctttgccaccgtcatgccaaaatcagcagctaatcatccagaagcacagttagttgaagactttggagtggagttggagttatatatggtaaaactattatatattcgtgcaatccacgatataaaagtaaaaataaatattggacgtttgtaaatttgtcactggttttttctaattttaaaaggatgccactcgaatgatagttttgcaaattcaactctaagattatattttagacgcggatgataagaaaacaaatagacgataagagactataggctggaactaaatcatttctattttcaaaaacaaaacatatattaattcatacttgcatctcaaatggatataagaagttatcctcctatatattttaattgtaaaaaaaaagcaacaactagttacacgcattgtaggaatattactttacacatacgtggacatcattaattagttggctgattaattatactaagcacaaacagtaaccaattaagcaagttgcaaagtgtgatatgaaatgaaatgtgtggtcgatctgtttgtggcatccatgagcaggtgaagggcggcctataaaaaccgagcagccaggcacatctacccaacatggaaagaccgatgaacaaactaacaattagtcaagcaataaaccctcataaattatacatgtttgtggtgtttgttacacagccttttcagggtttttatatcaaatccaacctctgctctctcccgtttctgggatggagacagtcgggtgcttttcaaaagctgaaaaacctaatccacatatgcttctctgtcgatcgatcgacacaacacctagctaggcgacagcaattatctaatttaatcatgaacatattcagtattgcagtgtcgatttcaattaggtgaactatccattgaaccttctcaactactaacaaatatatgtgatcttctcccattggctccagctctaactaatccatcgaagtgacaggagattaactaacaaataaactataataaagtcataaacatgtagtacaacccagttttattgttccgaataattaaatgaacagatggtatattatctgactattcttgagatactcgacgtacaaacgaatgaattaactattataaagttaaaatgtggcttttattaaaaaaaaattctaggcaatctatatataatttcttgaaaaaaaaatcgtattgttcagcagcttggaaagtgtagtgcgataatcaatactccctccgtcccacaatataagggattttgagtttttgtttgcaacgtttgaccactcgtcttattcaaattttttttgcaaatataaaaaacgaaaagttgtgcttaaagtactgtagataataaagtaagtcacaaataaaataaataataattccaaaaaaatttgaataagacgagtggtcaaacgttgcaagcaaaaacttaaaatccattatattataggacggagggagtaattaatctgtaagaggaggaagtacaaatgggcctacaactgatggaactgaagagaaaccaactaactgatgatgaagagtgcatgcaatgcatgactgaactgattgcaagaagggttggtaatttggtatggtttggttactgagctcgatcaaatcatgagagaagaagatgcagacagtgtgtgagaatcacgcaaggtagggtacctggcggacgaagccctcgagggtggagagcttgttgatggcgacggccatctggcccatgtagttggcgacgttggaagggcagctgagggcgtcggagacgacggtgtcggagagcgactggtagagcgcgtcgaggccctgcgtcagcgcctcctccgtctccagcgccgactgctgcagcccgtacacccccacgatctgctgctccgtcagcggctccacgtgcgccaccagcatctgcatcccctccaatccacattgatcacaattactacttattaatcaatccaatcacattaatcacatcacgaattcagtcatgcaatcgagcaaaaaagaagagaacaaatgcacacaaactgttgctctgtcagctagtgatcagatattcagatattcattcaggagttatagtatatgtcaatgcaggtactgtgatagcagctgatataacagttcagtatacgcgatcgatggagcagtttaattacactgaaaaacccagcacaattaatcgtaacagattcgaaacgaatgtaggtaaatcctgaatccgtaatggtttttgttggtttatcagtactgctacgtacgtacgtacagttctacaacatttggttggattcagttgtggcccggcttgaaaagctgaaatcccagtttcctgatctgattatgatcagatcgatcattcaatgcgtcgatatatcgatcgattcgatcgacgcatgcgcccacgcggtcgcgaagatggcggggaatgctcgcacgcgcgcgagcgcgacagatcgatgaagctagctatccatccactactcgttgtcgtcgtccagctctctccatggagggagagggtatgatgagcttgccgagcaagtgcacaacttctcctacccattgctggaaacgacaataacaaggtgtgtgttttggcttttgtcacatgaatattattcactgcctccgcgacccatataattaaggtgccaatgctgctaatactctctccgtttcgtattataaacaagtactaaactaaaatagggtttactatcgacattgtttttttttttaaaaaaaaagacattttcctttacagacggctaggatgcatttgcaaaagacggaatcgcccccctaacagaaggccaatgaaaattttcacatgtagaaaattatcacattccacaagcagttggcttaactcaaccacgtgtgcggccaccttaagtcagccatatatgaaactacgttttcgtatgcgatcaatgacacgacccttatggattgtcaatgcagtcggagggggcatcaatagaaatcattttttatatagtgaggctaagtattatatattttcaattttcttatcgaaattgttttcgataagttacttttttcatgttgatcaaaattagaaatgcgcaaacttttttcatgcgacatttttcttcatcactctgaagacccgagctagttaaggttgtttatgtaaattcttttattttcttttgagggactaatacgcaatataaaaatattcgaggggtttcaaagcataatccaaattattttttccccactttgttccgtttgtcttctacctcccgacgaagccattgtcaatcgctacgagcatctagggttagggttaatccaatccaagccaatccatggcggggggagtgcatagtagcgtaccttgatgacctcggaggggcggaagccgccgagccagaggaagcagcgctcggctgggctcatccagacgccggagatgaggtggaagacgtcgcccctgatggcgccgtccttgatggcggcgacctcgtcgtggtgcgccaggcagctctccacgtacacctgcagctccccctccggcagctgctgctgcagcgccgcccgcagctcgtacatcagccggtggtgctcctcctgccacctcccgtactccacgtcgaacatcgccgcctccgagctcagccccccgccgccgccgccgccgacgccatcgatcccgcccagcaggacccccttcccgctgcctccctcgccgatcagcccgccgctgccggggaagaacaccccctgcaccatgtatagatccgtacacattttcatccataatacataatccgaattggttgtgtttgatttgatttgggtgcagtttgaattttgctcgaatttgaaattatgaaattcgcctacctgggctctcgcggtgtgcagttcctgttcgagctgagcaagcctgatcctgctggactccagctgctggatgtaagcctgtcgtttcagtcaaaatttcagtaaagtaattaatccacagtggctgaattgaagaagagtggtagtaattaactagcaaaattaatttggtttaatttgatcaaatttgggtgattgcttttgttctgaatatattgaatatatatagcctgtcattttcttctttttctttctgtgtttaattactgtttaattttgcttcactcaccttcttccttagcctgcttttccttgctgcctccctgttctgggctagcctcctcagcgtctgcatatatttacattaatcacaaaatgatacgcaaaaaagtaagcatgatcagaccaaatcatttttagtattgtccttaactcaactgatatgcacaaaaagagaacaacaactaatctctaattatttcttgagaatatcactagtatagtacctttgggtcgcgttcaccagtagatacacccctcctgtgatccttctgcaataataaaaaaaaacataaacaatatgcacattaatgtaagctaaaacataaaaacaatcaaggacagtgttctgaatagattaatcagggtgttttctttagctagcagggttagatattagttggttaattaagtggttaagtgatgatgctgaccttggctgtcaccggcttcacatccctgttgatccctgcaggctcagcagcgaaaggttggtgctgcaggtggtggtgatcctgtctcctgctccctgtcgccaactcctccatggctgctgctgcttgctgctgatggtggtggtgatgatcaggtgacctcgccatcttggttcccacagctgctggggacagcactaaactaatctctccctgccaaatcaatcaatcaatcatcacatccacaaacattaaaccaatctttgatttcatatatactacacacgagtgctacattgaaaagacaaatgacataaccaatgtgagattcagatgaaagtaagtaaaattaattaaataccttgggtgatggctccacatgcatgggctgggaagggaagatgttgagggtctctgcatcatccatgagcacaacacaaatcaagagatcgatcgagcaaaagcagaagaccagctaaccctggagactcacacaccacaactcacaaactgatcgaattgctactgaaaactctactgaagaagagagctaggctgtatatatgcaggcatgcagctggaacaagacactactgtgctactgctgctgctgctcaaattcatcatgctttgcatggcagagagtagtgtgtactatatatgcatgctaggtacgtccaaagctagctatagctgcagtactgcaggcacacaggcaacacgagaaagctgggggctacgagagatacgggagccaaggacagatatcacacagctgcacagctagctgctgctacactgcaacactgatcactgtaacctgaagctggaaacaacagaagtggatagcatcgatcgggtcaaactcgaacaaatgtgcacatcttgctactactcctagctagtagcagcaacaagaacgatcagtagcatggggattgatcgatcatctcttcggcgtgtgtgtgtacgtccctctttctctgcaccaggccacatgcagatgcagctcgatctcggcgaaatcattgagcagtttgttacatgtcacagtccaaaccagccggccagatcttagcagtcagagatagagagagagagagagagggaagagagaggtatagctagagagattgttggtttcatatgcatggactttgggttgctgattccctggtcctgagatgtgtgatctccacaggagtgcagtggtagtagtagcagtagtagtactgcagagatttgttgcagctagcagatatcctggtcaaaatggagtacctgagaatctgctgcatgcaggccggccggccgtataccatgatcgtttctgatgaccccagaaaaaggatgcaactttctgcaaccataggaatatatccctcctcctcctatactacagcctactgctactccctgtgtatgcttggcacatttgtttctgtgcctaagctatatatactgctgttattatgctattattactactaatgctaaatgccaaaagaagaacaactgaaaactgttactactgatctcatcacctgcattaatactctttgaaaaaaaaaatctgaactttttgcaaggaaatatatatggtgaatgcatgtttgagaaaatttgtggtgatttttcggttggcgaattaaaatttacgggtttttttcgtatacgtacgcctttgttcttggtgcgacgccgcatggctgccatgatccaggtacatgaacaaggcctggtccagctcccccagatgatcataagctcctgcagatgcctccttgctgctcctggtggtgcaacacaagaagcaaaattaggagcagcacaagaagcaaaattgttggtgatgaggtatagctatatgtatgtgtgagatagatgcaggtagtatagtagcatgcatgcacaaggttgaggaagtagtgaaggcatcacacatcatcatgaaatcatgcttctataagccaattatgtatgatgctatattaattatttgtctggtccaacctctgcaagactgcaagagtaggagcagaagaataatatgaatctactctacctttgtagcatttattttggcacagcccagaaaataagcatggccatgtactctccaaatttcatgtgtgcaagtcatgctcactgtaaattaaatgtaaaaacttgggcagatatgtatgatcagttggtcataaatatgtcttaggtaatgctcttgtacttatgcggaaatgaatcgctgacctcccaaaatttgaaagaaagactagcgagttgttgcaacaattcaactatatctggctccagatattaaatcacaagtactgaatttttaaatctgaacttgtttgatcatcgtctaactttttttttcttggggggagaggaagaaggaagagaaaaggaccgatctgtttgcatccgctcaaacaatcactgaattcccaaccaggaagcaaaaaggcaaaatcgtctgcatgtaaaatgcaaaattctagcaaaaaaagaagcaaaatcttcaacatgtagaacagtagaatgcaaaattcagtccacaagaagattattggtaacctagtttctccatggctagtgttttgttaaaagaggaggaggaggagaagaggaaattaaagcagtttccataaaaagaagaaggagaagaagaagaggaaaccatggcaaaaaagagatcagaagaaccagcagaaacaaagagagcaagcaagaaaaaagaaccaaaccaaaacaaaccatgcatgatcatgactaacaaatcagagatcaaaatcaaactccaagacacggcccaaatcaagaacaagaaagagacacacatatatatgcatcaaacaaatcagagagagagagagagagggagagagattcagtaaacaaagccgtacatgaagcttgcggcagcggcatgcatggaggaagaggaagacgatgacggaggcggatgatgatggtgctgctgctgatgctgtccgtagtgatggtggccatggttcatcatcatcccaaaggagatgttcatctcctgctgctgacgatgctccctctcctgctggctctcgctcccgctcatcatcgatcgatcaaatcaaagctaacctcttcagaatcgagaggaggaagaagagaagaagaagaacacacgccgaaacatacacagagaaggcaaggtagcaagctatatacgtatgcgtatgtgcctctatctatctatagccatagctgcaaggtcctaaatactctttgactctatgaggctagcagccaaggcgccacctctctctctctcactcactttctctcttcctcttccacaccagcaactaccccatgcatgacctctagctctatctaggactctagttcgtgatggcgccttggacactagcaccacttgcaaactaccctctcttactgctttgatgatgctgttcctgggctgctactgctttgatttcctcttaattcactaatatggttgctgatgatgatgatcttggctatgtgtttctagagagagaggtgagtgggagagccattaatggcgaaacagactttctgtttggctccatgctccctctgcatctaatggtatactgctacaaacagccgacttcttctcttctctcctctcctctcaattttctctctctagattgagagagaagtagagagagagatggaggggcaggtgaagcagaagacgtcgccacctttaatttttctgccacttttgcaccgaagcactcgtggtttctcttattctcgtttcaattcaaaccccggccggtgacaaattgcattagccattaatttagccactgtattttgttaactaaaaactgaactgttattacgatttgagatgccggtagagttgtgcagttgtgcatgcatgcaccaattaacgatttgagatgtgatcctttcaacttgtctttgtctctgttttgactttcggtagaaaccgatattgatgtgttcactcccaacagcaaagtcagtagtacgtactaccatgaaaaaagttggtcagagccacccaaagattgcgagagagaatttttctatgagagtgagctagaaaaagtaagcaatgccttgtgccaaaaagcccaggcctcttctaaaagtaaagtgagttcaaactgcccgtttgtctcacggcctcgatcgtgtcgatatgatgttgtagagattaattgatactatctttgatttttaaatataagtcgttttagccttatgataagaattgagaaaacaatacaaacgactttattgtgcttcatttatactgcggggaaaaaatagcgtgtttatttgtgagcgaggtaggtagcatttatttagcaatgacgggtagggaagaaagaccgaaaaagtgtcttgaagttccaaaaggacttgtatttaataatacattgagaagtttaaaatgatttagaatcagagagagtattaacttgaaaatttgcaaaatgtcatgtgaatcagtttaattcccatagaactccatgaaactttgtacccatgatttcaaagaggagaagaactagataggtgtggtgtaaaaaggtaacgtaggtagcatgatcgaacagaagcatgcgacgaacaaagaaccacccgccttcctagccatggtccccaaaaaaatatacatatagtttaattctaaacggaagaaagatctaagaaaacaacacaaatgattttatcgtgcttcatttatacatggaaaatgattcatttacttacgagtgaggtagcatttatttagcaatgacaaccagggaagaaataccaaaatagtgactataaattccaaaataactcatatttaagaaaacattgagaagtctagaatgatttagaatatgagggaatattgacgtaaaaattttacaaaactaagtgtgtgaatcagttcaattctcgttgaattccactacccataattccaaagaggagaagatcagctagacagctagacaggtgtggtgtaaaaaggtaatgtaggtagcacgatcaaactagagtaggagaggacaaataaccgtccacatgcctagctatggaaaaaaatatttctagtttaattctgaacggaagaagtgaatcgttttagccttgtgcggaacaagtaaaaaaacaacatgaatgacattattgcacttcatttatactacatggaggaaataactcaattatttacaagttaggtagtaagcgtttgtttagcaatatcaaacaggaaaaaagaagaccgcaaaaatgactagaggttttaggacgacttagatttaggaaaatattaaaaatgctataaaataacttgaaaatctgacaaaagcctataacattaaagaaagtacaaaatgtcacgtggatcagctcaactcccgtaaaacttcctacatatgacaaattgggaaggaaaacgttgagcaagcatgctataacttgaaatcagagggagtataacataaaaactttacaggatatctaggttttaattctcctgaaaattctgcaaaattatactttccgcctatgattagtgtggtgtaaaaaggtaagagtttggtttggtagtataggtaggttggtcgagcgaagtggaggatcgcgcgggcgacgacaaaagaaccgcccgctcgctcgcgctggctgtgggcatggtccaagattgagagccgcgcctgggatcagacgcacaagagacgcagaagaattattcgccgagtatgtgaatgctcctgttgctgccctcgaggcacgtataccgtccccaactcccaaaatcatcagtctgttgaatgaatgaaaatgaatgaatggccatcgccttacgtggccgctatctccccatcctccgatccaatgcatctttgcttaatttgcgttgcattatcccccgaattctcggcaaatttctcttcatcatctccagtttctgtttgttttattatctcgatcatcataatacaggtagtagtagtttgttatagtacatctatcatcttgaaatcacaacacttgtagtcctactagcaattatttttacgtgaaaaacataattaaaaaaaaccacctgcgccgataaacaatgatcattgagttgtctggcttaacaaaaatatataaagagacaagatagaatcctaaagtcctactagcaaactaacctgaatatattgcatgttaaaattcaaatcacatttatatttaacagtacgtttgttgaaattggttcaattctcgttgaattcctttgttgcaacggacccaattgaattggtgcacacgttacaaaaaaactggcctgaattcttggaggaacaggggagaaaagtttcgactgaccgacttaaattgttcgttcactggacgcattaactttgaagtgaatgtgctagcgagtgactggcaggaggatcgtcgatcggaccaggaggaccggaccgagggagttctgacatcttggaaattgcagtctcgagatggtaactcgatcagttcagcagcctcatggcttgtaaaaattcttcgtcttctcgtgtactagaaaaaaaagattgttccttttgagactttgaaaatacagttgctgctgctcatgtcatctggagacttgcagcctgtggtaggacgctcctggaaattgcagcatgagttgtgacccagtttagcgaagccgtcaacctttgcctgatgacgacgaaacaggaactccgtcagctcctagctaaagaaaacacagggtcagattatctcacgagattattaatttattatcattcgtttatgacaattcatattctaggaaaaaactcagcatatattattatgtacaaacggccggaagcagattcttttctattatataacgctcgtttcagctacaaaatatggtcaagacgacagtgaaaataaatgaaaatgcaaacgtccatgagttatttctttacctaatgtgctagaagagaaaaggtagagcaattgctaaaagactcaccttgacagcataggtgaagaggagtaagagcaggtacgatagcaggctataagccagctataaatatattttaaagagataaaggaagagagagaaaagcggcgggctacagatctgtagccagctgcagcacgaattctaagatgtaatgtgtgtatgatagatgggactaggtattaatagtatagtaagcaactattgtatgaattgactattacattagttatagataatttggagctagtagtgggctatactattaaacttgccctaataaaagattagtactctaggggtagtagaaaggacttacggagtacacttctctccatgcgtaaagagtacttgcatccaaaaggagaatctccggtagaagtcaaaactgttactgcctgacatcccgtttcgcaagtcgatattctactcaacagagcttttcactgatccagtcgttctgaattctgaacatatgctccagcgggtagcaggtctgccatgtgatgggaggcatggagctgcagctgctgctgcaaaaggattaggatcagaggacccacaatagttggcccctgctattttgtgcacaagaacagcaatcaaataagggaacaagaagtcaagaacaacattgtctctccaagccaagaggtatgaatcttgtgtctttaacgcaaaaggaatcaaacaaaatcatcctaaaaacacacgaacagaaaagaacaacaaacgagaggcagcaacaacattccagcatggactgaacagcaatggcaaagctcaaacaaccaaccaaacaatgcaaatcactgcgatgtcaaaacaaaaatgcagatgacagataacagcaatgggaaatgattatgcaaaaacagaacccgctccatgatgagatgaatgtgttacatgaagctctgcacaattagaagtcatatggcaaactttgtaaaagtactgctgacattgacagtaacaaaaattagtatttcacgaacataactgccccaatgcgatcaaagaaaaatcccttcactttgacctttccctaattcatgcattacaaacatgtcgcaagtcaatgacaatctcaatccattatcaattcgaattttttgaaaataaaaatagcagcagccattcattgcttggattgatctctacttttatcattgaaaagaaaatagtatgtcaacttttaacatttgaaactatgttggctgttatgcatacaaagcttttcttcgtgaaatatttatcaagaccatttcaagttcacatgctactcccaactcacatgcttctcaaggatacataagctacagctcgcagatcttggatgcatgcatagtcacatagatgcactgtggtgagaaaacttacggatagcctctagataagaataatcaagcatagaagatacatggtgcaagggatccaagatgcatggtttaggaaaagaaaattgtactggaagcaatttctactttccaagaaattgtgctgggtcataagtaagcagctcccaaaattaaagcatctcataaaaataagcaatcatgatgatatagttactatcaatgctgcaagaacctagtaacattctacatgctcatggcatttgggcagaacaggttctttcatataatagtcaaaactcaaagattatactttcataataagagcatcagttcaggaccaactctagccatagattgatgggtttcttcgcccaattaaacatcatgtaaccacatgcagcactgtgcttagctgaagttattagtattaataaaattaagataaaacttatgcttcccagtgtttagccataagcaccagaacatttccttaacattagttgtttttagttttttaggtaagagaactacagaagacactccatggctcttattcagcgtataaacgctttcttggacttctttttttttttaaaaaaaaagcaagcaggattgcaaacagattctacaaattggaaaatgtaccagtcatacaaaatgtccagcaggacaagctatcatagtatcatacagatttaagggttattttcttttagggaatgcacaaagacttgtctatcatcacatcaagcctgggtactgatgttcaattacatcgatctaacttcacagctgcatgagaccaccaaaagtaactatgccatattgccatgtatgatgtatcgttgcatcaagggttcttttctctcagctatctccaaaaataactatgccaattgccaagtagcacaaggggacagaggaggatagtgttggtgtgatttagtagcagcccccattgccacctggtagatagtgccattacattagagtatcctaaaattttatatgcacttatagaattgcttcacttttgtaactattagaaaatggcactggcaaagagcttttgatctgctacaacagttctctacttcattgtaattgaacatatggacagatcggatacaggaggttcctatcaactgatgatttttcatttattagtcgcatataaaatgttgaggtgaattctcaatgtttctgtagaatgcataaggggagagagtgagagaaagcaggagaccaaaactttcatttctcgcaggctaaaaaaattacaaaaactatgttcattcttcactagatatctttcttcagaaaaggccatatttcaaacttaaatcatatacacctttcccatttacaattcggtcatcatttgatatatcatttccaaagaatgcaagtcaggtataatttgccatgctagaaacggtatcaactaacaagattgatatttgatggcaaaataagaagtatagccttccatactcaagttacgatggtaatcctactgacaaaatgggcgacagaaacaaatgcaaggaggcattggagcctaacctgaaaaggagaaatgaaaaaaatggtcaaagaggaagcaacatcgaataaatggatatgtttaatgaatttacctatgttatgttcccaagtattccattagatcatcatcatgcagcagcaaatcatcaatatctgggattgggctactgatactgatatagtctaaaggtaatcccgcaaaggaactgccagcaaacttatcttgttcgccatagaaagggtaatcaatgagctgcatatctccaggaacagaagtagaattcccactaccaattatttgatcactataaggactgttgtcagctggtgttctgatacccaagggaaccacatgatgctccatgatagatagtggaagtggttgcttaggaggtatggtctggtaactactaggcatattgttaaagcctgaatcagaatcctgtgggaagatatttccagtttttggcctggaattgtcactgctttcataaggtacagcctggcctctcatgcatatgcttacaggagtagcaattgttgcctgcgcattgccatagtgattaaaatcggcaggaagatgggccagttcttgagtatttcctctgtgttgcaaagcttcactcgtattagcttcctcattgaagcttgtaatctggttagccatgccttggatttctacctggtccagtcggttcatatctggaatcatattccttgaatgttctgatgcgtcatcagctctttgtacctcctgctcaattacggtgacactgtggcgtggtctttttctctttggtggttcttttgttcctgccttcttaggaacaacctgattagggcgtttgactttagctctttctctccttgttggggcatgctcctcgctcaactgtgcagccggagaaagatcttgttcatcatctccagatgatgttgaaaggggagcctcctcaaaaccatcaacatcatactcattactgctgctgtgtgtgtccccatttctgtactccagagcaccgtggtgagtaacctctgacatgccattgtcaatgctgagaacaagcctttcctctctctgtagaacacccaaccaaatcaggctctcttttgcagtcatcttatcctgcaagcattttgatttcctaacatggtttctgatcttatcgaagtttggggacatgtgcttgatcacacctgtaagcaccccaaccttccagaccttcttaagatcatgtggctttttatacggaggaatttgccccctcggaaggcccaacgcaatccaccaatcctcgttccctgaaggccaccacgggggtggagtgcccctctccaatgggtacttgcgctgcggtggatcacagtgctgcatcaatgacgaaagcagtgaaccgagagtggcgtcttggagatccatcaagctgtgctggctcttgatcccgctgctcggagcatcagccgacgccaagttctccgactcatactttgcgattgccgccggcccgttcttatcaaacttcaccttctccttccaccaagctctaatattgtcggaagcgccgctcacgggcttccctttatcagggatgatcccgtaaacgaacccgcgcgcgttgcacacctccatcagcttgagcatgtacttgaggatcccgtcctgcgccctcgacatcttcttgcgcatggcctgatcggatatcggcttccccttggacttgtccagctcagcctgctgcagcgcaagggcgagcctgtcctgcctctccttgatcctcctcagcttgatcctgtctttccacatccgccgggccagatcctcggcctcaatctcctcgtcgctgacatcattctccgtcagattctggatgccctccacctcgaagtccgacgaatcccccaactccgtcgcaatgatagccagatgatccatcacaacaccacaaactagggatttcccacaacccgatcacatccaactccactcccccccaaccctctcctcgtcagcaatccgcccaccgaaatcctagcgagaattcatacctcccggtgccaatcgggagcgagtcagcaccaatccgaatccgcgaaacaagccctgcaaaaggcgaagaccaatacaggattaacgccaccaaaaaaccaaaaccccatccatccaccccgactcatccaggaacaccgaaacaacgaacagaaatcggaggaatcagcagggcgggcgcgtacttgggcagcagcggatgggattgtgcgcggcgcggcgcgaggcgaatgcgacggcgaaagagagagaagaaatcgctgtgctcccctcctccctcgaatcgaagcgaatcaatctgttcgggggaatggggaattttatttatttttttaattttttttgcccagtggaggtggaaaagattcgcttctcttccgtgtttccctttttttagaaaaaataaaaggggaaagggaaaggaaacacgagggaggctagcgctgaggaggaagggagcaggggtagggaaggaaagaaagaaaggctcgcagatcccatttgctccggtccactctgtgcacagccctgtgttgtctaggactacctccgtctcaaaataagtgcggtcatggaaatctgttttcaacatttgaccgttcgtcttatttgaaaaatttatgaaatttttttaaaaaaatagtcacacataaagtattattcatgttttattatctaatagcaataaaaatagtaatcataaaaaaaattcaaataagacaaacgatcaaacgttggagatgaatagtgtaaaactgcacttattttaggacggagggagtaagttggagttgggaactctcctccaaacatgtaaaacggagctatccattagtaagaattaattatttttttaaaaaaataaatcaatatgatttttaaagaaacttttgtatatttttttatgcaaaatcatgctatttagcaatttggtaagcatgtgtacggaaaacgaggaaagtgagttgggaaagctaattctatataccactttaaatgatgttacacgtaaatgatccagaattactaattttagaaattgtaaagggttacgtacaaaaccttcaaattcaccttctaccaacaaatgaattataagagtctccaatcttgtatgatccgaccgtatgactcgtgaacatagtcggagaggataaaacgaggtgatctagaagcattttttcagtgtggctgcccttggagatgacattatatgcttaatcatctaaccatgctataaacttgttttttttttgcttttgcttttatttctcaaaatatactccctccattccaaattaatctgcatatatatttttttaagttattcctaaatgatctacatatttgcgttcattcattaggactattcgttatttgtacattggagtaaatagatattgatgcatgcatccatgcacacaagcatttataacccacatgcaatatcttgatttgctattggctagaaaatagtggggatggtgtatgcattgagtttgttgctagagtaaatatagtatgagagagttattagcttttcttggtcttggtatacctatgaaatatgcagatagggagtatgttgcaacacacaggttttagctagttttttgaaaaaaaaaatgttggagtgtgtgtcatttcacataaatttcatttatcaagttaatttataatagatgatagctgggttagaatatgtattttttaccaactacttgtcgtaagttacagttaaaatagttaagctgtttagaaagatgcgaagatttgttcgtgattttcaaatatagtggttttctcattgttgttagaatataatatactccctctgtgtcaagataaatcaacttttgtcctaaatctagacattaacgtagagagttaatttatttttttatgggagtatcattttttattacacaaaagacgcacactactcccacatccacgagtgtgtctcctaaaacacgctcaaatttagccgcggccgtagcaccactataacccatttgttgcttcattttgcgtgtaaagggagggttcccaacccttccaaaacaacacagcccgtataactcagccaacccaacagtcacagaaatgtgaaacctcttcctctccacaaaggatcccgatctcaaggggtcagccatgatgcatcaatgttcactggacacccccaagcttgtgtttgtgtacgttccttccttgagtgacttttcctgcttccgtagagccgttttccagcgtcaacccatgctcggaatctcggattctcgctcggctacgaccactccccatcccggagaccgcccgtctcaaccaccccaccctctcatcgattccatcctttctacggcggtggcggcggcggcggcgcgcggcgctgcgaacggtgagcgtcaggcattcgtcgtcttgaccatgaaacttgaaagacctcgtggttgtactctggcagaggcgtcgtcagacgtgtcatcgtcaagtggctataaaaactaacactacttaagtttgaggtcaaatagattcagagccacacgtttcttaaggatcaaggagtttgatttagcaaaacaaaaaataagattaagcaaagttatacaagtaacacaaacttgcagggtatggataagatagtagccctactggtagtattctaggagtactgctggtagcagcttgtttgttcgtgcatggcacctttggtggtttttttttggccatttgctaaggttcactgaaagggcagattcattgaacgtggaccccctcgttaggtgccgaggaagccgtccagattcactgtacccagcagcgggcctctcatgggccttgtccatcaatctgggccgagagccaattcaggccggaacacaacaagagcagtagtagaaaagtaataagttcaggttaggtcccttgaattatcaccgagttcgactttggtcctcgaaccacaataccacgtacaacaacgagggggcagtccctcaacttgcaaaacctgtacccgagattctaaacagtatagtgtccagttttaactaacatgactaggtgggtctcacatgtcaggcatatttctcgtcctctccaacctcctgccattgctaactaaaattataaatctctcctttttagttttagtagagttgttggtattttttggatgtatccatcctaatcaacaagcaggaggtctcttctctgatttaatttgctagcccatcagatatggggtgcttcgcgttcaagagcggcaacaggagcaaaggccaagaacgcgcggacgccggtggcggcggccgcgtcgtcctcgcgcgccgtcaagcgccttaaccagcgcagcctgcaggtcagtatggttttgcatttactcctctcaaaaaattgccatggtgcttttgatttgagctagatttgtcaaaaccataccgaatttgttcatcagaatgatcgaattacaggcgatacttcggcaaaaaatgaacttgcagattttgtcttttgagcctgtgcactgaccacatgtctgcatattttcagagtaccaaaaagaaataggcctaatatgtggggctcactcgtcacataagctaaaaccaagcattatactgtttgggatctcggctacaacagttttataagttgagagacacgttatatctggcattgtgtttgggggatgaaattcgaactcaacaactagataaaggacgtaaagtgaacttattccagtggaaaacgagatgaaacaaagagacgagaatttgttttattttcctccagatcgacgaacaaacaaccgaaacgaattccaattggtaaatcaaatagctcaagcaacaatgagctttatcccctccccctcactcaacaatggcaacggtggtcaagcatgtacagtacatcaattcaccaatcactctgaaactgaaaatcgcacagagagctagcttagcttagctagaaccattagctcactcagtacttcttccgcttgaggaagttggcgatccagtagctggactgcttgtggtagcgcttgagattgttgaggcggtcgatgtagatgaggccgaatcggtcgaggtatccgtcgccccactcgaagcagtccatgaacgtccaggtgaagtagcccttcacgttcaccccgttcttgatggcgtggttgacgaactgcaggtgtttcgagtggaactcgatcctatgcccgtccttgagcgcctccgtgattggcaagctcttgttgttcccctcggcgattcctgcaatcacacatgaaagtcatcttgcaggatgtcgatcccctcgttttttttttcatttccatgttatccaaatagttgtgaaaaagttttggagaaaaaaaatgagaatgtagttcaaatgtatcagcccacaaaacatgcaacttcaagttcaaattaatctatataaagagtgtactacttatctatactcctttaaaagaccctaatgataatggtgagtggtgaatctgccaccacccaccaccactaccatatgggtcccctaaatactgagataggtggacttttatcccttccttggccagaagccatcaaacaaggaaaacttattttaaagtgagatacaaaattatgaaaaacataatgtggaatgatttataatggggataattttattttaatatttgtggttttaaagccgtatattaattcctgttgcaatgcacaagcattcagctagtatatcaaaaagaagttaaagccattacaatgagaaagttatttaattgggaagtgcggcggtataaatcctaatgctcatgaatattatgcatacatgagtacattttcaataggaatttagtggagcttaggataagctattagtccctgtctatttgagcgtatgctagaagtgtgcgtactcgtgggtgagtgtagtgcacgtatttatctcgtgtgtaatgaaaacaaagatggttatttaattaccattttctgtgacgtagatgatcgggttgttgtacctcctcttggtgtagaggagtagctcgcggagacccggagggtagttgaagaagatcggggtgaactcctgccaaaatgttggaagaaattaatcagccgtggattgatggattgatcgatcggtctcaagaaaatcaagaacatgatgttgtgttcatgcgttggtgttgaggaggagtcgatctatgtacgtacctgcggaccaatgggtttgccgttgcggaagccagtggtgttggcgcggatgtcggtgtcgtaggagagcctgtttgagctgggcagcggcacgctcttggcgtagtaggtggtgtagtagttgacgccgatgaagtcataggatcccctcaccgctgccgcctgctccgccgtgaacgccggcagccgcgccccgagccaccccctcatcgtgcctgggtagtcgccgtgcacgatggggtccaggaaccatccgtacatgaagtcgaggctgcgttgcacaacgcggcggtcagcggccgtgtcattatacggcacgaaccagtgcgacaccgccgtgatgccgatctgcccgtgctgcgtgggttggtacttggtgcggtagaggtggacggcggtggcatgggcgaggatgacgtggtgcgctgctaggtaaggctcgcggctggagtcgccgccggcacaggaggtggagacgtagggggagcaccggcccaaggcgtggatgccggtgccgtagccctgggagcagtaggtccatggctcgttgaaggtggcccagaacttgacacggtcgccgaactcccggaagcacacttcggcgaagtccacataatccttgctgaaaatattgacaatccaaatctctaatatgagtatttttttaagataatggtaatggtttacatctccggtgtctttcgacaggcacacagccaaatttgcataatcgacaaattttaatgtgagtcattgatgaattctagccaaatttgcagaaccgacaagcaatttattttgattcagatgaccaaattacctaccctgttctatctaactggtttttcttttgaaacttaggtgaatggcctaactttaatcaacctcatcatcagcttaacaagttgagtgattttaacaggtttatggattttctttgtctctatctaaaaaacttacatgatattctcactcaggaatcctccgtatttgctctcaagggcctgtggtgtgtcccagtggaagattgtgacaaatggcttcatccctgttatgaaaattttgtaattaattcaaagtttactacttaaaaataccaaaaaaatatttataattttgtagtaacagtaacacatgattgtaaataggacataactgaaaaaatttactcacctttggctatgatttcattgatcaggttgttatagaaagctactccttccttgttcacccctccactcaatgttccatctgcattcaacaggcatttacaaaggaaaatttcacggtcaaaaaactgaaatgcaactgaatgcgctgatacgatctaggaaatataatgcccattctcaaatacttcctctgatcataattatttgacgttctggacagccatatactaagttcaagtcatcttaactgtctaaaacgtcaactaattcagtccggagatggtagaattaacttcactcacttggcaggatccggctccaagaaatggaaaaccggaaggcgtccatgttcatgtctttgagaaggtttacatcctcctgcattttcaaggttcaacaaaagaaatgaatgatcagttcaagaagattcctgtccaagataaactttttattcggtccatcaagtcatgaaaacatttattttttgacatacaacaagtcaaagattaaaaccttgagttaatatctttttaaataattagactgacacatggaaatcatatgggtaaaatctcatagtaaaatcaggtttttataatgtgctcacttcggtcaaatttatttgacgttgggagaactgagtttagttcttccaatgtcaaatattttttttactagaggctggagtatactataacaaaaattagtcattaaaattgcattccaaagactgcgattttttggggaaattactgtagaaaaggcttctacagtgtgtaaatatatattccaaagactgcgttaataccgaacaatgtgtttccttgaatgcatttcaagagcaagaactcctgctttacttaaaagaaaaactagaatctaccttgtagcgatgatagaagtcatctgccacatcgccggtgtcaccatttaagatttttcctgcaggcatgaaaatagtttcccttaatcacctattttaaattttacatgccagctatatatataatagtgggaggttaacacttaataataataataacctgggatgtgcgagaaagtgtcccacacgctaggacgctaggacccctacctccttccttagcagctccctcatactgcaagtaattaagcaatgcaaggatacatctctgaatttgttcaggaactaaccaagaaccatgtgcattgcacttgattcaaaccattcttgcagatgtaagagttttggacaaatttatctctgtatggatcacctgatacgctgcagagccggtgccgaagatgaaatccttggggaagctgtacctgttgaacgatgcatcaacaccgctgcagagtacagcaacgaaaacaagaacaggaacaatctgccttcccattccgattccgagccaggccatctcgaaactggaactgatcaagccaagcagcttagctgggcagtggctctgcaggaagcataattcagaagggtatttatagagaagagttggcgatgcagataaacggatcagatcataggccagcagatgtgttggcgttgcttccctgattggcaattctcactattccgagatcgagttcctcaagactttcgagaagagatatcgtattatatttgattttaaccggttgaatttgtcatctacagtagcaagaagacgttgaaattgatttgtttagttcagcatgaggggcacgagagggcaactgctcaaggcttgagacatgtaagtacagtttttttttatatatatagaatgtatatatgatagcggctgatttcgttctcattcttctgaagaggacgcaccacctataatttttagttaaagtattttgtgattggtacgaatggtgtataaatatataatgtacgttgcaataaaaggaatagttgctataacgacttacgcacgacgatcgcctagttgctataactggaaatgtattttcaacaccgcaattaattctcttcacatgtaatggcgtgccgctggttacaactgacctctgtacttgtaaacctcttcaaatggcaatggaaatttagttgggaaacctctcccctctggtctctggtgattattaaaaaaaaatagttgtattgattataatataagtacacactatacttatattataatcaatacaactattcctttttttatatctcacttggatactaataatatacctcctatgtggattaagggagagacatttgatccttacacgtaaggtaatgatataaaaccgacatcacagtcgtcatctatatacaaacatggaaaacactataagatcaagattcattctagataagtcatttaaaggcacgatatttttgataaattttcatgaggtggatttattgcgcgcatgttcgcgctcgaaatcgctaatagacgatcagtcgcgcggggcgtgcgactggacacgtgtcatgcgtggagaggggggcgtgggcggcgtgcagtttctttccttttttttttgtttttttcgcacggtttctaggcggcacgcggtttcttttttttttctctttttatacgcgcggtttctttttttttttttcttttcttctttcagtatcgttactttttttttggcgcatggctttttttctgtttttttttctttccgtatttttttgtttttcggtttttttaatacaaacatatacaaattttgtatatgcgtatataaattttgtatacgtatacaaaatttgtatacgtgtatataaacttcgtatatgtgtacttttttatatatagatgtacaaactttgtatatatatacgtatataaagttggtatattttgtatgcatacatatataaactttatatacatcgtatacaaactttgtatatgccatatacatacattatacatgtgtatatacatattagaatatctacttatatatactacttaaaaagtttaagatgtttccttcctctgttaataaattttttttaaaaaagtccgattgtaattaaaaaaagcccggggcgaaaaaaaaagtgcggcaaaaaaaaactgaccgattcctatccttacttaaaaaagcggaacaaaaaggtgcggcaaaaaacgattgtaaaaaggaagcccggcacggccaaaaaaaaaatttgtccgtttcctttttttttccttttccaattttattttattttcaccgcttttttctttcaccgtttttccgggctttttcgtccgttttctttttttttcgttttattttctttgcgccgttttttctttcaccgtttttctggtttcgctattttttttctgtttttccattgggccgaatcctagcgccgccaccatatcgatttgcatttttatgtgtttcctcatccaattgattgcaaaaaccgattctccactactctcttatcattttccccttgaatttctcttccagttcgtcattttttttccaagttttacggattgctttgattttggtaaaaaacgaaaaagggaatcgagtggatcaaaatctctcaacaattttggagatcgagaaagattcgaccgcatttgacggagaggatcgactccaccatcgtacagacacggtactatgcgagctcgaccagattaccggatttgatgggtggatcggctccgtcatggtacgggcacgagttgacggagaggatcgaatccaccatcgtacggacacggtactatgcgagctcgaccagattactggatttgatgggtggattggctccgtcatggcacgggcatgagactgttcgagctaggcctacagttgcacttgtgggctaagccgaagagaggtaggccaggcacaggactgttcgagctagggctacagctccacttgtgggctgagccgaagagagataggccgagcatatagatgtagtggactactctaggactagagctgaaaaggaaggaaggaatgaatgtccggtccaaaaacaaagaagcatccggtccaaaaccaagggagtataatgtatcggcttgtttggtaactcaagggaaggggattgggagtttacacgagggaattgatgatgagattaagatgggaatttgatttttaatctcaatatcttgtttggtagaggtgatggaaattgatagggagtttagttggagattagttcattaataaaaacggatggctgagattcgcttagacaaactaaaggaggaattcccttccaattaccttcccctacccaggtattgaaaaggagggagttccttactcaattccccatcccaccaaaattctcatatctcccaaccaaataaaacacttaatagcctcatccctctaaactctcaatccctcataaaaactccttccaactaaacgagccatataggataaaaaaatgtttttacccgtagcaacgcacggatattttttcgtgtgtgtgtctatatatatatatatatatacacacacacatatgtataaactttatatataaagtttaggaaaaagtacgatttaccccccaaactattgcgacagtacgaattatccccccgaaccacaaaaccggttatattacacctcaaaactattgataccggctgaattaccccctgactcaatactgagcggttttgctcctacatggcatacacgtggcgtcgacgtggaaatccaatcagtaaaaaaaaagaaaatatagggcccacctatcattactctcactgtctctccctcttctcctttggacggcgacggccgaggcagcaagcgcacgcggagtcagcagcggcgaggcgaggcaaggcggcggcggtggagagcggcgggggcggaggagaggctagcgcggtgggggcggtggagaggcgagcgcggcggtggcgaggcagggcgggcgcggcggagaggcgagccgagcggcaggggcggaggaggcgaggcggcgga

SEQ ID NO: 65825 - DNA, 890 bp, Oryza sativa
agcaaggacaagagccatcgttccatgtctcgtgggacgtacacgaggaacattgtatatagagaggttctcacgtcatagaggtactgatttctgagctagcaccactgtagtatgttggtttgaacagcaatcctctgagctagcatgcaagtagctagcttttgtcgtaccagcactatatttatgtgctgatgtttgtttttacctaatttcagatgtaagatatgtattagcacttagctttctacgcacttatgatttcctgtaacataatcacataatttgtattattctagaaatatcagttgaattcatagcactatggaaatgtttgtgtcatgcgatggtttcatttgtgaagtggttcacaatttatgtctaaccggttgagcagcccatgatatggccagtgagaaaaacaaccgggaaccatctcgaattacccctccccacctgacctactcaaactagcatgaccagtccacccgttctattcaaagccaccttggaaacaccacaagagggatggtatgacattgaagacacgcaccaaccataggacgattcgaaatgaaccctgcagatccagaatcccagaaaatccagactcgccccttcccaagcaatgttaatgggaacccagctgatgggatacaggaaccactgacaaaatagtgcctataaaaagaacctaaggcaacttcaaaaagggcacacccccctcttgaactaagccagtcaaaaaaaccttagcccatggaaaaccctaatgggtatgcccaacagttgaagtacctactccagcaagtagggtacttccaggagccggtctattgttttgagcggatcacccaaggatccttggagatctggaaggtgaaaatctt

SEQ ID NO: 65826 - DNA, 890 bp, Oryza sativa
acatttaactgctccctctattctattctaatttgatcatcctctaagcaaagtgcacaaaataaaaaaaaatgtaatatccatcattttgaaattaatccacattaatcaatgtgctccgtcacttcgtgtccaacaaaaatttattcacactttaaacattgtgagtttaactaatagaaattaatcttaattggttgcatgtatgcatgcagaacattccacaatgaacatttactctctacacaaataaataaaggaaaaagtacgaattagcacctgaactatcgcgatcgaccgaattacccccttaacccgaaaaccagatatcactcaccccaaactttttataccggacgaattaaccccccccttcaacagaatccagagcggttttgtcctacgtggcgtacgcgtggcaatccagtcagcatttccttttaaagttactaggaagatggcccacgcgcatgcacgggtacttatattttgtcaaaattgtaagattaagggtaaactaaagctgggatgatggtattttataataatttagggttctatttttcttaaggtatctaaaaaaccgttttgagtaggagatggattaagtacttaccacttttgaatcatgtttttttctcgagtaaataagaaactattactagttaattaattatcatgcaatccatccatatacatatcgtgtagtatgtccacaaatgaaaaattcgagagcaagatatgcaaaattcttgtgattaaatcgtctcatgaaggcacatgatataataagaaagggagggaagcgtatgcatggaaaaaaagaagaaaggggaaaatgaaaaagagaggggaagtgtatgtacccacttacgtaggtgcgcacctat

SEQ ID NO: 65827 - DNA, 810 bp, Oryza sativa
acccctggaatccctggaattattatgtgttgttttattatatttgtatcacaatatttcactgtatctgttgctgaatatgtaaagatcattagatcagatgtaattgttgtttatgctaaaataatattttctgttgcgatgaactgattatttcttatcatctcgctaagatttaaagttgccctaatttttttcccattgcaacgcatgggcatccaactagtcaatagaaatatttctaattcgtgagtgcttaggaacataacaatatttttatatactgttagtcttttacattgtcagcttctatggcctgaaagggagagatagagagtgtgagtgagagagagattgagagagaggtagggagagagttacatgtgatctatcattttttttttcaaaatgatcagtttgcaaagtttgtcaaatgcgtgcaattgggtaatgttttagagttgaagcttgttactatggtttagatctcatttcctatgtcaccttgatgtttatatggcacatggctatatgaggtccacatttgctggaagacattcccttgcttcagatgatacatacaaatacttcctaagttagcattagagatattggattgcatgttcaatggaagagataagtatgatctcttaggcaatataagattatttagagactgtgtctaccataaactcaaaaaaaaatattctttttattactattctttccattttttcgtcgtcatgcaaccatgttttcatattatagatgataagagtcgctgttgagctgttgttacctatagcaatg

SEQ ID NO: 65828 - DNA, 1521 bp, Oryza sativa
ggcgggaagccgccagatacagtgaagacggcagggcgggggcactcgtgccgtccgttggggaagagaggaggaggccggccggggaggggggaggaggggggctcaccagcgtcgttgacccctttcggccagccgacgagtccgggcggcggcggagtcagccgcacacgagaggatgctgcggcggcctggaatgacgaggggagagataggggtttagggttagaactgcctgcacgaatcttaaagcgatccaacggtctagaatttgtatgatttgtgaggtgtttttctgtcaaatgccacttgttctttttacatatagtatatatgtattaggagttcagattaattgctcagccgttatggtgaggcgctggagattatttctgtttggcaatacataatggatcggtgacaagggatctctttgctgtatgcctagctattccatgattgaaaactgatatctcgcaatgagccagaactgagattaattacgacagaaataaaaatatccagttgtaccatctttgcctgaagttacagccaattccactgaatcgtaagttttaattataagtgtccagcctcatgaaaaagtgccagctcgatctttcttagtttttgcagaattttcacgaaaaatgaaattctcatgaaacacccccatattcttgatgattgaaggcactaggctctttgagtctatatatcccctgggatggatatattgtttcctttttgaaagtagcaaaatatttgccaactttaaaagatggcagagttccaaattaaaaaaaaatctatgagtttaagtccacccgtcacaaaaaatacatttttccgtaggttgcttacaggaccaacagaaaataccacggctcacagggaagctgagtctagtaatgacgactctacagctgtgactaatagtacagcatctttcataaaatttgcgaacattttatagaaacccatcgagaaataatattctacaatatatatgccatcgacaagaggtcaattttccgattttccatctacagatacgagttctacaatattccacctacttcccccttttcccatttccattagttaatatccattagctgtttggaattttattcacagtgctcaaagtactctcgagagagaagaaattaaaaggcacttatacggtggcatagtagaattcagtttcgttgatggagaaaacatagaattgaggatttgtcaatggctttttgtcatatagtttctcaaacattgatccagcaatgaaactgacttgggactttgtctctcttgtttaatttggcgtggaaaattttgatgtcagcatccccacactggtggagaaaccatctttgatcggtcgacccaaatctacaatagtcccagttccatttaaaaccgggactaaaaacgatttttagtcccggtttataagaacaacaggactagatgatctttattcccggtttgtatgaccaaccgggactaaagatcatc

SEQ ID NO: 65829 - DNA, 8632 bp, Oryza sativa
ttgcatctttcctcttataccgctgcatatctagacacttgtacattgatctaatggcggaatactaattttttgcatcaacccgcccctggtgatctaaccctccgtgccatgctttgatgactcttccagctcatccttaccaatggatggatacatcctaacagatggattttgcctgcatgccagaaagagccttctggaaggctcgggaaacggatagtccgctgtaagttaagcatagtaggggattatctatgtcgtgttgtgtaacaacatagttaataaagtagtgtgctataattcaaatgtttgtgtcatatgataaaccttgttataagacaaaagaaatataaaactattgcattttcccctttcctactttaatttgtctttgttatatgttatatttgtttccagtaaggactatttggataagccaaaatgctgataatcttgctgtgtaattgtggcgcaagagttttatttgtaatcctctattactatacaatcgcagcctactaattagcattaaatattttctatcttgcaccacagtcttccacgtaagcatcaaataaaaaatgtcggattcacttctacctcaaaaacacgctttcaattttttaacagctttctcagtactggcccaattctaagaccttgccaacagcccagctaaactcctgcaaaaagcccaactcacccacacccacatcatcgttaaaaacaaaaaaacaccagagagagatgcactattcctctgtttgtcgcaatgcataccaggaatgtataaccatatatgtatagatcatattgtatcattgtattccttgtattctcctccatttgaggatcttgtaccttagctatactataacaatacatggtcatcccacaacattgggtgtgtggtgttcctctaattccttctacattgtatcagattccaggatatttccctctctttctgcaccttcctggttgccgcgcctacactgtcgcctccgtagcctccgttggtagaatgccgacattccagcactcctccgtaaaattctcgaaggaactccgatatttcagggcactccttcctgaacttcccctcactctctactaagttaacaaattaaatatgaaactgtcacgtcctgataaattcatcccgaattaaaaatcattccctaaaaggaataatagaattaattaaaattcgaaaagaaattgacaaacactaaaatacgtaccagaaaaattcgaatgtggcccggagaatttttgttaaattctccttggtctaaaaggagccctcaaattttacttgaattttcagagcaccggaaataattattaagcaacaaaaacaattatcaaagtttattaaaaagaaaacctaaaaataaatcctcttcctcctttgggccaagcccagcccaaagtcctctcttcccccccccctctctttctccccctcctccctttgggccccaaagcctccctccattcctctcagcccggccgaaagtctgtttatctcccccgtgctacagtgctccttcttccagctcaggcagagcccgagctctccagccgtgccgtgcacagtgccaccgcctcctccttccaaatctcgcctccccgttgctcctttttccaaattagttgcgggaatggaatcctctcaatctcctcttcctttcccccaactttccccctttaatcccgcccccaatcaccgggatttaatccctcttctttgaccaccattgatgccgccggccacctcctccggcgccattttcggcctctcccgtgaccggcactccgtccttgccctataaaacgaagccctcctccttcctttggtccattttgctctctcccgagcccctagccacctccccatcaccttcccctctctcctgtgccgacggccatctccggccgcccctgccgcggcgcctgtgtgccggccggccgtgccgtcgccatccgcgacgtcgcagctgcctcctcttcctcggcttcgcctccgtttcgcggggaaatcaccggagacgcgtcttcgccggcaaaacagtggcgttgccgccactgtaccgccatcagtcgccccggtcgccgcgtcagagcgtcggccgatgtcgccgtctccttcgtcgacgtcgcggcgtcgccctccaccccggcctgccctcggtttcgccggaacgccgtcgcccgcgccgcctctccctcggtcttgtcggcacccactccggcagccccttccgccatgccagtgcgccggccgacgtcgccgtctccacctctggcatcgcagcggcaaggtcgtcctcggcatcgcttcccctccatccaaacccctccgcggtccatcatcgtcgcctctgttcgttctcgtcgtcgacgtcccgtcggtcgcccggctcgtcgtctcgcggcgtcgcctccgtcgtcggattcgcagcggcgcgttccacgtcgtccccgtctccgtgcagctgttgccggctgccctcgtcgcttcctcgccggccccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcgtcgtcttcgtcctcggctccgcgtcgtcaagcattgcgccggccgcgtctcaccttcgtccaaggatcgccgctgaagtcgtcccctcgccatttgtctccgtcgttcccggccgcctccgccgcgcccgttcgtcgttgtcgttcccacgcctcgtcgcgtggtggtaaggatctctcctctcgctgccccgtcctcgtcctttcggtgtcgcccgtgcccgttgtgcggttgtcagccccggtatccatgtatcggtatcggtagtcgttcgcttgtccgtgtagtgtccgtgttagtgtgcccacttggtagccgcgttgtttcctcgtgtgcaacccgtgtggtgtctagtggagtccgtttgtcggccactcgcctcggttgacacacggggtccgcttccgtcgacccgtggaccgtctctgtgtacctggtctaccgcggtcctttaggttgacatgtggggttcgcatgtcaacagcgcagccttcctgtcttttccaggctagcgcttacacatgttttatagtcgcaaagcctaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagttgcaccccggccactataaggattaagctcaggccactgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggatggctagggacgagctgggacccagggtcgggttgccagttcggtctaaatcatcgtaggccttgggttaaggcaggttcgtgcgggttcacgaccttgattaataatactgtgtagctttaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttattttttattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcgaatttccactagtactagatggttagttttgcgaagaagaagatgtcgccaattgtttgccgaagctccggaagactgcaggatccgctagcgaagcgaaggaagcagtgaagccagctgtaaagcaggagtgaagatcttggagaacctgtcgcagaacctaagccaccctctagggtagagtcgttagtcgtgtgtttccttgcttgtgtgtgtagcgcgtggttttcatcagtggggtgtgatgtaaccatgctaggttgtttgcttaatcaacttgcagaataagtgaaacaaacaacacatcaacaagaagagttagttcctttaaggtcctgtctctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaacaagggcacacccttggtccattccgagcatgctgcttggttcacagctaccattggttggaagtcaagaccaaaatcagtatgtgtttgatcgagcatttgccacccaggtcaatgagcttccaatgccagaagagcatgtccccttttgtcatgattgtagagagtaaggacactatgccctgaattgtccatgggtatatgtcaaagaagccccttcctttggtttagcagggcagacatcgctaaaccagcctcctcacaccaagtcaagcttgcagcctagtgtgcaaagtagagagcccaatggagagaatccattgaatcctgggaaatgctttcctcctagcctttcgtaccacgtggggtcacgtactaagcaagccaaaggcaagaagagtaagaatcagaagaaaaaagcaccgatgcgaactgaagaagaagtacgtaagatgactataaccagcaccgaatggcctccagcagggataactattcctagacgtcaaagaggaaataccttccgaggtgcacgaaagttgacccagcacctcctaagccatggcggcagagtatctgatagtgaagggtcagatcaagtctcctcggattatgaagatgagtctctccgacatctcggcgaggaagagatggaatcaaaagcatgcccccgttgtggagaaattggacacgttgctagcatgtgtttcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcgtcagttagtcagctccaacagcaacatacgacagaatatgcatgccacaagtcagccaagtgactgcctgcttagcctggcagcctgaagctgcgtggcaattaagatgcataaggcaagtaatacccttcaagcaccaagccattctcatgcaccgacggcctcagcaaagaattgtcatcgatggaagaagttgtgtctctccccgacctactccaggccgagcgaagggcaatcaacctcaggaggatgatacgaagcagaagaccgttattcgcttcaaccagcaatcagaaggaagcttctcctgtgaatgataacaatatgcagtcctatcacatcatcacagaaccaatcaaggatgcagtcactagaacaatgccagctatatctctccagaatcaaaatgagcagccatgtttgtggttttcagttcgcgacttatcattgtgtaatggaaagtatgcagacaatcagtgtaatacataaatatattcatgtctatagacagtagacaagctatgcttatggatgattcatgttgaggatacaatgtaccgatgttgagcaccttccctttttgtttaaggcagtgcctcgtattcatgtaatatgggagaaatgtgtaataaaaacaagttctatgaggactctttcagaagatgctgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtcttttttggatcaaaggcaatggcagtcagtatagcttttggcgaaacacttcaaggattcactgaaaggcagtagaccaaaggacctcatcgccaccagaagtgtccgcaacccacattaaagagtaccacctgttagagataggccgaaagatgattgataaaagatattggcaaagaggttctctagcaggaaagatgtaggccgaaaggtgattgataaaggataatcaaaaacatgctctgcatcactcaaggaagacccctgatagtaatcgccctgcaacagtcaccttgtcattgagagaaaaaaaaagtcgtgagtaagcaagatgacctaggtaaaagtgtttctatgaaggcaaggagtgaaatcttcaactcagtatcagatgctacacggagtgaaaactgcaagcaccggttaccaggcaatgccatgtcttgggagatgatccaatgggaaggaactcatcaaggtcaaaggagtaaaggaatacgttgaatgctaaataatgacaacctgaagataatagtgggaagtaaactgaatgtaaagaaccaagtgatatgttcgaagatagtctacagaggtcagattaaaatcacatctaacaacgaagcttcaaatttggcaggataacgatcaaacaataagaagttcagcagtaaagtcatttgggaagacgtcaaagcatgtcaagtgggataatttggttcccttgggaaacataattcaaaggcaaagttatcgaccctcacaatgaatagaggaaatatctagcaccggagaccaggaaagctaatatgagacaatcagtggcaagttgtcaatcatggtattcttagtaagcaggatatcatagtctaaagcatatggtggtaagttagaagtaaatgacaagcatggtattctcatgatgacaagcatggtatcctagtaatgacaagctgatatcggcgcaaaacgtgaagtgggtaacttgtatgaggttgacgccaaagatatgaattatgagaagttctggaactgaagccccatcttccaatgccgcagcctagtcgaagtcagctagaggtgcaaccagggaaaagtcatgtgaagagaagattccatctataacaggagatcgagccaagcagtccagagtggagaggttttgctaggcaagtttgttatagaagacgcgacggaagaagtcagataagaagagaagcccgcccaacctatcttcttgctagcctcctcgaatctcgg

SEQ ID NO: 65830 - DNA, 3815 bp, Oryza sativa
ttcctgcagcccattgcatgatcctgtgatgtatttgatttgtgtgtgatgtgaacttgtgatgtatttgcgatgaattttgtagaacttgtgatgtaatttgatttgtgtaattttttttaggatttgtgatgtatttgatttatgtgtataagtaacttaaagatttgtgatgtggatttgggatgttactttgatttgggatttggggatatgcatcccacttgattcgggagaaaataaaaaagaaaaaagaggaccatctgtactgctgttattccctctttttaccaaccgggactaaagataaagtatctttagtcccggttggtgttaccaaccgggactagagatcgatttttactcccggttatttcacccgggactaaagatagcgatctttagtcccggattcgtagtcccgattgaaaaaccgggactaaaggggggttacgaaccgggagtaaaaaccacttctccaccagtgccatctcatccaagttagacatggctagtccaaacgaagggattccatttattatcagctcagcccttctggagaaagctagttggcattcttcttgtgcagcctgtatcctgaaaatgacttgattagcaatgttcatggacagttttatgtgtcaggccttaccttaatttgtggcatttgatcatagctttattagcaagtctgcttaagtaaccgagacgaggggaaaggagaaatttgagaatggtgagccgttagcgcataagtaactgagtattaattattttaaacttgcaaaattgattgatatgattgaaaaaaataacttaatttttctatagaaattttttgaaaaaacatattgtttagctgttcgagtagcgcgtgtacaaagaacgagggatttttcttccgtctgtgcttggaatgaacgcaaacttagattaatatatatgaagtgacttggtgtggttattgttgatgtgctgtttgcaactcattttgcctactgttgaaattataagcacataatgatttaatttattccataaataaatcatgacattgcaatataaactagcataaacgcatcattggatctacatatgtaaattaagcagtaaaacatgaacggatcaaatatacacaacatgttgaacatgtaccgaggttgcggaacaaccggttgctcgacaggaatcactcgcggttgcgggcgtcgacgaaggcgcgcagcacgtgagtgaacaggaagacgagctgtcgcggacgaacagggagcagtcgcgctaagcgcttcccaaaaaccttattgccgccttctcccagttgtagacccccgtttttataacagaaatcattcgtgtaaacagtaccatttccctggatcaagtagtctggtacacacgagttcatagctgaaataccaaatgcacatacacgagagtctagtactaattattacaccataagcccttaggcattgtcttaaatcatcggaccgagcggttcggaatacatccaaaagcagaaatagataaggcagcggaatttaggcagtggcatgccattgccacaggcaacgaccgtactaagacctactgagcgccatcgtcttcatctccctcctggtagtaggcatagggatcctctgaagcttcatctcccgcttctgattattttataattgcaagggtgagtaccaaccgtactcagcaagccaccacagcaacaatgcatatgaaaggggtatttcaaaggatggctatggctcttttgcgtaaagccaattttgtaattcttttcacaagcctcagacctagcattgactgatcaaattttagtaccagtgtttgtattcaaacaacaacggttctgtccaccatccattgtgatcccaaggatagcttcccgccattgaatcgttatggttttctgaggacacccactttccccctcctcaggaagtggctctaacagcatataaattcatcatgcaactacccatcccacacaagttaataatttagagactagccaagtctaatacatgtcccggtgctcaataaccgcgagcacggctattcgaatagatttggtttactcacactgcagtggatgtacactttacccacactccatgactgcccaacacatgagcctcgtcccaacacatgagacgcgtcacggcaaagcttttcgataacctcgcattggcagtacccgctccatgaactttacatcctcttgcactctaggcgtacacggtttctagtagtgagagaagttctggcgcacccgggaaagaaagactcacacatacattaagttataattatgtttaaattctctcatggcagtcctaccgatggcgacaccactgtagacacccgcctcgcggttctaccaatggctgccccaccgtagagcccctgcctcacacatcaagaaaccactatgcatggatactgcctccgctcagctatctattccgctaggtctatacccatacgagaagtgcggttgtacaagggtcgtttcatgcttaactttatggctcggtccttaattgaccagggacggcactagcctttttccggataccacccaaatcctccatccgccccagtcgaaaacatttgtttagtttcattttcctttcacaaatcatgtcatcaatatcatggcaatgtggcgctcatgtctccacatgccgcatctcaattaccttcccaaaggtaattgcctaagcatatagcatttgataaatatgagtatgcataaatctagagtaacatttctaagcatttgtcatagttgactagggacttttacgtaaatcatcgttacaaggatttaagggtaaacaataatcaaggcatggcataatcacaaataggatgttcatcattgcatgcaattttatttgtaaacaaaacaattttgcaattggtatcaacatgttcaaggaatagtgatgacttgccttgctctaggtcttgtgggtcttggtcttcacccggatccgcggctccctcggtctctatagttacgtgcgtaagaacaatttgaattcgattagaattcaaacaaaatccaaataatgaccgaattgagaaacgagcgcgggaggtgaattctatataggctactttattcgcgaagtggaattattcttctacctaaaatatttgtgtttcttaagaaattttgtgatttaaagtcatgtcctaagactttatctaattatctagtgcttaattacatctagatcactaccgcgaattaatctcttatagagtttactaaaaataatctataataatctgtaagaattcatctaattgtttagttcttaaataattgatcctataattaaatgctagtattttaggtatttaaatagcaagaatttatctagctatattttcattaagcctatgattaaattctaatatttttaaatattttaaatttccccctaaatttttcctttccttttctttctctccctctttcttttcttttcttttctcttttcccttttcctttctttttctctctctctccctttttcttctcctctctttctttttctctctctctccctttttcttctcctctctttctttttccctctcttctctccctcccggctcctttctccctctctctctcggcttcttgctctcccgggcggcgacgacgatggacgcaagggggggggcggcttaccgacggcggcgatggcgacggtggcgacgtcggcgcaaggcgcggcgtggcgcggcggcttcgtggctgcggcgcggcggctctatgcgac

SEQ ID NO: 65831 - DNA, 2628 bp, Oryza sativa
tgatttcgatttgattgggattgggatgtagtttttgggttagatttgtgatgatttgggattggttgtgggatcttcagagcggatgaatcagagggaggaggtgcgcaatgcacagactaagatggatttgtgcggtttttattattcttctcgttcgatttctcttcctctacgttctatgtttggttggattttgtattcgattgaatttgtgtaatatcgatgtgtggcgcatgtgggaacggagggctcgattccgattgggattgtgggggtgggggggaggggattgcgacggacggatgaaaaggcgaacgttcgaggagacgaccggaaaaatccaaatcttttaattagttaagatattgaagggtaccaatgtgactgaaatttcggtccgagattatttgatttttaacaaaatttgatcaaatattaccaaattcacaaatgaaaaaaagaaaaaaaaactttccaccgaaagagtttcttctatgcttggaattaattaggatccatgatcacctataatccaacgcactaagattgaaggtaccaggagcaaggtagtaaaagggtggaccaggtacaagaggtggaaggttaaaatggtaattgacttctatagttaactaggaaggtagcccgcgcatatgcgcgggcacttatttaatgttgcttaaatttttgttaggaatgtttacatgtagatgtagatgatatttttaaaatagatcttgactctattttaatcatgttttcgttaatatctagtttggacatattacttgaaaccgtacaaccttgaatttatgagaacatgtgtcacgataatggaatacttgagttgtttcatatctatttgtactatatgtgatttttttaacctatataaagggtcttttaaatactaccacgataatctccaaagcaccatattattagttatattttgacaaatatatgtaattttgagtttgtttattttcaacgcttatgattcataatgacatgagacacttttactaattaacctggagaatgaatctattttcccaaacttatttacaataactaatttattgaagtatactttatagtcacattaatagggtatatgacataagcccatcaaattatgcctgatgtgttggaattcctcaactacaagaaaatataccataagcaagatcattggcttaaaatatttttcatatttgttttacatctatgtaacattcatgttgctaacttatcatatactaatgaaataattctgaagattcaaaaaaaattgagaatctcaatctcaaacgaattaaaattaaattagatctacttaaaaatacacaactaaattatgttattttcatttattttacatatgtagatttaaattagcattgtatagtcgtcaagtgatatttgacacctgaaatataatgtaaaatttttttgaaataggaaaaagtacaaattacctccataaacctgaaaacatgacatcttttactctcaactattaatagaatgatttaccccctaactcaacccaaagtggttttgttcctatgtgacagtccagtaagcatttttttcaaaaagtaaaataggtggggcctacctgtcacactatctaccctctctatctctgtcccctctcccctctctctccctcatttcctcaatcctattcccaagcctctctctttcttatccctccccttgatgcaggggccggctgggcaggcacgtcgccgctcttctccttctccttcgtctattcccctactcttgctcttttgattgatccacctcgttgtttttgattggtgctttctgtcttgtcaggagagaggcattggtggtggggatcgattaagaaccgtggtgggatggcatgctgtggtagatggagctacgactgcatttgtttggggagttctcgatggtaggggcacagtcgaacctggccatgaaggagcagcgcaggtcctcgcctccggtggccgtcacgtgacgatgagatgtgatggaaaggatagagatggcagcctttgtcggagtgcgcatgtggtggccgagatagctgaggaggagccgcctccgccgcttgagctccaccgcccaccactattgtcctcttcacgcgccggtagaggctaaggagaagtcacgtggccatcaaggaggtgctcgccggcaaaggctgaggaggagccgcctccgccgctcgccactcaagctccttcgccccactgctcaccgcccctagccttgccgattcacagacgtggaggaagaagaaagagagaggagtgaggggtgaaggagatatatgataggtgggtcccaccaatttgtttttgaagaaaatgctgacaggactaccacgtttgaccaaaaccacttcgagttgagtcagcgagtaatttgtccggtattaatagttgaagttgaaagatgtctagctttcgagtttatggtggtaattcggccgaccataatagtttagggtgtaattcgtcttttttactttaaatattatcataacattatttattatatgttggcctcatgtgactggatcacaaattagatatataattttcaaataatttaaag

SEQ ID NO: 65832 - DNA, 3794 bp, Oryza sativa
gtccgctgctgtttatgttgattgtcagccctaagtgccttgtcataatgtaaatattatcgatataataaagatgtgtcttttatatcatgtttgtatggtgtaccccggcttttcctgggacggggattaatacactagcgttcgggaaaatgcgattttctcggtcgcgacagaaactacaatttagttgtactctctggagctcaaaagttgtgtgttgaagtgtgttaggtctcctactttcatagctgccaatgatggttggaatggcggttaacccctcagaaccatcattgggactccactggagccatccacgtgtaaggtggagatgaggtgggccaggatggattctctagcagcttataggtgggcccctatggcggtttggtcccaatgtaagtcagtttcgactgacttgtggtccgtccaatccttgtactcgcacatgattggtcagaggttcatttttgtcgcatggcagatatattttctccttaaatgacctgcatacatatatttaccaaaattagttgaagtggttagtagtaaactcctaccactatgttttgagagtatatttgatatcttttatgtaggtgttaacggttaaagtttgcacttaacgaccttcaatgacaccccaacacttatcttcaactcgtccctgagtaaagctcatgaacctactagagtaatgactttttgcttcatgacatgacataccaaatattccaagacatacttgaggctgtaaacattgatgtgtttaccatgccatctttaggcgattgaagaacgtaacagtcctcgaaccaagtcccctctactacttctgatgaattaccataggattttctttgatgtttataaaaacataacttttactgtacttctcaattgactccctcaaatcactcaaagtgtttattcctcaccaaggtattgatgttgcattttctcatcctacctttctaattaggcttatatggatctcagggtagggaataagaaatgacatacttgcatcagatatatagtaaagtcaaacagaggatacaacaagataactaatcatataaccatgaccaagcttgtgcacctatgtttatgggtagaaatgaaaagggtgaaaaatctacaataaaaaatgggatggtgactctttttatctctacctttttttcatcgtgctcgagtttgatcattttcttttgagcagagttttttattttagctcatctctcatttggcatggatcatgggaggagagaccacaaaatttttagagtctttattctgtggatacattgcttaaaacatagaagtttagcatatagatatggatggattagttttctttttggctaatcctccagtgtagagaaaaagcaatatttttggtgtctaagtgcacaagactttgctcatgagaatatgaaaagaatctaagatggtcacaaccatttggcaaaactcaaaatgatagcaagcaattgagtaccaactttccgataatgtacaaggtttcatcattaagatcgatatatggctttggtaggaagggaacatcaatgaagagtacgcaaagatatttattttctttttataaaatcccaaggattcattattaagagcaaggttcatatctgttgacggtcgttagcgatcagtttcgcacgtcaatattaccaaaataaagtagaactaagttttgcttgcaaagcatattatgtcaaaataagatatattccactagcactaggctttctaacctcttgcagagaataaacataaaatggaggcgattcgacagtaaaatggacgatcaatcaatcggacgctgtcgaggatcagacttagaggaagatgggccaagaattcagaaagaacacaaccaatgggacaaaactcgcaagtctgcagaaaccaacagaagaggaggccgccagccgaaattggactaattttggcccagcccatggttcggccgaacccccttgagctccgttggatgcaggggttggtttggacggtgtggattagctccgaatgatagttggagaggtatttaccgacgcattcgcaacaagtgcacaaccgtcattggagagctatataaggccttcacctcctcacctcttccacacatctcaagcaagaagcttcatacattctctcaagtttaatatagtttctagagtatagtggaatagaaatagaatataatcttcagtccgcagagtttttggaagagttcgggtaagactctagtagcttttccttcttttgtaagacttgtactatttatagaatattcttctcaatatattctcatttttgggggttatatgctgcggatacgtcgaggagggctactgatggagacagctcagtatgggtattcctctgcgcgtgtatataatcctaagttatttttttagggagggtactcctccgtatttagccccagttggatgggcttgacgggttgttgtaagaaactcggcaaccaagggtggtctctcgaaacaccaggagggcatcataagggggtattggctatacggttatatagtagataatattgactaaagtgtatgtatgtatattagaagtataggaaatgatccttttcttattctttccacttagcatagaattagtaagtatgagaatagtgaatgcttcagctttgtgtcaccctaccctttgaattgaactaaccccttcttagactttgattattacaagtaacatataagtattagcttggttctctctattataattttcccacgggattaaaaaaatacgatacccttggaatactctcgggtgaaatgctacaattatccatgtgcttgcggatgaactctgtaaccataatataccacgagtgtttctgcgtcattgctgggaattatatttctagcaatgtcgttaagaaataccaacagtgtttagattattggatatcattatttagggttatatgctgtggaagcgaggtgggctactgatgctaacagctcagtacggttattcctccgcacgtgtatatagtcctaagttaatttcctggagagggtactccttagtatttatcctcggttggatggtcatgacggattgtcgtaaggaactcggcaatcagggtggcttctccaaccacaaggagggcatcggaaagaggatattagctataatgatatgactaggatgtatgtataatatgtatgtatactattgtcacgccctgaagtttcccccttcttctttctttaaaaatttgttaaataaatcgtccaaagagatggttcaaattaacctagagctaattccctaattaataaatgcaattaataattggaaatggcattgtgggatttttcttgggttccacatgtcgcaattgattaacaagatttttagtggaattttcagagccttggaaataattttaaccaattaaaaatgagcaagtgcaatatttaatcccaggaaaaatcctttcttctttttcttttttcttttccttctttttctcttatgggccgccggcccatctcctcccgcgccctccccctcctaccgggctggccggttccctcttcccctccagaagtccacccggtctccccctcactatcaggtgctgacaggtggggtccacctatcagcccttcccctactccagcggttggagccaagctccacgccggcgcccccacctccccacgccgcccgctcctccgctccacctcgtgcccccactccacacacgcgcc

SEQ ID NO: 65833 - DNA, 3353 bp, Oryza sativa
aactcggaattggaccgttcaagtctctaatttttccttaagaagtcaagaacccatttttgtgctttgtttctgctgttatgtggagtttgttagagtaaaagccttttcttttccgttggtcgtgtagacgctgcagcttcggaagatccgctcttcgtagaagtcgaagccgtcggttgggaaagcgagcaaggcaagtcacatcatctttgaacatattgaatcccagtttgtaaagttatgttgatttaaattattgcattatcgctttatttaaattcccgcgttatcactgttttatttagccatgcctatttacctttgttatgaccttattattgttattgttattatttccttgttcaccctagattaaataaaacccctactagtggacactctactcgtggtatccctagtttaaatttaggtagatgcttcgcaatttaattaggtaacattaggtggttttataactttagacttgggaaattctcatatcacctggacactgtgaaattgttggtttattgtggaattggcttcacaccgccccctctattcaaaatccccaaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgattaataacattgtatagctctaggatcgtgtttacaaaatagcttgagcaactaaatgtctttaaatgctgtttactgcaaccctaacccctctatgttataattcccttgtactcccttgcatttattctgcacttgtgggtgtgtcttgttgagtacggtggttgtactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgttctgggccttcgctgcccatgtaataaattaactatttacgcttccgcttgttaaactctgatttgtatcaacttttggtgtaccttgcctcctgggacaaggattaatgcacgcacgtaaggaatgcccgttgggttatttccggtcgtgacacaaagatatattttgtagacggtattattgtccaaaacctcaattagaatgaaaccgaagggagtaatataatttccacttaaaccattgtactactttgtactattattttcaaataatacactattttaaaataaagtttacacaattatattgtgtacctatcaaataaataatttaagatctatattaactaatttatacgtgcactcccattatttaaatcatccgatatatttttttttacattggactatcattctataataatgcattgtttcaacataaagtctacaacattatattgtgtacccactaaattaacaatttaaaatgtatatcaacgaatttacacttacactaaaaccggtggatccgttatttaaatcatcggatctattatttgctaataaataaagcatccaaagctccctttttggctcggtgcacaatgcacgtctgcacatttgccttttgcacacgtgacaaagcgtcgtgtctgaggcatgatcacgaccgctgcagcgctaccgctttgctacatgtcaaatcatatatggagataataaattttgttaataacatgaaaagaaaattaaaggtgtgatgcagcgagagaagaattaagcaccgtgggttgtgtttttggaacacttagttccatttaagctgaaccaagagttgattacataataattataatgtattatgttatgtcgtatttgaattttgtactatttgttcgtacaggtgaaagaaatcattatattataaatatgagcacaatattaaagaatatcaatagaactcttctaagacaagggagtttaagaccctctttttttttgattccatagtttggattttcgtttgcacgcttttcaagtttctaaatggtgtcttttttaaaacaatagtttaacttttagaagtcaattcattcgtttataccctcaaatagcaatcgcataaatcagataattcatcaatttcagttgtcctaaacccgcgactcatggtggacaattggggatcgacggatactcaaagtcataatatgaatatgtaagagctactatgaataactgtaaataggtgtcaaaattaattgctattaattagacatctaatggcttgcttgccatataattactttctctctacgtgtatataaacatcgacgaagctggaacaaatattaccatatgccccatacatatatattaagcggttaatattgtaattacatgtgttaagtcctttaaaatttcttaaaatgctctcaagctatcacgtggtgctctaataaattagagcaaatattagaaattctatcaaaaaaagcaaagcatatattacttgattttcacttaaatcggtacgtccaatattataaaccgttagattaaattgatcttagaacaaactaaatactatgaggtcccacctctcctcccactgcataggtgcgcacctacgtaagtgggtacatacacttaccctctcttttttcattatcccctttcttctttgttttccatgcatacgcttccctccctttcttattatatcatgtgccttatgagacgattaatcacaagaatttgcatatcttgctctc

SEQ ID NO: 65834 - DNA, 84970 bp, Oryza sativa
  unsure (1)..(84970): unsure at all n locations
aggcacgtaaattcaactactatggtagccagtggtgactagcttgtcctcatcggcttggtactaacaaaagataggagttgatgaggatgagggactctctgactagatcacattcgatgtactcctacagttgatgcaaattttggatttttccctatcaatcttctgacttgctaagttgtgattaatgtgaatgctctattgctatctactttctagaatgaaaggagtgcctttcgttcaattcaaagtcacggagacagaaaattcgaaggtcaacaaatcagtcgagtgccaccatcatgtagcagaacacccgttcgatcaggacctcccgtcgtctctcccatttgggtcattggcattcatttcaacccctgctcaagttggtccttcaaactaatctgattaatccttcctcacacccaatgttaaagcatcccatcacatgattccacgtctcctcttcttgtcttacacttccaagatggcactctcaacttccctcctacgtaggcctccgcccactccctcagtcttaaaagtatgccacagtttcgtccctacaatcttctcaccaagggcacattgtaatgcatttgacatgatctgccccgtctaccatgtttcatgtatcaggtatgtgctacatgcaagcacataaataataagtatacttatttgcaataagctacatagcctcattttatacaaaatgagctaatatgattagtatagatgaaattgtctaagttttttttttctattcactggtggctttttcttcactttggcacttgaaccacaatatcaactatttcctgtgggactgtgaggctgtgactacgttatatccaccaaaatgatgcagaccacgttcaacatcacatattccaccatccagaacacggtatgttgttgaacaaagttaaaaaaggggcacttagtagtaacttgtaatgcatgaattgacaaaattataaggatgcaagaatcaaagcaaccaactgggtagatataaaaaaaatgcatcaacacagtaaaatggaagatacgtagggaggtgtacagaccttcaaaagaggtgtatggcgtttcctaacctgcaggaaatagacattatgtgagtaaagagttctaatttcttaagaaatttaggaggtggattccaacaaatataaaggctcgtggtatgccaatgaatactgcaccatagccccccaaaagcattcctactgtcgagaacatattttatacgcaaataatatacgagttacaaattgtttgaaaaagctctagtttgccacagaaataaaatcaaagttccatgtgtcctaactaaaattacaagtacaacaaaaatcgggaacaacagatttactccttgagttatacgaaggatttttagagattttatttttcaaaattgaaacatcgacaagtgattctgaagacaaagatttaaggcaaataacattaaatcatatggcacattggatgcaaggcaatctgaaaataaaagaccatgcacccataaatggaccaaatttccttcagaaacctgaccatcagaattcagaacactataaaagaacattccttactttaacctctaaattgtaaagaattaagaatcaaatgatcctatacattcaagagagaatatgcaattaaatcctgctccaatatatcctaatatttcagaaataagtatagccttattttttaaacctgatgttaagtatcaggaatggatagacagatagtaagaactcaccacataatcccatccatgcttttcagcaaatgcctttgctgaatctgcactgtcaaacgtaagccctgcttcaccaacattagcatatggatctccagtagatgtccatcccattaatgggttctcccacctattattcacacaaatgttagaaggggaaaaagcggcagcaactgaaatagtaatatctaattgtatgctagaatgctatataataaggaggtgatacataaagctaaatgaagtaaatgcatgagacataaaagaaatgaaatagactaagtacacactgtttgaccaaaccaaggtgaccacctcaatgagaggtcaaatgcatcagttgcaaggctttcattgtacaaaaaaaagggggggtaatctcacgttaaaggaaaaaaagaaacagacttcaatcgtcaatgaattcttctgttatgaatgtaaatcaagttttaatatgagactatttgttttcatttgatatattattgaggcagttcaccaaacagcaacacagggtttgaggtaaataattcatgaaaatgaatcaacaataaccaataaaacaaaactggaaacatacttttgggttgacacaaagttgattttccacctcccgactttgcctgaaccctgctgagatgcagtcctagcgggtgaatatattacaacctgcaaatacacaaggataagttgatcatgtcttcccagctaggtagttgaaaagcatacagtgagtcttaaaagaacaaaagtggcagcaacaaaaatcatattttctttacagtataaatatttaaacctatctgaataacacaatcctgtcgtaggccatttagaaggccgtttactgtataaacactaaaaggtgggggagaccacttgttaacagtctaatgatctacaagaacatagatcacaatcaaaatattttctagggctcactctgtataataaatctgcaaaaacataagatctattgatgtgtaggcatcctctctctgcagacaaacataaggttgataataccatgaaaaatgtgactgaagtggtgctatcagcattgggccatatcataagatgcttctaagctctttgaagttaagacggatctttgaaacaacagaagaattgatcatcaaacaatattcgtattaacgagattatgttgtagagaaaactatttcatggaagctctgttcctcagaagtcagaacaagaaactaccactctacaagtaggcctctacatggattttgaggtaattacaagaactatgaaatggtatgaaacagacattagttcatagtccaacaagttatctaaattcaatagctaagcattgctagcaatttcatctttctttgtatgcagttagttctatcaaatgtatttttaagtttgatgtacaccaagaaaatggataaataataagcatcctagcatcatctaaactctggtatgtacagttctctaacaccaatactgtcaactctaatcacaaacaatttgaaaggtaagaacatacacctatatacattcagtcattcacagtacataaaccaaatcaggataatttgatcaaactctgttgcctccagccctccactaacataatctaaagtgggagaacccaacctggagagcagcacattcctcccaagttctaaacgcagttcaaaccacacaagcgtaaaacatcatcaccaaattcgcatttctatccactccacgattcgaacgtctactagcgatagcactgtagtccgtacgacgagttcacgacccgacgcctccaggctctatgcctctatccctaaacacgagtaacgaccaaaacaacccaccaaacctggacatctcgagcgattcccacacggatccgcgagggctagccaatctatcgccactacataaatcagaggtaaggtcagcgaagcaccgcaccttgcggcggaggtgctcctcggggatgccggagaccatgccgatctcgcctggcttgatctcgacgagggcgtcggacgccgccgcggagagcatccgcgcgggcgcgggggacggcgagaggagcgtgcgccccagggaggggaggctccgccggagcggggcggccatctcgtcggagccgtacgccggtgaggcggatggtggaggagagaaggggcggacgagaaggccgaaggggaaacaccgagagagagagagagagagcacttcagaacttgggagaagagacggctggaccgaggatatgttggaagcagctcatgttgggccaatcttctcggcccagtgttgtgggatccgattggtttatgggccgggccttgcggcccagactggtgcgaattcgatttgtttctgtgtgctgggcccagttatggtccagtgggtgatctgcagccttggagttgaaggcccataccgaggttagactagctcgttgggttttggtccagatgaaccactgacttatctgggccggcaatgttatattgggctgcctctggaataattcttgatggcccttttgataatttatagaattcatttttcagttccgttatttcaactacaccgtgatgaagttcatcaagagcataatcacccataataagtgtattcagataatttaatacaccatttggtcgtgaatatttgatggttaggccggacaatatttggatggcaaattttactacaaaacatctaaatttcgtgtaatttgctgatagacatcgaaaaaacattcacaaatgaaagacatctaaaaatactagtaatttgttagagaacaatatcgactcaattaaaaagataaattcttgagaaagacaagaatgcccctagaatcacatgcttcaaacataacgttaaagtacgaatttagaaattatgcaactccaaatttagcatcaccccaagtacatcactagtatacgtgatattttatcttcaccctagtctcagttcaaaatcttttgaccgtgggggcatccttgtcttttttaagaacttttcttttcaattgagccgaaagtgtcatttagcaaattatcagttttttaagagtgtctttcagccgtgacacgtttttatgatttctatcaacaaacacaaattttgagtgtcctatagttaactttacctatttggatcttacttttgaaactttaactatcaatagtctttgaaatgcttagtttaaaaacaaaagacttggtagtatcaatgttttatgcccataatatagactaattaaattttataaacttaatactaattggccgaaacttgttttaaacgttaactatctagaaaacgagggagtaagtcttttgtatttcgcctaagaatgaaaagtgattaacattgtgtaggaggacaaatacgtatgatctatgatcacatgaagttctgaaaaaaaaaagatcacatgaaaatgcaagattacatctctaaatcattttcaatatcgatgccaaagaaatccacaaataagtccacctgaatatagtataaatacaaacgatattcctatcttggatctttttcctagttctagaacagtacattttatttaacaagcaatagctgacgtgtaacactcttataaggtcacgttaatccactattttttcccacgatcatagaggaaatcatgcacaaccctaaaactctcaatccctgtcctcattcatatacagtaagatttttttttccagagagtacaaaatgcaggggagagagggatgcgggcacgggtgatgatgccgaactggccgaggccgccgatcaaggacggcgaagaagaggtcggggtcggcggagggaagaagagggagaaccgagagaggagagagaatgacatgtgaggcccacgtgggccccactattttaaaaatatttttgtgtgtagctcacatgtgggaaacgatttttattattttccgagatataattgccaggtaagcgctacgtcaatgtcatgtgggatggagacctagtcaaaccagccacgttaggcccacgtcagccaaaaccgccttccaaaccactgagagacctcatttgcaccggttttgacagtttaaggactggttgtatctggttttagggttcaagaacgaaaaacggaatcggtgtaaaattaagagacctcagataaacttattccttcgataaattatagacttcatttttcagttccgttatatcaactaccctgtgatgaagttcatcaagagcataaccacccataataagtgtattcagataatttaatacaccatttggtattgaatatttgatgtttaggaaaatatttggatcttattttgaaactttaactatcaatagtttcgcatgcttagtttaaaaacaaaagaattagaagtataagtgtattctgcttataatatagactaattaaattttataaacttatactagttgatcgaaacttgttttaaacgttaaatatctacaaaacgagggagtaaatctctagtatttcgcctaaaaatgaaaggtgattaacattgtgtaggacaaatacgtatgactatgatcacatgaaaatgcaatatgacatctctaaatcactttcaacattgatgccaacgaaatccacaaataagtccacctgaatacagtaataaatacaaacggtattcctatcttggatctttttcctagttctagaacagtgcattttatttaacaagcaacagctgacgtgtaacactcttctaaggtcacgttaatccactatttatttttccacgatcatcgaggaaatcatgcacaaccctaaaatctcaatccctgtcctcattcatatccagtaagattttttccagaaagtacaaaatgtggattttaatgtacgtgctcacgtagaaaaatacataaaagtcttctttgtttgcgttctattagaaaaacattacgataacgacttttttttattggatagttgcggtgcattatgacattctgctatgaaagcatggtcgtaatgatagtcatggatgagcaagtgacagcaacatcctgcgttaattttctgcacgcatggttagacacaatccatccagaaggtttgaaattaatcgagagcttaattagattcacatgttaatttaactggcgtggcagcttatccttgtcaggcgccggccggcggctaactcagtaatactgatgattaatcaattttcaagtcgtacataaatttcttttttaaaaaaaaaaacagagttcaagccgtatatagctgacgcaactgtctgttgattcgtcagtgaattggttaataaaataatatagtacttagctgatctttggctgattttttttacaataaattttgaagagatttatcatactccgtaaactgtgtgaattgtggtgatgttgaatgataatcaattgttttcagccaggtaacgatgatcaattgtgacattgctagtgaagtactatactatataataactgtctcgctgatgtcagtgatgaacttgataagaattagcaggagtaactaactaactagtaggaattggcgatgaattaacttgattgtactgtacgtgaggtacgtgatgcacgtcgtcatatctatctgccgtgttcttgaccacttccgtcgaacattcttcttcagataaagcagatagagatactagaatgccacaggtctttagcccgttgagtcaagcaaattaaatgattacgaactaacgtagtaattaactgcacccaaaaacaagatcagctcccctgccattaactaaaactggttaaactaattacagtaggctaccggattgatttcaaatattatggctgttcttcttcaggttaaaatttacatagttagtttttcaaaaaagaaataatagacatttataatttaagtttgacttatacctgcactcgaaactttgactcgttttcagatgaattaatcacgcagccttttgagttttgatccattcaactgttcaaggttatctgcgcggcgcgagcgataagggctttcagaattcagagtccacgccttgcccagcaatcaaatattaccgcgggccagaagctctcacgctcgcgagaaatcaacgctgcaaaacgcgatgacatcatgatctggcagaaaaatgcaggcaatcatcatctccaaaaccacgaaacgagagaaaccgatgacgtcgaaaaaccaatctcagcgccgttagctcgtgaaaccaacgtgattacccgaaacctgcagcaaaaaaatcgtgctgcagaaacgttgttttctcttttttttttcaagaaaaggaataatagatgcaggaactgtaatgatccgatcccatttgatatggtcaaccaattaaccagcatcttagagctaatctgatccgagctgcacataatcagatcgattctgtgctcgagctgagctcgatatacaatccggcgcagatcgtgagctcgaaccgagctcgatcgacgggtaactgtcattgtcggtagctagcttgatgcagaatcacaagagtaaattaatagtaagattttagttatcatcacatactaaaaagctagtaccggccaaattgctctcggcagattcctctgcattttgttactcgcacaactccaccgggtcaatcgtggcaagcaaggcacgaaattaattttcttttacaaaactgaacagtagtatctttctgaacgaaattgaatacatatttctttcagacatccatacttgaccaagcacacgcataggcaggcagcaatcacgcgccaacatctgaagatcaagtctttgctccagaaagaaaaacacacaaaaaaaataataataacacgtactagaagaagagcaggtcgtcgcggagacccaagaaataaacgagtcgggacagaaacagaggcgatcgcgttgcgttgcgttgcgttggcaaatcctctttaaaaggctcgtgcccgtggcgccagaaatcgttgatccgcacacggtaatatgcaagagatgttgttctgcggcacgggcagtttcaaggacgtcgacggcaaggcggcggcgccggaggcgaagaagaagaagcagggcggcggtggtggtggtgggaagaaggagaacccgtacgcgtcgagggggctcgacaagttctccaccgtgctgtccgagctcgagtcgcggcgggagaagatccttcgccaagtcggcggcgccggcggcggcggcgcaccgggggagggcggcggcggtggtggtggtgagcatgtgctcgtccggttcgtgcagtcggaggggaaagggtgggtgcccatcgtcgtcaagctcccgcctgaggaggaggagcagcagcagcggaagggagggaagaacaagcggaagcagcaggcggccgcgacgtcggcgacctcgtcgcagtcgtccacgccaccgacgtcggagcccgccagccccagggaggacgtgatcaagcccgcgcgccccgccgccgccgcggcggcggcggagccggggagtgcgaagcggaaggccggcgtgaggtggtcgtggtcggacgtgcggccgcgccactacatgccgttcgtggcggtgctgctgctggcgagcctcgtggtgttcggcaaggtgttcgccatctgctgcacctccgtctggtggtacctcgtgccgatcctgacggccagctctaatggcgccggcggcgccggcggggcgcacggcgtgaggagatcgaaggccgccgtcaaggttctcggcaagaaggcgagcgacaagaagatggccgtgacgccattgctgggtccttcgcacggcaagaggggtagctccggtgtccatgagttgatctcgccgagaagtcatccacatgggaagaaagggtagtaattcgcgtggattcattcaccacacgctgtgaaaaaatcaacgccgtgtttgtaaatgtttgtacagtagggtggccaggaagatcagattttttttgttatctttcctaccgtttcgattcagtttggttgcaattgcatccagtgttcatgtagcatcagcccccttcttgtgtggctacccaaaattgttcataaattttacagaattttgtccattaactcgtccctggtgtactggcagtttattttcatctctatgtatgttaactatgccttcgacttctggatctctggttgatttgagagagcgccattcgtttatacgttgtggaaacatgttttttttttttggctctatccgttgaccttgtttttaggtacaatcatcagtaaagaacttctagattcaggcatgtgattgtgtagccacgcatatcacaatgaatagaaagtcaagcatgtttacttctagaagttagagaacttacttgtttgacaatccagaagaaaatgcaattgtacctgcctcgtcaatgtcaattcacattatctgacttttaaccaatacaaacagttatgcttagaatttgcaggcttaggctgatcttagccattgcaatttctcattcagcaaaattgtgagtttgtgattgaacaatgaatgagcatacattgagatgccaacagtgcaaattcttttacaaatcacaagcaagactgtgttgtgatgatctctgggaatcaaccaggacataggctaatagtaataactacgcaatacctaattcagaaagactttactgttagactaatgatgaaacaacagaatgatacagtacaatcattttccctgtccttggaaccaagtaatcccaccatcatgccatgccctatatccatcaatcctgaatcataagggaaataatagatgttagaaaatgttacaaagagaatggtaaaaatgaagtaagcaatacagcattcgggccaagaggaacaaatatatacaattatcaatacagccacaggcaaatcatccatgataactaaatgggatgcggttgatattgcattctatgctcccagccgttcagcactattaaacccccggcaagatgaaaatatgcatcaggatgcacccaatgaagatgaatgcacatcacatcacaaatacttatattagaaagatttgatatgttgtcctaccctaaatctctttctatgatctgactcaattcgcgatgtgtaatgtttcttccttccatgagccgatgaatttctctcttctaaattgctgcgaacaggctcgtattgtgcattgcggaagaaaccttcatgatcccaagttacttcatagtctaccttcaaccgtgatccttccttcaaacagaatagatgagtcagcttccattatgttttctaaaacataaaacataaatgataacaagacattaattgaggctgttctggcatatatagtatacatatgtggatttatccatgtgtaacaaatttatgcagcttaaacttaagttgtggtgccaaggtagtgaatatgagatagtatatatcagtcatcactcatcagagctgtatgtggaaggaaagcaacaaatcctaccaacaattgtggtcctcaatcctcatagaagctgatgcacttctaataatttctaatacctgtaagtatctaataccttagtaattttgtagtcctcttgtctagctaatttagtaatgatctctctagttagtaaacactaatgtggtcactttgctttcaataaacatagccatttatctgaccatggaatgtttatcggcagggttcaccaaacaaggaagcaaccagataaccataagctaacgcatgaaggtactgcctggcactctaaaagtgggttcaacccaacccaacccatcccatcccttgaaacaaacacacgctgatagagggtgatggttaacttcagtggaagatagtgatgtgatatcctgctaactttattggaagactcagaacgcttggatgtatttgaaaaggccaacaggacaaaatatataggatacaagaaacacaatcctacactaccacaaatacctctagcatacaagttcacacatcagaagggcatgtgaaggtctgaaggatgtgtgctatgcaacgtcagtgcatgataattgccagtaggtaatgctaaaacagagctgcacagttgaaacaaaaaacctatatagaaggaaaccagaaaggaaaatctagaggatattgacttcaaaaaaaaaatctagagggtatgctcacaatatcatttatatgtgttatgtgaactaataaaaagttaaggattgagagataactggtaacagaatatgaaaatcttactttttctaatgaacgtccacataatgcctgcattgcactgttgaaatcgtcgtagttctcaaattgcacccacactttgcaatttagtccagatataatctccttattggttccgtcttgttttgctccccattcatcatcactagaaatattaaggttcctgaaaattggcagaagaatgccaaagaaaagggtatgcggagtaagttccccaaaatgtgaagggcagttcataacctgcagaatttaaaagaaattgggtgcagtgttatttaaagaagtcacatgtatacaatagacattactccattattgtgcttgatgcactagggttatgtcgtatgttgttttgtgtgacatggattttatgcgtgcaatatctaatactactaaagaaatttattttacccatgttacttcccaagcttctttattatgaattttgaacatagctaacacattcacctaagctaccacactaacatcagaaactgtatgaactggtttttgctgagtttaattgctatcttggagaatcagatcatagatttcaaaatataagaagcgatatgagtgagaagaaacttatatgtggatgaaaaccaactagacagggcagaccttcaggtttcaggtggtgctaattttaatgcgcatattaagctctcaaaaggtgtgtataccggaatgggaaggcaagtaagaacaaaatatgagtccacaaacaaaataggaaaccaccaggatggacattgaacaaaactgaatcaaacaatttccttatggatgctcatgtcaactaagtttaggactcttttcgcttttattagcttacgtccggcactaatattctgccttgtatcccagagatatgaatgcatttacaatataatgaaccaaacagaagttgagaacaccaaaatgcaccttattttaccaagtgccgagaaaatagtgtgtgtgaccagcgtggaggctttcgatgatatcctcgtctccgcaaaccacctggatggcacaccccggacaagaatggtgtctggccttttcgctatcttcctcacaggattccctgagcaaagcaaacatcaattcaaactccacctagcaagaatcacaactaagagcagcattttcatttaaaaaaatgaatcccatactgctactgaggagctcggaggcgtagaaattctcccaagacttcttcattgccctgaagtcatcggagggcgggatctcgacgctcatccgaaacttaaccccctcgaggttgagctcgatcccggccagcttctcgaccagggagctcctccactggaagtacttctcctcctcctgctcacgggtcatctcctcggcctcctcctcctcatcatccccgttgcggcggcgtgggcggaggaaggagaggtcgcggacgtggaggacgcccgaggcgacgggctcgtcgcggcggcgcttatgcaggtcggggagggtgcgcacggagaggtcggagtcggggaggacggggagggagaggggcgggtcgcggaggaaggcgaggagcgcggtcttgagctgccactcgtcgacggggcggacggagaggtcggcgcggaagaaggtgaggagcagcttgaggcgcggcgcgagggagaggccgctcgggagggggagcggctcggtcggccggagggcggcggcggcggcggacatggcggcgcggtggtggggagagagacggcgggatggcggcggaccggcggcgggttggactcgacgggttgcagatgggccgggtgaatggacaatggagaaccggaggcgagagaactgttgcttcacgcgttgagggccgtccgatgggagatcaacgggtgatcgtaattcaactatcgcctatcggcctatggcgcggatgtgttgttagagaaaaggattatgtcgagattatgttcacgtcatgttcatacggactagcgccgatttgaacatgcaatttcgcacgaaattcatacatacgtgcaatatgggattccgagcataagaaaatcataattcgagttcaaagttcgaacacaactccacatcgaagacaatagatcttactatcatcaaatgattcgtataagattcaatgctaagggaactattctaaataaaattttaaggggatattcactcgttgtttgcagctactcaaatggttataaagaaataaaataaaaaatcgacgagatagattaatatatgatatatcaatccacaaacatacaagttaaatttaacttctacatatcgcaatttaaaaaaacaaatttaattgtcaatatacgttaactagctgtagttttttttgcaacttttagaagttgatttttagcttgcatgtttgtaaagtgatatatcacatgcaaacaacaaggaacatccctttaagagtttaaaatctactctcttcaatactctgtatttatgttgcaacaccttattctctcttactataaagttataacccactaactcttaaagcttaacatgcaaagatgctacatcatcgtcgactaacagttattacatttaaatatcatgcaaacatgctatattatctataattttataatttattaaattttagagctttaaaatacaagcatgttaaatcatcatctcacataatttaaataatatgttaatatatatcttcattatttttaataatatcttatatacctatatagttcatcctcaattagttaatgatatttttatcttctctcattaagccatatcacatcaattgtttttttttgtgcttaaatgatttattaaattttagagctttaaaatgcaagcatgttaaatcatcatctcacataattcacataatatttcaatatatatcttcattatttttaaaaatatcttatgtgcctatatagttcatcctcaattagttaataatatttctctcttctctcatcaagccataccacatcaatttttttttgcttaaatgattaatatatggtcaaattatctccacattttcttctttcattaagctatatcacctcaattgcttttaggtcttagatgattaatctatgattcaaactgtctccctacttttcttctctagtaaagtcgtatcactttacttttatatttgaatcattattttatataccatttaaatttaaattatcataaactacgttaacatactcttatgttgtgtagctattttatatattatttttacttattgttatcataataaactactgcagcaacgcgcgaggtttcacctagtatatgagatgttagctctcaaaaaatgaatatgggctggatttgagatcctactggagatgcaattataacttgcaagtcaatgtagcgataaaattctaaaaaatgcgctaattagacacaaatcaccctttgtaagaccctctttcgctgaaaaaaagttctgagtgtacatgtcgcatttccacttgtgatttttttcaaaacgctcagtgatatcactttaacttagaactattgtaccatattttatccccaaatttcattcgagtgacatatagcaatcccgtttgctttattaccaatctgcacgtgaagtgctatgcaacagccttgcattgcaccgggaaaacagtagagctcatcgccctccgccgccccggcggcacgcctgcctgagcggcaccggcgggtcggagagcttgccgccgacgatcagctcgaagacgaacctgttcgccgcctccgtgaagtgcaccccgtcccagctcacgctcctcgacgggtcgtcgcacgacttccccgccagcaccgacgtgccgttcacctccaccttcccgccgcaccggatgtccctgtcgaagttgtactcgccgccgccgtacccgcagcacaccagcagcgggtccccgaatcctgcaacgaacaatacccaccaatttttcaatcctgcggcgatttcaagtgtttcttctccggctccggtggtcagatcaacgtacgtaccgagctgcttggcctggctgatgagcctgtacttggcggagtagacgtcgacgtaggtgagcgcggcgtccgggagcgccgcccttagccggtccacggtctcgcgcagcctcgcgttgaagaaccgggcggccgcgttgtaggcgacggagcagccggcgtcgtccctcggcgcggcgagcttcggcaggagcaccaccgcgtacgtcaggcagccgagcggcgccgtgttgtgcacccagaagtacctccctccgaggctgtacactttctgcactcaccaagcaagcagagcacgtacagtacacatgagcagtcctatcgttttattcgaacggcatatttacaaaagaaaaataatttataaataaattttttatatacatcttcttggcaatataaaagtataggtcgaaaattaaactttgcgatagaaaagtataggtcgaaaattaaactttgataaaaaaaatcttaaaattagctttaaatataaggttgaaaattcagaatttgactgataagtataaacataagcgaaacaataaggccgctgatcatctgataagccgtggaaaaataaacaaaacaagcaaagattatttcaatacaaaacatttatatctctgttattagtgttttaaaagcaaatgctagaaaaaaaactacgatgaaaagatcctaaaatcatctcgaaaattaagttctaagaagattcaaaatttcttagtttgtcaatcagtcaatgaacctaagtgtactgtaactaggctgtgatcactgcattgagctgcacctggatggctgcactgaacctctccatgagatcagggacgtaggcctcgacctgctcagtgctcatgttgtcgaagtagcccattgtcaggtcgttctggccaatgtcgaacgtgtagagcgccctggagaagtactcagctttcggaagaatctccctgtaaattccacctgcacgaaaacagagtatatatcaacttcacaaaaaaaatggaactgaattttgagctctgaatggcgcatatgcagaggctgatcgaatttgtcttcacctatgttgctataaacgaactggcttctgttgatgaactgttcgaattggctggtctgcacgtccagggagatcgggctgatgccggagacgaagatgctgccattcgctggtctgatcgacgcagcggccgtcgcgaaattggcaccttgactgaagttactcccaactgaatcgaggtatgcactgaggtaacgaatccccaggctctgagctgcagcgtcaggaaaccaaaaaaaaaaacacagtagattcagagttcgttccgagtaattgggacgcactgagtattactgacccatgaagtcgatggtgaggcggccgtcgctgaaccggccggcgggcatgccgaagtaggtccggccgaacggcggcggcaccacggcgatgagggccgagagcccgccggtgtccgagttggagtcgccgaagttgaagatcgccgggaaatcgcatggcgcgtcgctgccgccgtcggagcttgccccctcggagagttgcagcaggagcacgacgaggagcaacacgagcttggcggtggtcggaggagcggcggtgcagcggcggcgacgtcgtgaaggcgccattttttctttccaccttgctcgatcgtagtgtgtgtgtgtgagacttgtgcacttgattattcggagctagcgctgatgtttcatgtttcataggggaggtatgtgtgtacgtgtcgaaccaacgagtcacacgtccacgaagcgttcgaagtccctgtccattctttctcaagatttttctaggtttgggtgttgtttgtattcagaattcacacattgtctcaggtttgcatcaggactggtacaatggggacaagagtttgtgactttttctggaagtctgattggtttctccttgtttgttgcacgtggcgtgaggatgacttatctacacttttctaaagtaacttattctctcttttgttttccacgtgtacgctttctaaactgttaaacgatatattttttaaaaaaatacataaaagttgtttaaaaaattatatcaactagaaagttagcccgcacatatgcgcggacacctatttaatgtgtttgtgataatacaaatgtttatatgtgagtgactttttactgaaatattttttactcaattctaaatctgttctttttttgccaacaattcattttggattgctttgaatgctagttttgattcccttctaattacccttaaagcaaataaagtctaaactaaaattacttgaaaatatgaatttataaaagaatattgtgtcataagaatggagttggttaccatgaaattatatatcatttgtattatgtgtatttactttttaaaatatttagcacatcttatttttggattttctaaactttaattaaggtaaaattttattatgctatatatgtctttatagattttagggcatattaattgaagatattttctattaaaaatatggctaagagactattttatctaactatagatatacctctatttacctctactttctccgtctcataattccaaggattcaaatcatatcccaaaatataaaggttgtaaagtactaactgtcccatcgaaccacccctcatttattttgttcctaatcttacttcaaccatctttattttttatccaattttatctcaaccgccttccctatctctatgtatcctttatttaatgagagttgtcatagttttttttcctccccttaattcctcctaaaatagtatgatcccttacattataggataaagatgatacaaagtatgcaccatttatagatggatttgtttggtttgtttgtgcctatgtagattaatttagccttgcatgtttataataatgtggatacatgaactattgatttagttgtagcgacataatattttactgatatttgaactatccaaaagcaagggtttaaatatggttatttaaagatcgatcaaatatttagcaagtatgctcatgaatttagggtggtcaatgtgcacacaaattgtgctgcccgcgcatatggacatgtgaaaaaacagggtcaggtgctctacgcaaattagttaacattccctaccttccaacaatgcaaatttgtttaaaatatgggtcattaatttaaataaaaaattttaagagctgtatgctttcaaattaatttcattagctagctattctcatgttatcactttttcttcaatcttagagttataacagtaaaggaaatctggatgtaatactttataaagataagctataataatcttcaaaataccacgggaagaaaaacatgccaaattaattggcttggtgaataagataatataccttcgtcccgaagatcaaaatttcaaaagtaccattgttatgggaacaaataacttaaaatatgcataaacatcttcagaaaacctgtaatgttatgaggaggtgattattagtttaacatcaaagagaaaagtaaaaaagaatgtgaaaaaactatactgaaccatattaaattaattaatatttttttataattgtatagctgcaaaaacgattatgatctttgttgcaaaaatatgtcattaatgaaggatattggtattgtatcctctctgcaaaacttatgtcgcatctacaaatcacctaaggagaagaaatatggaatttgcttttagatggatgatgggatggtgtctcgctaagcattgtgaggctgagtttaattttcacatgaagcttcctgctcaattaacggatgcagaccgatgccacgcttgactgcttaccggcctcatctttttcttaagcatcttattagccaaaatttgaatttttaatcttaaatttggagttgattttggggtttttttcatctaaatttatttttcagcttttgcttttaaatcactaagaacacgtatataaaagttttatttacaaattatttttagtttacaaatttattgtttcgaaacgatggagccttgtagatgtatacatgtaggacccacatgattcaatgacaaatttatgtggcatggttcaaattttccatatattgtatacagaccccaaaagagctacagtacaaatgctaccgcacataattctgagagcacctatgtgttccaatctcattcaccgctgttaattatatcggctgcaatgatgatggcatcaaacgaattagaatgcagatgcctcgtggccactcagacgaagtaaatctctattacgattcactaattacttagagaagggactaaacaatgcaattagtcttgagtggcattggaaaaaaaatatatagcaccatggatttacctagatcgatcggaaggggcatcacaacaactcgataggaagggggcatcatgatgatcgatggctcctttcctgacagttagcacctagcgagttgtactcgtattattcaagtgatgcacggagattaatcgcagctcctctttccaatctgttgagagtctcggatcgatacagaaacgtgataaactgcgggcctagctaagacataattacgtggattggaaatttttcttttaccttaaaatttctatgatttttttctaatttatttattaatttccttaatattaggatgccacgtggtggcataggagcgttggtaggagtgccacttggcggcataggagcgtttgtaagaagttttatgtaattttagtatataatagattcatttttttaatttttaagtaatacttaattactcaagtgttttgatgtgcttgtcagaggagaaatgttcccaacatgcaccttcaaacacagactactgtccgattgtaacggaaagtgttatgaactgaaagaatatccgctcatcttatgtataccatctcaatagttaaaaaaaataaaaatttggtaggacatattaatacacaatatataactccacaaacatgcatgcaaattcaaatacgatttcagtaagttgtagcaaaaaaatatatatataactgtgaatatgtatacatactcgtcagaatttaatttgactttttttaattaaaacttatagaactcatatttgaacttacatatatttttaaaaattacacagtacaacgcagacactcacaatgcacgcacactcactcatatgaacgcaagcacgcaaaccctactcctatgagtattttcgaagactggaccggcaaattatggagattgacaaaatcaccacaggtgtctcgttgtcgcctaccactaaaagcacaaagccgttaaatcctgaaaaaatcgctcccatagagagtcgaactcaatcttttcaaatatttattattttttagaattatttagattccccgttaaccttcttttctcaccggagaacatagtgatgagcttgaggctttcatggcggcaaacaccgtcattaacaaaaccaaaggtccaagaccatgcgcataacgccttcacatcgtgccattacggcgcaacggcgtctaaacaaaacttaagatgattcagaatcgtattgtcatcttccagattgtctagaagcatttcatcgctactcgttatgaatctcattctccctttattgcacaaaggaagcagtatatgtactttatatcaaccatatgcctctgcaatattgcacacttacaaagccagaggcagcagcagcagcagaaatggcagtacggcacagccaacctgacgacggctcgatgcacccgcaccggcggcgacgattcactgccctctgctgatctggcaggcctgcctgagaggcaccggcgggtcggagagcttgccgccggcgatctggtcgaacacgaacttgttcgccgcctcggtgaagtgcacgccgtcccagctcacccgcttcagcgggtcgtcgcacgacttccccgccaccacccacgtcccgttcaccttcaccttcccgccgcacccgaccctgtcgtcgaagttgtacctcccgccgccgtagccgcagcacgtcagcatcgggtcatccatccctgcagccacaacacaacacatcacgccaatggcacgggggggattgcacgagctcgctaggcacaactagctaagctttaccgagcttcttggcgtcgctgatcagcttgtacttggcggagtagacgtcgacgtaggtgaacgcggcgtcggcgtgggtcttccggaggtggcccacggtttccttcagcctctggttgaagagctgggcgacctcgttgtaggcgacggagcagccggacccgtccttgacgacggcgaggtcggggcggtgcaccatggcgtaaggcaggcagccgatcggccccgtgttgtgaatccagaagtaccttcctccgagaccgtacacattctgcaggttaccaatcagctcatgtatatgggtgtgtttagttacaaagtttttttttccaaacttccaactttgcatcacattaaacctttcatacgcacataacttttcagtcacaccgtctccaatttcaaccaaattctaaactttgggccaatctaaacacaatcatatgtgtagagttccatatttcagttcgaaattttctttttggcaacttcggtcccccgataggaaactattttagaaaaatattcaaattatttcagactagaatattctgaaatttctgcaatttcaaaaaattaggatcgatcggtacccctgtttttttttctttctgcaatatagaaccctgcatgtatgtgctacactactgctgttattagcggagaagaataatttggtgttcttttgagttttgaagaaaatagtaggagtattgtacaatctctgtacctggattatgttcgtgagcctttccattagatcagggatgtaagctatgacttgttcagaggtcatgtttatgaagaagcctgtggtaatgtcattctggccgatatcgaatgtgtagagcgcctgagagaagtattcagccttgggtaggagctccctgtagattccacctatgtgaagaaatggagcgaaacagaacgtgattgttgggttcaacgtggtactgaattactgacagaaatggattttttggttttcttgtcacctttgttgttatagacgaactggcttctgttgatgaactgttcaaactcccaggactgcacgtccaaggaaatggggctgaaaccagagaggaacaaagatgtgttctgccttctgattgacgacccggccgttgcaaagttagcaccttgtgtgaagttacttcctatcgagttgaggtacgcactgaggtaaggcagtcccaggctttcagctgcagcatcagagagcaagagtgtgtgtttacacagtaagaatctgcatttgatcgttcaaatagcagtaatctcgttgcatttgatgatttccgaagagtgtgagttgaagcctgaagcttttacaaccagcaccaaagctatagcacggactgccatgcatcacaaagttaaggtacatggcgaatggttcaaataagtttcacatgcgtctctgtcagtggtgttggtgacgacaagaacccgagttcagagccatgtgcaaatggttactactccagttcatggtttctactgctgtgtactactcaactattcttgcggtcctctcccaattagccaggacaactttatgctaatgccaccactttataccagaatgcttcaactgcaatcagaatttataaagcaaaacttccacaatctgcagcgaatattgcatagcatggcatatatgataagctcatggctgttttgtctcccagtttttctggccagcgaccactaaaactttctaaaagaccccttagggccaccaaactactatcttaaggtaatgtttctttctgtctctcgtatcaaaagctaaataaaggaggagtatctgatatattccccagctgcaatgcaacatcctctctacaaaatctccccgcgaggatcgcatggctgatagcagtggcgtgaccgtatctagagatgctttgccgcgagttactggccggcctttcgtcggattgtggggaatatatcgagatcgtgtcggcgctcggcagcaacttgttgcagtaacaataataccgtgtaatcgatgccatcgttggcacggacacacgggccgctcgtcaataattatggccatggttgggttggttctttttttttagaactgttgggttgggtcttggctggttgtagccagcttgccggatatcacagcactagcaatcaatcagtacgtgaaaatggtagaccttctctttcttttgcggacatttgttctaaagcaatcgagcaacctgttcagacgttcgtttttacttttaatttgggcttaaccattgcgagacactaaaacactcgagcagcaaacgctgaaacatctcgtgtctgcaacctacacatggaacgaattaaagctgatatttattggttcagagtgggagtaggtttcagttcgatcaagtatatgcagtcaaggctcaagggccctacgtgcagtcgtgcggaagaagaggcagtgaaaagttgataatagaaagaacgagagaaggttaattagctgattaagacgtgcaggggaaagaaaaagactctggttgcagtgattcagagacgtacgtaccgatgaagtcgatgacgaggcggccgtcgcagtagcggccgacgggcatgccgaagaaggtcctgccgttgggcggcggcgcggcgccgaaggtggccgacagcccgcccgtgtcggagttggagtcgccgaagttgaacacggccgggaagcggcagtccgcgccggcggccactgagacctgcgacaccagcaccagcacggcgacggtcgccaccaccaccgcggctgcgtacggaggaggcgccattacccccccaccacgcctcgttcgcgcgcgcggggcactgcgagcgagagcgacgacgagcagagcagcgtgggcggaagacgaggcggagcttagcagcagtggcgttggcgtggcagtgggcggaaatggcgaatggagatggatggttgtggatctgcggatagagataggcgggaggcgggaccgcgcgcgtgcgggagagaacggtgggagaccccaaacgcgacgcggtgccgtggacgacagcgatgggagggggagggcgcggtgggatggccggatgggtcacactgactgacgagatggccgtggtgtggtatggtgtggtgtggtggtgcgcgggcgtgggcgcgggtcgcgagcgatggtggagtggagcacagcgcacggtgtgccggcccggtggcgcggcgcacgggacgttggatttttgttgctgtgggttcgtgggagccgcgtccatgacgccgcgctgcctcgtcgcgcgcgcccggtggtggattcgcgtcgcgtcgcgccgcaccgcacgcgaccacgagccgtaacggagatttttctttgctctacgtgacgctttggaggcggcggtggagtggcgatcggcctatgttacatacatacgcgatctaggcaaagcgtgaaccgggcgcgcgtgtacatcaatgacggtacgtgaagtagaaagcagggaagcatggcccacgtggagggaacagatgggtttgttttgctagagtggagcacatcattgggctcaaatagtagtgtgatgtatgcctgtatgagccttatctctcggtcacttggtgtctggatagtgggtggaataagttcaccagagatccctcaacttaatattgagattttttgaggtcccttaaccataaaaccagaaatatatacccctaaactcactcaaactgttcaaaggaggtcccatgacagtatcgactacccggttttgctgacatggcatcctagtcagcaaaaaataaaaaataaatatgtgggacccacatgtaagtgagaaaaaacgtggggtcaacaatcctagtcagcaatctccttctctttttcttttttctcttcttctctttcagtagcggtgcgcggtcggaggtaggcggagcggcagcagcaggcgagcggtggctccgggctcgggaggtggacgcataccgctctcaacactgatccggtcaaatccagaagcggatgcagcttccgccggtgatgccgatgtgaagccatcatcattctccggcgatttggggttcccctcaccattcaccatggtggtgatcatgctctcccttatgatagaggcgtcatcatcacatcccctatcgacgtcacatccttctgcgatcgcaccgctctccggcttgccgtcctcatctgcgtcggaattgatgcggcttgacgacggagtggaggtaatggagcgtggcggccacgtcgcgagcgacggcaaggcagcggggccactccaccacgagctccgagcagcgccaccccagcagcgcgtcctgcagcgacccattgggtatgcggtcgtacgctagcatcatccgccgcggccgcccctcgccccgcgccgcggacgacatcgagtacgtgaacggaagcagtatggagtcccgccccttcccacccggcttggcggcggcggcggggacaggaggagatcccggtgcggaggacaacgcgagaaggtgggacgcgacggcgaactcgttgtggaactcccgctccccctgcagcgaaccagcggcatcccagcaacccaatccaacgggacgcaccggttgcttcttgagcagttacccaaagaggaggacctgctcgaccgtcgtttcgtgctacgggaggcccgcctcgatggcgcttgcaaggagattgtgttcctctaatgcatcttattagccttccatgcgcacccatcctcgtcctcttccactccgcggtcacgtattgtgaggcgacgatgtgccgacgctcctagatcccatgcctcgtgtcactagtctcgttgttggtcatgctttgggtgttgcggtacaaggagatcgagatagagggtctctccaccaaattgatgggccggtggccggttccctcaccatcagcatccgcctcctcctaatctcagcctcccggtcctatcccctaccgtgaagcttatggtgttgatgcttcgctgcttgctgcctcatatcccctctctccccatgccatggtggcaatcgaggaggccatagggggagtgaggaggcccaggtgagaagctcctcgtcgccttgccgaccaccgctttcaccttcctgtcgaggagctagtaagctcgagctcatcggccactactattgatgatgtccatgttgagataaataggaaaagtagagaaagggaagagatggaagaagggatgaatgttccactgacacgtggggctattgtaatttttttatttattttggtaggagtgccacgttgatgccacattagctaaaaccggacataataatgttttgggatctcaagtgcaccagtattgtaagctgagacaaacactatatctggtataatacggttcaaggatgcaatttaaactcgacataaaaatgagggataagaagtgaatttattccgcatgtatttgtatatggaccaaaattttggcccattaaaacgtggcctcatgaggcatacgagcgacgtggatacacatggcaatctccagctttactgtggtggatcgctctcttggttagtagatttgaaatgtccagaaaaaaaaattactagtgcgaatgcgattttagagcatcggatcaaaacggctatgcgttatttgggtggacatctgcaccgcgatttccgcaacggccgcctcctccttctccgcctccaccctctactgcttcgctagtagcttctctgtctgaggatctgcaagaagctatcagcaaccgcgctggtagggagatcatgattgtgatctgcggtcttaccaagttacaagatgttgcgaaggtctagaggatgctgcatgagaagataagagaagatagatgggttggacagtagaggacacaaatatcaaagtcctcgatgatgcaacagatcgatgtctgagtcttatggttttaggtcgttcattcagttatgtgatgttccaatcgaatcaaggaaggtactggaactacatgtgtttggcaagttgcgaagagagagtaaggtgcctggactatgggaattggttggtgtagatgaggccatggccatcgcaatggagggtcagtccattctcagagaattggatctatcggatgaacaaccattggattctgacaatgattgggggggtgtctgaagaagcacctgatgattatgacagcctgagtgaggatgcacctgatgattatgacagcccgagtgaggatgcacctgatggttacgacagcctgagtgaggatgcagcgaatggttacgacagcctgagtgacgatgcacctgatggttacgacaatccgagtgaaagatgcaccttatggttacgacaacctgagtgaagaagtaatcaaggatgtgcaagttgagccggcatttgtatccaaggctttgacctcattagaagaagcggtccttatgaagagcagaatcaacaacctgaaagagcttatccagaaaatgatcaatggacccattcgttttccacaaaaaagttaggaagcaatccacatgatgaacataatggaatcaacaatatgaaagatcccattcccctctctctcgatcaatagaataaacaatatgaaagacccccctctcgatgagcagcaatatgaaatatcccctttttgataaacagaacataatcaacaatctgaaagatcccatccccactccctcttgatgaatggaatcaacaatctgaaagacccccccctcacgatgagtagcaatatgaaagatcccctccttgatgaacatgacataattaacaatctgaaagatcccccttacagaatcaacaatttaagaaaaataaaactgtaacgatttgttattttcacctttacacttcttacattttataacctttttttttgactatgagactgaccttgctcaattgcaatgatgatgcaatgatatgagatgtagtagcataaataaaagaaatgttatctaggatacaatgctctggagtggatatattgcaaggatatcttcaaaccaattgtaagaaatattgtacatgatagctcaaggggatacaatgtttgtcttgtcgaccccgattttggaaatcggagatcttctgtgtttatcagtaccaatctctggatcagaagttggtacacacatacatagttgaatcacaacacatcacgaatgctttttttttgataacaaagaggcagaagcctcagatttaccaaggaagaactgggtgaacaaccagttttacataaaagcccctaaagatgggcaaattacactggaggatacacttatgcagtgaaggacaaaataaagtttgaaaaaagccatcaggtcctgcacaacaaactgctcacaacagagatgaagaagacgatgctccaggcaacggcgggtactgagcgctcacgataggttgcagaagattgaaccatggcataaacccagttggggcctcacaaaggaggttaaagccttggtttttcacatacaaatacaaccatatcttaaatgcttatattagggccagccatgccaacaactatcagagaacaacagcggaagataaaataatacaagtgcccaattaccatgccacaagcagtcgactgggaacaagacctagaacggaattacactacgatcatcttgttaggtatgcaagcgcactgacaagggtttctcttcaagcactatgctatatatatatatatatatatatatatatatatatatatatatatatatatatatatatatagtaacattgagtacaaaagtactcagcaattcaccacacaaaatgcaacaatgtacaagataatacaaggagtggctatggttattttgcataaagctaagttcacaaatatcatttcacaaacctaaaacttagcattgactactcattcagtttcacatgggttataaggaaacacaacgtcgtcttcttgcagttaccacttgctaactgatgtgtttgacattgtgcttctatttcgacatatagatgaccttttgttgtcttctccagggtgatatatgtggtcattacattacttatcagattagttaggttcagtttaatggtaacatgtcgtgtttatgtatctctttagtactccctccgtttcgaaatataagaagttttagggttggacacagttattaagaaagtaggtagaagtgagtggtggagggttgtgattggatgagtaatggaggtaggtggaaaaaatgaatggttgagggttgtgattggttgggaagagaatgttggtagagaagttgctatattttggaacgaattctgagggctaaaagttgttatattttgggacggatggagtaatattaatctcctttttcttaatattgaaggattactagccaagtttgcgcctttgcggtgctacttaacattgatgcaacacagttgatttgatcctgttccgctagtggcagacggtagtttaaccattcggtgcgtgtgtttaattgctgaggtgtacagatgtataatataccaaaactattttttcccatctaagttttttctactttcaaatgtgtactaaagcaaacttgcatacaacattctgtgcatacgtgttaatggtaattagtactcagcacgtgtcttcaacatgttatagcaatcatgcttaattccacgtttaatttgtaattttttggagccagtttgcgcagttatgtttattctttgttcattggcatcatagaccagcgcaacgcaggtccaaagattaatgagatgcggacgtgtcagtcagtttgatcctgcaactgacaagatatgtaaacagcagatcaaaacagccgatcggctgacaagccgatggagtagttccagccagtagccaataatagccgatgtcgatactagccgatagcgatagggtttaagcaatcggctatatgtccaatgtagataacgatataaaggcaatcagctgatgatgatgcaataaaataacaatataatctagtataaaccaatcgactagcaatgatatgataaataagcatcgatccgaaggttaaagcacacatcggctggaggtccgatgtcatgaaatccacaagattagattaaacagttaaacctttgttgtcatcggcgaaatccagcttatatgtatgtgcaatccttatgagccaatacaacgtcctgataactcaccggctgaaaccccgatgaaacccttattggcaatcaagaagcaggctagagattatggttctaagaacgacttagtagatcaaacttaactgatgcagcactaagtatgaaaagaaacataatatctagacaatcaagctgttgactgatttttagggtggtagatgtctgagctaatctaatctagcaacgcgatttagtcgatatcggtagaaaccctaaaacgagaagcagccgatagagctaaattgatatgctaggactagattaatagagacatatgataaataggtaggcaaatatatcatccaaaccagagcaatccaagaggtcgaatgtactgatgcagctttgaatgacgctgatgtagatgagacaattgcctgggccgacggaacattggacttatcccttcgccggagatcgaagacgatgcagccccgcgtcgggtgccaagttccacagaaacgtaaaaaacaaaagtagaagtaaaaagggtggcgatgcgccgaattgtattgatcgtagattgatagattacaatgaccccgggtatacatatttatacctatagggagatactagtccttgtcggacaagaaagaaactaaaaaggaaaagataaagtccttatcagacactaaacatactttcctaaagataaaaggaaactaacaaactatacctaattaatagataactgtcatgtcgtatccttcttgaactcgaactcttctagataagcttcctttgattgatccgactccaccaagaacacgacatcgtggcgacttgactcccatcggctgattctagaactttgaagccgatactgactctaaaccgatggtaactttgggcttaccaaacataggtgatatatagctcgaagcattatcttttttgataaaaccgtttacacatgtgttttttttaagatattggctacttaagataatcttaaattttaccgataaagtatgtctctagggtctttgatgaaactgtttacacgcgtgtttgtttgagtgaagacattgctattcaaataatcgccagttctatcgacatcgtgcaatcaacctctggctccacgctttatagtctactccctccattctaaaaataatcacttatccaatttcgttgattctttttggataaagggagcaggactcaggtccattctaaaaagagtcacttatccaatttcgttgattctttttggatgaagggagcagtacttaggctgagttcttttgttcactttctcaactcaactctctcattttctgtacgcacgccttttaaactgttaaatggtactgtcggagaatgaactcctccaccagggaactgtgaggcccccctttgtgagttcggccgggggcagcgggtgagattcaagtgagattcgagggcttggtgagcggagctgcgtgatcttgagggggttaggcccctccaagacgatgagacaaaaaagatttatataggtttgggccgctatgaagcgtaataccctattcctgtgcatgattgattgaatatagaacaccagtgcttggggttgcgagacccaagcgccagttcgctcggaagtcccccctctccaccactaggcctagacctccttttatacctcaaggggttaccacatgggcctaacaacctaacctaactccggtggagaagtattataatttttgcattaaatgcatgtcttgtcttttgacttgggaagccaagcacacgtcgtcttgatgatagggcctgtcaaatcttgccgcctgacacggggggtgcccctgtcagtcaccatttaatgggtgaagacttctgggctcctattacactgggaaacgggagccttgctttgaccagagcgggaggatcgactccggctgggataagaggatgagaacctctcaccatcattacattatttgatgggatatgtcgggctgcacgtcgcctgacacacgcgatggtgcgcctgacatcttgggtcccatcagtcattcgaccggtcacagacctgttgagtgcactgcacaccgcattaaatgcggcgtggcgcgaccgctcgggacgccataaatgcaggtaggtgggcacctggaagcggacacctaacccaccgtacgtggtgacctagagagggggtcgggggagcccgacccctagtcacgggagggggcggccaccgcccgacctcgggcccgatcccccctcgggagggggggggagggagccacgtggcgcctggggcggccttctccctctagtctcggccagggagtggtcgccgccctacctcgggcccgacccccctcgggggagggccacgtggcattggagggcagcctcctccatccagtctctgggaaggagtggccgccgccctacctcgggcctgactcccctcgggggagggccacgtggcatcggggggcagcctcctccgactagtctttggggaaggagtggccgccaccccacctcgggcctgactcccctcgggggagggccacgtggcatcgggggcagcctcctccctctaaacctaatactcccgggcccatatcaccgacaggtacgtttttttaaaaatttttctataggacaattgtttttaaaaaacatattaattcattttaaaaaattagttaaaacttatacatcgtttgtatgccctcctctcggctcctcccaaacaaagggcccgtttggggagattaagattatgagaagcagctggttggtagccagtatttgaaaatctgaaaaagctgggcttttcaacttccgacttctaatttattttctggattctataaatacaacctctcaaaatttaaaccaaaaagctgtaccgtctcgaaagcttctaattatgaagaaactaaagcagcaagctcccaaacagacccgatcctcactcgagtcgagtctcggtggggaggcccagaagggtcaagaggtcaaacagccaccggttcgcccaaaaccacgtacctccccgtaggccccaccctccatagaccgcgaaccgcaccgagcacatcccatccgccggtctccatcgccctaccatcccagccggtgggcgtcccctcccgcttccgctccgcctagcccaaagctgcgcagcaccctgaacggcaccacaccacggaacccctcaatttccacgacgcttcctaatcctccctcctcatcaaagccgtcacctcgctcgcgtcggcggcctcgactcccctcccccaaatcggttcccctccaaaaaaaccaaaccctcaaaaccctcgcctccgctctctcgcgcacactcgtgctccctcctccccccatccatggcttcctcccccgcctccgccgcctccgaggaggaggccgtcaaggtgaggtttccgccgctggcgtcgtggggggtgtaggggatctcccggtttgggcgtttttgttggtggagttttggggggactgattcggggggtagttatttggggtgcaggcggcgaaggtgctgatggtcggcgccggaggcataggatgcgagctgctcaagacgctcgcgctctccggattccgcgatattcacatcgtaagttttttttttttttggcttgctacgtgtttgcttcatccccttactcgcggttaaatttgagctgttcctagggttttagccgtgtttcgtgaattgagctctggtatcatctaggtagatgcacgtggattgctgggtgtctccagttaggtagttgcgggatctgtgatagggattggaggatagcgttgaccccagctgacaagtgggcactgtgtagagtatgcgtgggttatccggtgtctatctggagttttttacttagtgctgatgtttcagtatttcttagtttttttgtgaatcagtagctttgtgtattgtctattgtttcaccaattagaaccatgaataaacaatccgtcaggaactttagtattctttgcaaccatgcttggcagggattgttttgtgtaggtcattcttgttagaattcgtcataaaagttagtcgatatagcggaacgacgactaaccttcctgatcacttcagtcattgatcgcccaagacacgccagatgacgacacaggaacacacgatatttgttaacgaggttcagccgaagcctacatccccgaggctctgattatgggcgctcctccccaaccaatatagctcctagccgctacgagtccatggtcacgccgccatcatctccctgcgtgtctacgctacattgtagtcgccatggttacattgtggtgcgcccctctctatttaagagagatgccgggttacagagttcgactctaactccaccccctaacacctattacaactacaagtccaactgtaaccaaatagaactagtatattcgacacctattctaacagaattgttgctaggttcttactcttagatgaactgttatgctgctgcccttgtttcgttcactgctgatatgaaagcctccattcacatgacttcttttgaggttgatgtattgcacttggaccagtttggaaatagacacggtgtattctttgttcaggtatccataactaaatgaaatggtatttgaggcacctaagtttgttatccacacaatgccgacttggctgctattgatttctgatgattttcttttttggactgacgtttgtagttatgtttacaaagaaggaaataaaaccttttctaggaccacatgtcagtatggtactgggagataaattaaatcctcgtctattattttcatttcttttcatattttatctgcttttcgtttttttcttcactgatccgtttcttgcttctgacatactagtttacattacattgtcaaagggtcattttcccttggtgttgatggagctaatgaaaaaaatatcttgatttcctctcaaagtgttgtacacaaggaatttgatctttttctctacagattgacttggacacaattgaggtgagcaatctgaacaggcagtttttatttcggcagagtcatgttggacagtcaaaagcccatgtaagttacatttctatatgttgatatgattaacatagttgtatatgagctttctattatgtatgtatttgttgtattcaccttattattgctgctgcttattctgtttttgtcattgatcttgtcaggttgctcgtgatgctgttctgaaatttaggccaaatatcaatataacatcatatcatgcaaatgtaaaggacgctcaatttaatgttgagttcttcaagcaatttaatgtagtcctgaatggccttgataatttggacgctaggcgtcatgttaatcgcctttgccttgctgctgaagttcctttggtggaaagtgggacaactgggtttttgggacaggtgagttaagaaagtaccactgctctggtccccgtaactcttctgcatgtatgaacggatatataatacactctggcttatcttcttcgtaatctgtatggttaataagatttaccagacatacggccttctagttgagtatgttttgtgcacttaccattgttcactgtgatcatgtgggtccagagggaaagtgtggttgttacttaatcaggccgttttagtgcaaattatctaatgttgatcatagaacaggttttctaccttctccacaaagttcctaaaataatatggtcatttagacattatccagccttatttacaatctaactctttatacagctcaaatcaactcctggtggtagcttggccaatatttggtgcatgttcatataagctgcacaccttttaggtagttacgtacattgcatacagacattacatacttttgaagtgcacatgaatacatgatgtatatcatttgttggcctgtgatgcatgggactctggtaggcaaagctgaagagttcttttgtgtaccttgatgtattgtgtttattatcttgtgcatgatgggttttttgtggtctagaatctagattctgggcttaacaatagtgtcatttaaatcatcttctttatttttttatcacgtatatgtcaacaactaactgaaagaagctaccagtgttcactaaattaactaatggatgaatcgacctcggtcaaattattctgtttattattatattaggccgcaggtggtagaatccctgtctcacgagcaaaacagccaagtaagctaagtctatattttcaagttaattctcttctaaaattatttccattccatattttgcaggttactgttcatgtcaaaggtaaaacagaatgttatgaatgtcaaccaaagcctgtccctaagtcataccctgtctgcacaattacaagcactccatctaaggtttccttttgtcccactttcctcctaattatatccctctactgtgaaaatattagtttggaatgcccttagtcaaagtgcaaacctataaaaatctgaccacttgtgggcatattattagaacttaccacatagggatatttttttatttgtattaataatacggtatttcgtcacatctttttgtattcttttactaatgtatagtctatacagttacaataaactgatgttttggagtatgcgaacaaacttcataaaaaacagctatcagtatctttggattttcagattgggcttacagcaacaaaatgtgcaaatctgtccaaaatgtacctctgtaacattataattttaccttattttataaatataatggagtctattagtcaaagtagttttgaaggatccccccagtgtccaaaggccacctatttgcgactggactggaggaggtaaatagactaagtagttgtcaaggtgtgcattggaaactgtgtcaatatccaaaatggcaggtcacgttgacaaattaataaagaaagaagatgctatctctcctatgctctccatatcttcagttctcccatccaaatctatggacatctcactgttaaaagtgttctaatccatacataacttgaaaatcctcaatatgcagaaggcattcttttaacaagcacacactccgctttatggcattttttgtaattaaaaatctgaacttgacttcttgtgggaatactctgtgaacttgaccatttggaacaagcactgtgctgctctgatcagtttttagtgttagaattcattactgactttttcttttcacagtttgttcactgcattgtttgggcaaaggagttgctttttgcaaaaatgtttggggataaaaaccaggacaatgatcttaatgtccgttcaaatgaaagcggcacttcgaaatcagatgtatttgaaagaaatgcagatgaagatcttgatcaatatgctaggagaatttatgatcatgtctttggttacaacatcgaagtggccttagaaaatgaggaaacttggaagaatcgaagaaggccgaatccaatatacatccgtgatacattacctgaagaagctattcggcaaaatggtagttcacgggacatcaataatgagcaggaagaaccatctgctatggtctctttgggtcttaggaacccacaagaaatttggagccttgctgataattcaagggtatttttggaggcattaaaactattttttgaaaaaagggagaaggttgtattttattcggatctaggttatgtaacctttaaagttacttccatctgagatattttgctcttctggttttcaggaaatagggaatttagtatttgacaaggatgatcagttggctgttgagtttgttactactgcagctaatatcagagcctcctcttttggaatacctctgcatagcctttttgaagctaaaggtgttgctggaaacatagttcatgctgtggcaacaacaaatgctataatagctggtttgattgttattgaagcaataaaagtcctccatggtgattacaaaaaatataggtgactaggctctttgtttgtttcatgtcattgttgtagcatgtacttcttttttttcctaaagatagtaaacttaagctaaaatacctgctctctggtcttctggatatggtaatgtccagagagttctaaggtgctgccaattttctggaatttaatggcacttcattggctaacaattttacagaatgacatattgtcttgaacacccttcaaggaagatgcttttgatgcctatcgagccatttgagcctaataaatcatgttatgtctgctcagaggtatttttgcactttcttgggctatgatattcgtatgtttgttcgctttctttcaagtctgacccaaaactgctactgaatgcatcagacccctcttcttctggaggttaacacaaagacaacaaagctgagggaggtcatcgagaagattataaaaagcaaacttgggatgaacctcccattggtaatgattggctccactcttgtttttgaggatggtgagggcttagaggaagatgaggctgcaaattatgctctaaaccttgaaaaggtactaaccttcccccttcaaagcagtgaaattatatcctccatggaatttctttctttctaagctatggcccttgcagttgcaacattgttaaaatactattcattttttgccaactgagctttgtctggttattacaggtcttggctgaacttccagctccagttgttaatgacacaaagcttactgttgaggattttcagcaggaattgtcatgcagcattaacattaaacacaggtaacctatgaaccatgtatgctgatctgtttgcatatgggaggtctttctaaatgatacttatctatatgtttttcacatatatttcaatgaagagaaatcctttgccgtccaactatcttctcaaaaggttgggatcttgccagatgtaaactaaaaacagacaattttgcacaagtgaaaatgagctgctactaatttgctatacatggaccagtggtttttcacctttttcactaaagttatcatttgcagagtattatgatgtcacaacttttagtttcataaaatgtcctctacgtataactttgttctaacatgtaaggttgtttggctcattccattacatggatatacagtagcttataatgctgtgctatgtagatttggaagctatatgttatgatagtgtcgtagtgtacacatacagttgcctactctttcaagggggtagactgatttttcagtgattattacagggacgagtttgatgaagaaaaagagcctgatggaatggttctatctggatggtctgctccagtggagaagcaagttacgagtaatgggggaaaccagtcggttgcttcttcatctggtgcagattatgctgacggtattgttgaggacatatccactaaacctggaatgaagcgcaagctggatgaggttttagagttgaaggagaattgcgatgcatccagtagtgctcaagttgtcgaagatgacgatgacgacgatcttgttatgcttgatgagaacccaaagttagccaagaaaaagagattgcaatagcaacccctacggtatctgttccagggataacagcggttgacttccgctattatggctaacacattgttccaacgtaacatcttttgtaacttaatgatgtttagggctgataacactgaggtatcagtaagcgtactcagggtcatttttttgctttagatacggtactttaggaatgtaatttgtagcgtttaggcacaggagtgactaatgccctgctgacagtcagctgtaaggctgcacctgtgtttgtctagactggagcaatggtgatgttcttgtctactttctcgtttctgctatgcggtgatatatcttctgattgttttcatggttccgttgccctgatacgaggaatatattggtggatttagacttctatatagtgctcaaagcctcaaacgtcacaagaaagcagttcccacctgtgctacgtgttataagcaacagcaattttctcctgctgagttttctcccgttaagagatgcatatcgttcattaggtcttgagagatgcagatccggcccagttcttttccgcttaatgcatcaattgactctggtgtaagaactttatatataaataaatactgttacctcttcatcccttgtctatcactaacatccatatgattttagatgcatatgggttcaggtaaaaatctatttaaaatccaaaatatcttataatgtgaaaaacatcttataatgcggaatagaggggtataatagttaatccatgtattacactcgaataggtacatctcctcagccatccatcatagaacacaattaaagttgattagtaggataagcatctatattaggttcaagtagaggttgatcctaagatgaattcctttcagatgaaatgtggatgaaatctgagtgatgatctccttatatttgtaaggtaaaattaaatatcactcctatgttatgagtggtagtaatgttgatggataaagtttatttttcagaaattgtatttttggaagtgttgtgcaaaggcaactgatccacagataagctgaaagtagacctatggagtacttgagacaaacgaagatgaaatcacaaacacaagggaacacagtagggctcaattttttaataggaattgatcaaacctgagtataaggaaactagaattattttcaactagaaatcgaccaaacctgagtataaggaaactaaaaccgaattgcgataaaaaacagatatatcaaaaattgaattgaatctctacgaagtatactagtattccaacatctctcgttttctatcttccattcagcaatgcgatcatcatatcacagttgaattgaatcaatattccaagaacactaccccatccacaagaggaaacctacaactctgacgccgcaattccccaattcagggcaaaacactcgtctcacgaattcgaaacaacaaatcaatcaatcaatcaacaaaaaaatcaatgcaggaaaatccgcgctagtttccggccaccggccgtcctcgcgaggccgtcgacgagcgcggcgcccctcaaatggcagacgagggcgcagaaggcgatcccgagcagcagcgccgcgagccgccggagcccgccgcctcgcctcctcctccctcctcctctcctccacaccgccgcccacacgccgagcgcctcgccgaggcccgacgcgttccagtagtcggcgaggacggccagcttgtcgccgagcgccagggagagcgccagcgccgcgagctcttccgccggtgttgccctcctcctcccccttccccccatcccgaaccatcccccaccgccgccgccgccgccgaggaagaggacggtgagggggcgcggccgcgggaggaggcggcggagggaggacgagacgaggcggcgcagcggcggcggcgggaacgcgacgggcttgggcttgggcttcgatcggcggccgcggccgcgctgggcggcggcgcgcggggtgaagctaacggccgtggaggcggcgagggggaggtgcggcggcggcgtcggcgtcggcggcagcatcatgtcgttgcgtgcgaattgggtggagcggatcgagcgggagggggaggaggaaggcgttcgcgtgctcctctcccccgaccaatttggatttggaggacacgaattgcgaaatcgacgtgtccactgctgctactgtcgcgctctcctatgggtgaaggttcattctctgctcagaaattcatggctcgctttttaaactgctaaacggtaagttatgtgagaaaattttatataaagaagtttctctaaaatattagataaagggtgtagctatatttatggcgctatattttttatcaaaaaatagtcggcatgtatttacattgtaagtccctaaattacatatgtaattttagtgtatttacaatgtaagtctcaaaattacatatgtaagtactaaaattacatatgtaaattcgaaaattacatactaattacaattagtatgtaaatttgtaaatgaggtgtaactactgtgtaagtggctgaaaaaaaatcgactgtagcatatggcgccatatttctagcaactccgtagataaatatattttcaagtttgtaataattaaaactcaattcatcatacgttattaacaactcgttttgcgtaaaacatttaatcttcatcttcatctacattagtttcaaacaccagcattgtatgaaattctacaatcttgcttgaagtacaaaatcaaataatcatgaaattgattggaatttggaagagtgtatctctttgcactttgaaagcacaagtttataaccaatgccctatggtgcattagatggcaaatgcgcgatgttcaggtaatagaggttgagtccctaaaaaaagttgtatcaagttacatggtttgtttgactgtctattttggtttacaagcagcaacgaataaccaatcaaaactcggggcaagaaaacagctttctttggtttacttttccttactgaaaatgctattacaacaaatgactgaatgaacgtaagcaattgagcatcactcatatcatgtctgctcagtcgattgagggggtccgacatgctctttggcctttatgcatcgcgcatctctttctccctgcaattggctgattcttacaaggagaaccatccgaagctcgagcaccacagattgatggccatcctgagcttccggaaaacggtacagaggaagcatcggtgacctttattccttcatgcgcatcgcatctttctcttcctgccattggtattgtttcacggcatctgttgtccgtcaacgcttcacagatagctgcgacattgcctgtcactcttttctgacgtccctggcctttggatgacagtgtgctggtaggattctgcaatttgatcagctcaaaccacattcttccggaaggctgattctcttgggactgatatttaccatgagaaatctcctccccactgagcttgtcaactgtcatgcttttgaccttttcttcattctggagcaaatcaatgactcgagatgaaacaaactcttctgctttgcaaccattatgcagctgacattttttacttcctgaaattactttgttggtgcaggcagagttgtcactctttttggcttcacagatatcaatgacctcagaggtttcctgttttccatcttctataggagcttctccagtttttatttctttcgcttcaaagctataccatggtcttgatgattttttcactgttgctggcaaaaatttggagaggagttcactggtttgctgtgcttgatctgactcgctttcattttcagttagtggagatatggattcaacaactggaatctcaacttggcaagaatagctacaagaggagcctttaggattgactgtgattcttcctagtcttctacctttgtgtaattcacacctcttccttccttgtactggatggtcaagacaagaggagccatcttccagcatcactccacaaacatcgttagaatcttgttctggcatagttcttcgttttataacattgactcttttgactttgtatccttcagaacttcgacgtgcttgtttgccataactgttaccttcagatgtatttttccagcgaatgccaatttccttgtcaacattgtcaccagagttaactagctgaggtctgaagccaacaaatgttcgaattcttgggagcatatttttcataatgccagatgagacatcaacagacccatttctgcttatctttatacctgctttctctctgaacacttcctgtttgaagtgccgtactctgctaagcagagatgatctattgttgactgccccttgttctaacttgataagtatttcttcacggcgaagaccaccgttctgaagcttgttccatgcgtaatcaaacactctaagcagccgagcctcagtcttctcagcttcttgtttgttacccatctgtttatttgcacattaaagacacattagaaaagaaaaacgaaatccagtgctaattgctaaaagtggaattatgccataagattcataacttttttagggcacataatattcatagttgaccccgttgcttttgcaaaagctactaaagatatagtacttatacactccatccatcatagatactctgatagaccaaagatcttaactagttattaaaagtgataagatgaatctgagtgtccaaacatttgtcatgagcaaagcgtaacaaatcggatagctgttcgtgtagactacatgatagacaatgctggtgctgaagacaaaatgcatttttcagttcttcaaacttcagacttgggcatggtataatctcaaaatttgtggcaattgaccatcaacttctatttatttcactcaacaatttattcggacacgaagccattattgatctccacatgaacggtacagttcaactgttcaaggatccatttcttatctgaagaaacaaaaaacgagcatggaaagcagttttgcacttaccagagcacatcggaacaccaaggagtagcctctgacgaaaacttccctgaacaacccattccccgtcgcccgcgtattcgtctccgcttcgccggcggacggcggtgggttcccggcgtccaagtgcgatcccgtccggccgtactgctggagcctcgccctgacgctgtcggcctgcccgaggtacacgacgacgacgccaccaccaccggatccattccaccgccgagccgccctgataccctcgtcggaggccctcgcgacgcccagctcgtagaggccagggaagttctccggcaggttgagcaccctgtacctctggatcccttccttgccggcggcgtggtcctcccagtccgacggcccgacaagaacctgcaaccaggttggggaattcgatcgaggagcaaaaatcagatccaaatcaattcaagaactggcaacgaaatcggaggcggtagatggcaacccggggagttcaactcgactccaccggatcagatctcgtcagctctgcgccggtggcgggttggcaaggggcacctaaccttccatggggagaagagggagtcgtgcttggtgcgtgggtagtcctcccgcttcagcctcgctgggacggcggcggaggccgcaggcatcgtcgatccggtccgcctgtggctgcggagtggtgcgctctcagtctcagcgccgccggagccgccggcgccgctgcggccgcatcggcgccgggagcgggggctcgtcgctttttgaaaatctcgggttctcttttgggctgggtttgggccgtgagcccgcggctcgatccgacccgggcctgggcgctgtttggttggggttggggaaacagcttttgccgtgtgcgctcggccgttggattgacgatccgatggtctggatgagggtttacctaaccgtatggttattgtgattatcacatgtggtaacttttcagttttggaaaccacgatatacctcgtgataaccgcgcggtaatcgccaaactgcggggtgacggtaaccccacctcaaacggtttggtaaatcctagtccagatcaagagtggtggaaaaacaaagggggtttcatttgtcaggtactctaactgtccaagccattcgagctatagtgtgactgtgtacaactcgtgcggtaataattgtggtagattttcactatatattattagagaaaaatatgtagtgaaaacttaaaacttttgtaggatgtaaaaatatatgtatgagatttgtctacgtcgatatgaataaaagttttactcataatgacataaataatccgagacatttatttttctatgctatgatagtttttagtttttttccactataatgtggttttcattacatattttcctcgcaggggaattaaagggggcacattctcttcttttgcctcagattgagggagaaacatgttgagaaaaaattggtgacatgaattccccatgtccctcatatagcactttgaagtttgaaatgatagtttgtctctccctccccattttgcatggaagacatgcatgatgtagcatgttttctgtaaccagcgacggacatgaatttcctagttccgaacttacacatatatatatatagcttgtttggttcgtggccaatctcaatcaattaaaaaaattgtttatttctactagtagaatctgggtgagtggacgatttacattttatttactcttcgatattatcttccactatgatttaacgtcaatcattgatggtgatgtacgcgaaattcgatcggcacaataatcggtcgctgatttaagatattttaatttgtttccttggtgttttcaggagaagacaataactgttttgcaacccgttgaggcaacaatggttatgcatattttgtcaaacatatatggatatttaacaatatgtgctatctatgcctttaagttggtgttctaaatagttttcttgttgtctatgctttcaagttacgattttgtaattcgcagttgttcgacctgcaaggttgtaacatctgtaataattgttgtagcttttgtgaaataaagatagaaatgaatattgttgtttaaaaataatatagccatgatggggaggcctggcgatgagtctaggcaatcaatgtgttcaggtcttaggtccaagccatgtccacaacaggattttctctctttaccttgggtcctatagagacttttattgctttacttgaattggtaagcatcttcagcaatagctcctattttagagtccctaaaggttaaatgggggctgccctcatttcctcaggactctaagaatggttctaactccagcaacaacgtctatttcttagcccctatttctttttctcctctatttcatcttataatccatattttatgtttagtttaatattacaataatgtaaatattaatatttccaacgcatagaatttaatcaaatttaaattaataatttcaaacaacacaattcaattgaaatttgaatttttttttctaatatcacactgatatgtgcatatacgtacactagtgtgagtgcatggatgactcactagaatgctcgattagtgcatctgttgcggctagtagcagtagcagttcatccatcctacactcagtatccaatgatatacatgcatatatggatgcatataatcatatatgagctggacaatattaataagatatattatatccagtgcatacacaaaactgcatgcatatatgcaaggagatatagtagtagctccttctagatcagcatcaaatctcagttggccactggcggcagatggctgttcacacttaacaggaaccaaaccacgtctcatcgatatgtggaaaaatccatgcatacgtgcatccatgcaggtgaccaatactatagcagggcgatggccggattagagcagaaacacccgcaacaagacagtcggcagcgtgcaagcaatcgcacgggaaggagcacgcgtcgtggaagcattcccccgcgccaaagaaaactggataggggctggggatagagcccccaggcctaggggctgtaggagggaatttgggagccttcctactttagggccttaagtaggggccctgttgtactttatttttttagtctcaacctctcaaagttgtttaaggactgtatttaggggttttactgaagatgttctaagcattcgtggaaattgtactgcgaggaattttttttggttcattcctattcttaaccttgccattttttttttggcaacggtaagagttggtcattgcttttttttttggcaaaaaatagttagcctttcgcttagtttgctaccaaagtaagcaattagttgagcagtgtcaattttctttggctacaaaccaaataaatgactaatatttttgcactgtcaaatttactttagctagattgaatttggctacaaacttaaacagacccgagaactcaaactttcaaggaatttttgcactgcatgatgtatcaattttcccgtcattcgatttttatatacaacctaattctaaagcacaatataaaatctacagctgtacaatcgctgataccatgcaaaccgtgtcacatcagcatttcgtcaaccaggcagcaacagcaaagcgccatgaagctgcatgatcacgtaagaaaaatgtcatgaggataaaaattctacacgaaattcatagccccaagaaaacgaatttctagcatcttacaatcctgcgatgaatccacatttgggctgaggatgctccggcggcgcgggctcgtcgtacgccgccgacggcggcgccattggccctaaaaaattgcaaaccacaaaattaaggcgatcgattgaacgaaattttgccaaagcacacgctaattaatcagccaaatggcattcaaaaaaaagaaggcattcaaaaaaaaattaatcagccaaatcctctttttgccaaaggcggaatgcaatttaatagacgtttgccgaaacagcatatatctgagatttgtagaattactaattaattacctggtgctccatcgtgatgcaagctgctcgcccggtgctgcatatcgccgtttgctttgcgacgaagcgacggatcaaacgaaacgagagagagagagagagaacacaaacacaacacaacagagatgctttctttctgaacgaagagagaatctatttgttcagagcaaggaggcccaagaaaaggttaatcatgctgtgtgctgttgcgatgaacaggccacgcaggagagaacacagctggtttaaggttaggaagcctgcacaacgacaacgtagaggcaggcaggcagggtatccatctcttttcccccccggccgttaatgttagtattattgtgagccattgtttgcccgtctccagctgtatctctctctctctctctctctctctctcaggctcagctttttcttcctttctttctttctttcacctgttggatctaatcttggctttgcgagacaggaggtggtgaagtggcagttcgctttgccttgcgacgtacaggcaggaagcatacaatgcatgcacaaccccaacatagttgggtgcctttgctgtcagtggtgtggtggtggtggcatgcgttgcgtttttcaccgtcaattgtgcgtccccgtgtgcgtccttgcagttgccggtacggatacagccgggttagggcatgttgtcgtacagcagtgttacagtacaatcatgtaatataatctcgaactgcggaattgaatttttgtctctcgagggacactcgttttgtgcatgtcattgaaaaagtcatcaaaaattttaaaaatatttatcaagatagatcaatatatataatatattttcaaaaacatgcaagttaaaattcgactaatacaattcgaaataaaatataataaacttgacaatgaattacgtattctattcataattaaatttgttattgtttttctacctgttaaatttgaatattcatgctttgtgaagtaagatattacttttttttaaaaaaaagtttgatactttttaagtgacatgtaaaaacgacgagacatcctatttaagggatgaatagagttttcccttgtactcaacaattaggtgtgattatattttatcattgtattctcttacaacctacgacttcctctttttcaaagaaaaaacaatcttccaattacagtactggacatatgctatatctaaaattcgtacctagaagttttttttttcatctcttgtttggacaccagctgcctgcaatcacctcattcgaccaatcgaccactgtcatcttgttgtcatcgtgttatgatcgccataatgttctcaagcttgttggtcgaccactccagctgttgtattcacacttagacttcgtgggtccctagatcctacgctgctcactttgctggtggccaaaacgattgttgccagcctcagactatggaaatgcaattgttgtcctccatgatcacctgatttggcatcattgtgtcaccaatcgttagatttggcgcctccaacctttgggcggatttggaatgatcgagcttgttgatgaccgtatacagtactccctccgtttttaaaaatataacactgttaatatatattaaaaatatatatattaacggttttattgttactttgatttatcgttaaatgttatttaagtatgacttattattttatatttgcaaaaatatatataacacagtaatccctccgttgatcattcatcttactttaaaaaaattatgtaattatcatttattttattgttactttctttaagtatgacttatttttttatatttacaaaaatattagaataagagaaataatcaaatatttgttttaaaaaaatcaacgttatcacgcactaaaaatggaggtagtatctctgaccttgccagcagtactcgattagtcctgtttggagccatagtgctagctagcgaggcccttatctaggtctactctatctaccagcaagggccttggggagcgaggctacaccatcgcctttgtccgcataatattctcggccaaaacacaagtcaaccacaaagagacctcttttatatctctcccccatcttatatttttgctaagttatgagctatttttattccgtaaaaaccaagctagtacgggatgtacttggttttctatgagatggagaaaatatgtgttaaatatgcacttagcccattaacccaatctctcataactaatggttcaatatgcatctattttgtagtcaaaattacacatctatacaccgtactagtaaaaaaatgaactagagtgggtttgcaagttaacctacatgctctacttggttcatgctcctttattaaatcataagaatttcatggaaatttcataggatttagttcaactcgtctaaaattcctttaaatttcctccatttcaaaggttttagttcaacacatctatacaccgtactagcatacacgacttaattaactgagaaagatgattctcaaaccgttcatgcatgcgtagagatctattgaacatttgaactagttaacatgcatggaactgggcaaagtcaacaggccatgacaaaaagaacagtagtagctagataattcacaattagcaaaagcgtttttaacatttacagagcaagcaagcatgcagggcagcctaaaccgtgcatcctcgtgtgccagatgctttttattgttctcctcgaattgaattcctccatggggatgatcagatgatggatagctaggtacacgtatcattcgtcgtcgtcttcgtggtcgatctctctcacaacctcctgctgctctcgagcctcgtgtagccgaggatgcagttggcgtaggccacgttcttgagcgccttgccgtgccaccggccgacggcggcgacgccggtgcgcaccgccttgagcaggcagtcggccgtcttgacgacgctcctgacgcccatgggcagcgacaggtagggcgcgttgaagaggtggaactcgagcgacgccgcggcggcgtggtggtggtggcgcggcgacggcggcgaggaggaggaggcgagcatcctggcgacctggcgggcgaagccggcgccgagggagtggccgcagaggcagacgttctccgacccgaacctctcgatggtcgccctgagcgcctggagcgcgccggcgagccgcgccgagccgcggaggctgttgcgcgccagcaggcggagctcgtcctcgacgtcgcgccggatggtcggcccccgcagcagcgtgccgcggaacgcgatcaccgcccgcggcgcctcgccgtcgaccgcggccgccggctggtggtcccgctcgaagatggcgccgaacacggagccgtccctctcgtcgaccagctcgtgcgccagcctgtacctgaacggcttccaccactgctgcgccaccgccgccgcgtccctcctctcctgcctctccagctccagcaggtacaccgcctctatcaagcacgccatcaccatcctcctgtagtcgtcgtccctccacaccgacacgttcacctgcgccgccgccgccattgccatcgcaagctaagctaagctcagctcagctctcacactactcactcgatgacgccctcgatgtcgtagggaaggcgaggcaggggtggcgggaaatatatacgcggagtccggaaggcaagctggatggatcgatcaagccgaattcatttcgctttttactaattaatggcgggaataaagccaccgaatcgggagctaagctaccgacggatcggccgatcttttcacggttcctgcgacttgactggatcgacggatcacaacgatccgaccgatggatggcaacgtgcagcccgtgggtcgtaagctcactctctcacaagttcacaatagtcgcctccagctagccgtctggtttgatggatcgatcggatggtgtacgtcgttcgcgagctttatttaggggagggagcatatattcgccacggctaagcactggaccatggcttatagttcgttcgttcgtctcggtgtagtttaattgccctaaattaacatggctaaggatcgaatctgacagcctcagggtacgtgtgggtgacaggtggggcacgcgtttgcgccttggggattgtgcggggacaggtaggaggagtggggttgcttttgtcaggaggaagggtggttggttggttcgtcgtcctccggttgattagtgccgaagattgggtcgtttactttttctttgttagagcaagtttaatagtatagcctactgctagctttaatttatctatagctaatttaatagcatattcatataatagttgcttactatactattaacatatatagtccatctgtcatatacacattgcgtcttgaagtccgtgctgcagctggctacagattcgtagtctgctgcttttctctcttatcttttatcttattaaaatatgtttatagttagctaatagctcgttattgtacctgctcttatgtttccgttttcttttgggttttgggtggtttcggcgagaggatgggagagaaaaaaattagtgattaggaggtgatttgtggcacgtttaacactaaaccgaggggaatttgttccatctgatgacgttgggggaaggggggttaattcggtcgcgctccgcgtgtgttgattcgttcacacgctggcttgtgggcggtttcttctcgttcgtaatggttagacgcgggagtcaagctgcttatacgggcttggttttcttgttttcttaagaaaaaggggggccttggttttctttggaaaaagttacggggaatatgcatatttcgttcacacgcaagtgcgtggaaacatgacattggctacttcagtccttttccatcacatcaacatgtcatacacacaaattttcagtcacatcatctccaatttcaatcaaaatctaaactttgcgctgaactaaacacatccattgttctaagagaaggagagcgtttgataaatcacatagcaccttcatcaaaaaatagtttcagatttttttttcacatttgaatgtgaacatgctaatcatgtgactgaggctgcgttaacttttaattcttggatgttcaccgacaatttatcctattttaatcttgataaaaatctttatttatctttggatggtggcctcttccgttatttccccctactatttcaaagacgtgtgtacagggtttacatttcaatgaaatattaatgcgaatatggtatcgcaatatgccaataacaaataaggactcatcggttttattttccaaataagttaatacttattatacatagaacatgagaatacacaaatctactttaaaccctagtgtaatgcagagcaagaccatctcaagcccgcatggctacttaactacgagctttaggttagacttacaattttacaatatactatatatgttttaaaatatatggcattgttgaattttagacatgatgtttgactattcaccttattgaaaaaaactatgtaagtatttaccatgacttattttattattaaagctaggtactttacgggaatgctactgggcgagcgatccgctcgctcgcccagggcgatcagttttgcacacccccctccctccctccacatctccaccttgtttccttttttggcaccgcattacttttctattttagtaaatttatacacctaaagtttacacatctaaagtttagagacaaaaaatttataagtcaaaagtttatatatccgattcaaatttgaatttgaattcaaatatatatatatatatatatatagtatttctatacatctaaagtttatacacctaaagtttatagacctaaagtttataagacagtttatatacccgtttcaaatttgaatttaaattcaaatatccgattcaaatttgaatttgaattcaaatatttttcatatatagtatttctatacatctaaagtttatagacctaaagtttatatacccgattcaaatttgaatttgaattatatctgattcaaatttgaatttgaattcaaatattttctatatatagtatttctatacatctaaagtttatacacctaaaatttatagacccaaagtttataagtcaaaagtttacatacctgattcaaatttgtatttgaattcaaattttttatatatagtatttctatacataattttttctaacttttgtttttcaaaaaaatttgtgtggtctactgtagtagaaagagaaggggaggaggaataggggagaggagggaggagtatagggggaggggggccggatccgattgcctgggcgatcgcctggcgatcgatcgcccattaaggccccccggtactttatatataacttataatcaaaccttgtatccaaaagtcactactttacagacaaatagtactatttcataccgggcatagaaaaaccaccattttgtgtttctttatgaagtttttactatctagtctacttaattagcagagcacaggttattttttgtttgtacctgttcagctgctgtcttacggctgtggcacaaccggcaccaatagtgcacacgcatacggcatggccacagccacaaccagcttgccgaacgggacctttgtttgggcttggactggtcctgaatgctcaaaagggcccgagccgcccggttgacccagctattgttgcttacataaacaggccgggttcgggctgctgaagcttgcagagccaagctgggttgagtggttgaggcgttgagccacacactacatgatgttgaactgggccacgtctcacgttagatgacacgaactaattaacaacactagcaggaatctagtaattaatcaaggcaattttatttcctggagcgtgtgtttcatatatatatttccaatgagctccatgttgtttttacatcagaattgttataaccactgctccttaaatattatattacttcacattattagcaccttttgtatccatcaaacagatcggcatattaatcctgaaacccactgggaatgagaatcttgttgggctttggttctagcctacggtcgatctgcagcccttaggtgctatataaacataaagtactaatctataactcattatttttgcattgccagcttgtgatcaccagacggtacactgggcattaaaaactgaaagcatgatcacgaatcatataagtgtgatttggacccatgaaacttcaatagaatacattatcaatcttatgcttatctcttgctagactctgtgtgttcacttcctccttagagtgtcagtggagtggtcctttgtagttggcatcggtttttttttctttcaagaaagatgaaccaaaagttattatgccttcgtacgcaagtggtaaggaagaatctgcctgaaacaaaatctgaaattgttggattggatgtttgggatatcagatttcccctaatgagagggcactgttgtgacattggtgtcaaggtctcaaagttgtctagctactcttgtctatgaaatgcgtattcgatcgatcagcatgatgatgttgatgagatgttcggctaagaagaaaacgagtagaaatgcagtagcatttagggatggtagaaagtaatctctggtagtataggtgtgctagtgcaacaagcttggactaatcaggagcaagtataagtctaggtagctttctaatgctgtaaagataagattaaactaaattaaagtgaaacaaagtgagatgaatgtaaagtggtaacagtactttgatcttcaggtgcaaccgtccaaggagaatatttatcttggcgaggaatatgtctggagaatattgacgatgactgatcgatccaagctgcaatggcttatctgaaactcatccaaaaatggagactcgactactaactcataaaccctgatccgacgaggagtttcgcgtgccttcgaagcagtgtgttttcttgtgctggaaagataagtttaattttttttatgacaatgaagataagattaagttaaagtgatatcaatgtaaagtattaaagttgtaatgcttcctgtttatccccaggtgcatgcaactatataaaaggagaatatttgttttcgtgaggaatatgtgtggagaatattggtgatgcctgatcgagtttgagatggcttatccgcagaacaatggagttcagactcatgcaacactctgttatgccagaagtttgtacgcctcttagagcaagtaaaatgtgttagatgttggatgggtcagaattaggccttctccggtacaccaataccatccaactcaactaagtatgtgaactatgaaatataagtccacttgctatccctcaactttgcgtcgagtttgtttgacatcaatctccaataccagaaaccttcaaccctaaactatataaaaccgtgtaatttgggtcccatagtagtatggatgtctcgtttcgctgacgtgggatcctagtcagcaaaaagaaaataaaaaatatgtgaggcccacatataagtgagaggaaaaatatatgtggggtttacatgctctccttttccccctgctacttgcttgcttcccagacggcgtggtgtggcctcggacgagtcgatggtggccttgtggacgctgtcgcacgggaggcgggggatcacggaacctaaacctgtgcttgtccatgtctttgcagatatggaaaattttgcgtgcctccaatcactgtcggcgtcaccatccccaccccccaaccccccctcctccgatgtgcatggtggatggcaccgccacagagatgcctctcctcctttcccaaccacgacgcgagcaagtgcacggcgtgtggccgtggcgtgggccccacatatatttttttcttttcactaacatgtgggcaccacatattttattattttctttttgctggctacgatgtcactttagcaaactcagacatccatatttctattggatccaaattacacggtttttgtatagttttagggtgaagatttatgatattggagaaaagaaatgttaaacaaactcgacggaaagttgaggtggggggggggggggggctcaagtggacttattcctaggggaccagtgcagttatgtatttgaggccttgttctaaatgtttattgggccaacattattcgcatattatttatgccaagctttcaaaagtatgatttctcaaaaaaaaaaaaacatcaatattgtttagtccatccattctaagctatttacaaggttgatgatagtactacttcctataaacaagttgatcatctattagccttcatccacattattagaaagaacgggtctccaattggaaagaatgaagttcacacattttttttaagaaactgtgcatggataaattattgtttttttttgaaaaccgaagtcagcaaagctggtgttattttaagtaggggagaaaaaagtatttacaagattaccaaaacggtgaaagagaaagagagaggaaacaagaagctactaaacaatgaatacatcctaggccaataatctcacaatatttgtagctccacatatcttccatagcttgatttcatcatgtatcttgtctagaagctgcggcagggatttttcctgatttcggaatactcgtctgttccgctcacaccattttcccatgctactagcatgtaaactttttttttctttggctatgtctttttcaccttgagatgcccttctgatccaccattccaacagcggctcatctatatcacgtctggtcaatttcgttacagttcagtctacttaggattctctcccaaatcatttttcataagaatccgaaacattctggagttctttctgaataaaaggaaattccagtcttccaaacttggtgagccggtgagcaatgttgtcaccttagggagtatttagtttacgttaaaattgaaagtttggttgaaattggaatgatgtgacagaaaaattggaaatttatatgtgtatgaaagttttgatgtgatggaaaaattggaagtttgaagaaaaaatttgcaactaaacacggccttatatgaactagtgcctgcagaaacttcaatacaggggatgtgttcaccaaatcaataccaactcaatgcatatggtacgtccgtacatgaatgtactagactcctgcaggtggcattgcaataaatcaaagcaaacgaatctctttaattaatatgccaccaatactttcctttctgttctttaatttgcttctgttggtgttggatgggccaccaatccaccatacatgtgatatctggcaccctaaaaaagatgaagagaagttgtaaagacgtacgagagatggatttgagatcagttgctgctaaatcaagcaaggctggttagttataaattatgcaggcattgcactgttatcatgcaaaaagtcccctgttcaaattaggcaaatattttggagatgccatttcgaccatgtaaagtatgtgatcagattacacatatggttggataaatagttcactaatgttcaatttttatacccacgaatattacgtatatggtgtgttttcaatagaaatttagtgaggttgacctccatctcattgagaccgtgttaggaaacacatttgcaggtgtgtgtggtgcgcatgtgcgtcttccttccataaaaatcgttaagaaaattctgacttatcataagctagcactggtcagccatcatatgatcccatttcaggtttccccctcccctgagaaaacacaaatcacaccttttgagtttttgaccagtgaccaatccatcattccaaatttctccagctaagctatgacgcattgtccccaattaatacacacactgttggccgcctgacaaccgaaaatggccaacaacaatttgctaccaacagtggcaacagaataatttgggcatatgcattcagcgttcatgcaggaacaggggcgtgaggtgacacgaaagaaagctcagctagcaaagcaaccaattgcatggcaatgctcgctgtctgcagatgagccgcatcatgggaggcatggccagggccaggccgggaatagtgttgttttcagctagctgcagctttgagctggctatcactaaccacagctcgagagtgtggctgcactgcaccaggatttacaaaaccaaccgatttttgtaaaaccgctatgtcttggtttatagaaacatatcggttttagctggttttcatatgacattgaaagaaagtcttcggtttttgttggtttttgataaaccggtgaggatcggtttttatttctaaaacgaaaaggcaaaaccctgcactgctctatggggggctagcttgacgcatcatggcccattacaccaccaccttgttgtagatcttggaccatggcacaagggaagaagctgggggaggaggaaatgtaggggatcatgtcccattttgcaaggacagatgggggatcatggatatcttttttccaggtctagactattttgattggacagtaaattctgcctttttctgtttggagaagatgaaataatgagttgactaatgcatcacgaagcaccgtcattggaatatctaccaacaaaaagtttgtcacaagtagtttgcagctgataaggaatagtaatactttaataattcatacaaatgaaaaaaaacatgttagaaattcttataaaaacatggatctcttagctgtaaaggctttgatttggtgggtactctgtacatcagcagttaaaatgaaaatgagaatgagttcttttttagcatagcaccgaagatgactgagattgtcaagccccacttgtaatgaaaagagtaaattgcactcacggtacatcaactttgtaagtgggtgcaatttagtgcaagaacttgagaaatgagcgatctagtgcaataacttgacatgtaggtgcaatttagtataaaaactttataagtgatcacataaatacaacaactagcataaggtaatatccgtaggattactatgtaatggcataatgatatcgtgcgaccaggaaaaaaggtattactttactgaactgaccccgggcgtgttaatatcagttgaaacacgctttggtccctcatccgtgaatcaatccctagcgggtcttgtctcgcgtgattcagtttgagcaacagatcctgacgtaatacatcttcgaaaaaaaattcacctaccatacttagccaagttgatgcaccaaaatactaaattatcaagttcctgtactagaacgcaccaatttatcaagttgttgcacttgactgttcaattctcaagttattgcactatatcgcatccacctatcaagttgttgtaccttgggtgtaatttactctaatgaaaatatagtaaaatatggatattttggaggctataaatcctataagaaattttggcaagggacgatagatatatacctctaaagtctgaaaaaaaaacagtcgactgtaagagcaagtttaatagtatagcccactaatagctccaattcatctatagctaatttaatagctaattcatataatagttgcttactatactattaatatatggtcccacctgtcatacacacattgtgtcttggagtccgcgctgcagctggctacagatatgtagtacgctgcttttctctctcatcttttatcttattaaaatatgtttacagctggctgatagcctgctattgtacctgctctaacacccaactcgtttggagtccgtagtggttcttgtgttggtccacgtggcccagttacggtgtaatggtggtggtttaatatcaccttgaaagtttaagtagtttagggttcctaccaatttttcaaaaacataaacacaccattgttccaagcaaggatgacctcggaacaaaagattattgggttacacaaactgtatcgaaattcttatgaaaatgggctggcgctttggagaagttttaattgagttcatgttttttcataccatggcgagtaaactaccccaaaattccttagaaaaaaaattgtgttgatgagttgtttggtttgttgcctatgttaaccataccaaaggaaacaaaaatggcaatatcaatccccatctagttgttggcctatcagttgtgaccaaaattaaaattttgaaagacaattttagagttaattttgggtttttttattgtggtctagattatcaatccttgacttttacaatgctaatagcatagatataaaagtttattcgtaaattatttttagtttgcttcgtttattttttttcacggcttatcagcttcagctcaaattaatgtccaaagtgtaaatttatcattaccaagaatcatggtcatctttacgacggtctcaatccgaacaagctctagttaattgtgtaggtcttttgcccgcatgagcgcgggtttacggccggtggtaggaaaggcgatggatggtgtcgttgaacatcgaagaacggggagacgacaaaccagagaaaaagacagtgatgaacagcggccgtttttttatatgtgcatgcgtgattgctttgagtcctgagacgagtgcagaatcatgatgtcgccgtactttggcctcctgcttgttcgatcgattcaaatgaggagaaggaagaatgaaagaaagaaagaaaaaaaagaagttcccggcatacatggcagcacaaagctacaagtacttatgactgcgtcgtcgcgtcgagaagagagaaaaagaaaggcaaattctgagcctcccggatgaatccacttcagagattctcttcatcattggggttgcaaagctggttaatttagttttccgacttttccccaagaaagatgcatctcgttcaaacatgcgattttttttttctgaaactggacgaaaaaacagggtgtttagataagaaactacagctactgcaacagtggcaactctgagatgttatggatgtatttcttctgccattttttcagtccattttgttggcttgcgaaatttttctggcaaaccaaactgggcatatatggatgctagctggggcacactgatcatcattggactgaaaattctatttgttgagggtatatacctgtacatacatgccatgtgctgcagtattatcgtgccataccgggggtgcaaaacgaaatcaggccaaattcattcacatggcatccatgctatgcactgcacgctgctacggaagcgtacaaagtatgagaattttgtcacttttgctgctccatctacggcggcagtacagtagttggtacagggtaccccatgtcgaccccatgcatgatctgaatatacatacattcacacagatatattgcacatttacagcatgagtgcaatttaatattgctttcttggcctaaattattgatggtcacacccccttcgtttgtgacacggcgctacctacgcagagagatggttgtttcgttctgcgacacatgacacatgagatcgatcgcagtttcggtttcagattttttcttttcgaaaatatacaaaagaattacatatctttatattaagaccgagatacttatacacaagcaaaggctatgtaaatgtatggctagatcttgcgatatatatggttttgtgaccacgacagggccatcggttggcacaaggctagcatccctgaggactcccgtagaggagaggggaaacccgcttagatagggcgtaaacgtgttacttcctctgcagctgcgccaaccacctttctccgagttttgtgttggttgttaaagatcctattgttaccttctttccaaattaacgtggctaggatgacaattgtattatatcctttcctcggggttttgataaccaacttcctactgttgtaccgccacagtgagaacgattgtggattggataggaagcaccaagattggccaatggtgtttatgataatccacccaaaaaggtctctgggtaaccaatctagatgtagttgatcgtttcctcttgctagtcgcagaagacacatttgctctgatgaggcaattaagccatgcttgcttagcctgtatgccgtccaacaacggcgataagcaaccaataggaaaaatacagcacggcggcacgtgtttttttttcttttcaaaatggcttggatgggcagatttcacgaccaaaaaagaggattatgtaagctgacttggtggagtattgccctgaagcttcccacttccaaatgagttgctcgccgtctaaggtgattgcacctgaactcagagatttagactttttttacaggagaacagtaagggaggacccccacggtaaatatcaaattaaggaatatttacagggtttatgtgaggcatgaaaattacatagcgccaatccatgattgaaacaaaggtctatctcaaattctgagccttaacgtcaactcatcaatcttttaagcatagctttccaagttacaggagaaggatcaatatagagatcatcctattcaagcatgctttgatccagatattcagtttcagattttgtatatgtacatgttaatttgttttatatctggctgcatacgttaactagaatacgaaatgaaattgtacgtattaccatatgtctgcaattctcgaagtactgctcggttcatccagccgtctagctgcgtaatatatttcagggtgtagctgtagtagtattcagagaaccaccatatggagccacatgaacacgtttaatttccgagataacagttcgtcaacatttgtgactgacaggacaagctggaaccgttatacaaaacttaaaaaaaaggtaacatgtgagatgtgagcatggaccatggatatgaaagagagacactagctagtgttctaattggaggtacgctctgcaagaatggtgccaagttgccggggttcagataattctcagaagttttcccaatcaaagttcagtagtgatcagctaccgatcgatctatcaatcaacaaacggaccaggcctagcttctcccctctctttcaaacccctgatcatggccgaaaccatcagctgccgctgccgctgcacgtactgcatgctttgctacagctcaacagtcaaataccgccaactcacaacacaacttctctatcagtcagtacagtgctcgtctgctcgacctacccggccggacagtgcaaaggtccccctgcgtttccacgaccccatcactgcacgatctagcatatgatattaggtaaagagagagaagagctagcagtagcaacagctgctagctaaacctgcatgcagctgtgtgcagcagcagcagcagcggtagcactgcatagcaagaaagagacacgagcacatttctctcttttggagcaacaaagcttaagctatagactagctacagtgccggccggccggccggcgtccatcccaactagtacgtgatataataattatatatgttaatcaaacgatatgttagacaggttcttgttcttcagaaaagagaaaaggaaagttggtggtataatagtcactcactatagtcatatgtgcatgcagggccctgtctttttggccttccaaaaggagagaattgaaaccgggcgataaattcgtggcaaaatccaaaagaaggccgtgtatctaggacctttctctactatccaaaagggagatctcacaaagaatgtactagtccagtatatagttgtatatgggttgggttgcagtagtggtggtggccggccggccttgacgacgaacgatgatggccaccgcgtgcacgccgtgctctcggtgcgagctccagcttttttgcttgctagctaagccccttttgtttttcagccgtgctagttgctagctgctgcatcacactgctgcttgctgcttgctgctgctgctgcctttgcttgcttcgatctgatctccatattcttttagcctttctttcatgtgtcgcgcatgtgtacagcctactgatgggctcgccagtgtacgtactactacgtagcagtacgtactgcgtgctgctgctgctgctgctgctgctgctgctgctgttgtgtagagagtataattccttcttcacaagtcacaactggagggcaaatgggcaatgcgatgggagattgggagcaatataatggcatgcagcaagcaagggaataatttttctttcctctcaactcatatcagcatgcagctgatgcctgacaaagcctccaaggtaggttgctgtcgtcctggcctgaacggtcatttcaggcgcgcactagctggtctttgatgtatcccaggattgttggggcgacgggggaatcgcttttgtccagaaattggaacggccaaaatgtgcggtgttagtttttgatcagatgttggagttgcgctgcttaagagagcatgattagtgagattaaaggccctgttttcaacgtggggttcttacaggaattttggagagtttggaacagagagaagacataaatttctgagaagatctatatacgatactaccttcgtttcataacatatggatcaatacaaacagtacattttattagtatgaatgatcagatggtgtagattaactggcctaccaacttaaattaattgtagtataaaattgaaaaggggataattgtctttctaaatgtttgcttgcagacaactgttgtacataaatgcacaatgctagacgtgttcctcacttgatttcattccccagtcccgtagttgtcgtccatcataggccataccgccatagagagacgccacacgcactgcaagttcacgcgcaccacgctattgtgcctgcctgcctgtaaattaattcgaattgcctttctttcgtcttctcaatttccgacccacccaaaaccctagctagttcctctacctggaggaggcagcagcaatgatgcccaactccccactctccaccatgctcacgcgaacttgtacatggaaattcctagtgtatctttgtatatgccaaaaatatatattgctagtgtattgtaccgtagaagtccttcaatttctttaatcaatcccttccaaaattctacttgttctcaacagaattttcataggattctcctagggtctattggctaacaccacaatctgattagccaacccagctcacatccctcctatcttaagggtttattcgattgaaggggtgtgggattaatctccttaatctcatgtgaaattaattgattgcccaataccctccaattgccatgtgaaaaggattaatcgaacaacatgtaaatagggtatatggggaataagtcttgttcatatgtactaatttgatcaagattttagtgacatttcaagatttgcgactcatatcccaaatgccgtagcacatgactacatgagcaataaatcctgatttttttcccttttaaaacaaccttaatttcatatatgaaacacgtctctttagtagaaacaattaattttaccattctagataaaaatgggtaaatggttttgtagttgttttcttacgttaaaaaattagaaatgtaacagtttttacgattgtgtgcaatattaggtctggcatggagtatagaggcacgaagcatatgttcacgcactccattctagagggagtataagagcagggttcgtgtttccaaagggaacgggtcaaaacccatgaaattatgaggtttccacgtaggataaagtatattgtgattgaaaatttgaatggtcttttataaattcaaatttcaaacaatatatatgagcaaaatttcatcaaaatttgacaaaaccattgcaccgccgaggttgggatccaacaatccatcgaaaaaataaaccatgtactagagtaaatgttacaacatttcttaataatctattacataggattttgatttgtacttctaccataggactatcacattgagtaaaaaaaacaaaaggaaaagacataagtcaaacctaaccaaagcaagcaagaggagttcatccaaaagagaaaaaaaaaagaattaggatacaagataatattggatgcttgaaatgtgttttacactagattcttacacatggtaaaagacaaatgctctagctaaatgtccgtcatagttgtgagagagccacaaccaataaactttttatagattgcgtgtttaatggatttattgtctctattactttagtcctacagaagactatttctctaggtctagatcatgtagcggtggggccaaaaaaaatttagagagtatttgttatgaaaatcttattccctatagtaacagtaacataacgattttataatgtgttcgtcgatgggtcaggtagccgcctagggttatcgagcggtggctccaccactgagatcatgtacgctcgcatagtaactcgcggtatttgaatcgattggacactattgtgtctctctcttccactaactaaaggcgataaattgaatttttaaaacaatggtgataaattgaattgagagtggtggggaaataataaacagtgctcctacttgcagggtgacagtaccggtccacctccaccatccatcccctacactgtcgcgagcgctctctctctctctctctctctgagttcgttagcaaagccaaccaaaaaaaacctaaaagcaaggcgagcctcggcagtgagatcgagatggagaaagcaagcaaagcaaaggcagaggcagcaaaaggcgcccacacccactgccgctgcctgctgctgctgcccccggtaaatttaaagaacccctccaatcagagcgaggcatcatcgatccccctccctctcatcctctccctctccaccctcctctccttctctcatcgatccggccaaaagctactcaaatgttatcgatctcaccaaaagagaagcaaagagaaagagagcatcaaaagcacaaacaccaagccactcaccacacctcgcaatttacatggctcctactaggttgtgtagctgctactagctagctcagctcggctcggctcggctcgccattaaaatccccttgttaccgcgcgttgtttggttgtaccgcgccatatgttgccgcctcctcctcgtcgccgttgcttagatggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgtcctacagctactaccaccacagcagcaacagcggcggcggcggcggaggcggcggagggtactactacggcggccagcagccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcgtccacgcccacggggacggcgccgacgccgccgctgtcgacctcgtccaccgcggcgggcgccgggcacggcctgttcgaggcggcggacctgtcgttcccgccggacctcaacctcgacttctcgtccccggcgtcgtcgtccggcggcgggacagcgtcgtcgggcgcggttgggggcggcggcggcgggaggtgggctagccagctgctgctggagtgcgcgcggtcggtggccgcccgcgacagccagcgcgtgcagcagctcatgtggatgctcaacgagctcgcgtcgccgtacggcgacgtggagcagaagctggcttcctacttcttgcaggggctgttcgctcggctcacggcgtccgggccgcgcacgctgcgcacgctcgccgcggcgtccgaccggaacacgtcgttcgactcgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggagaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccgacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcgggagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatgatcggatcgtcgtgatcgatggatcaaagctcaccggtgagtggaacagcatggaagaaaagagctccatagctaagcaagcacgcatgcatatccaccatgcatggggtaagctagcaagctctctcgtgtgtgtcacgatcgacattaatggcggctcacacaaaggcatgtagggttttgaaacagcgtaggaagctacagaaatggatcacgtacgtacgtacacattgggttgcagcgatcgaggagggagatgatagttttagttcctagatttgcatccatttttattcatcgatcgccaacaagttcttggcgagaagatgattttgatttgcttgcttccatcttcttgtttatttttccccctttcgtttgtgtttcttcttaatttgtaagggttaacgacatttttcttcactctggagaaattttacgtgcatggtttttatcatgcgtacctgcatcgatctgatcatacctatatatattcatctagctagtagctagcatcttgcaaacattcatgctttcttgcatggttgttgagatgttacttcttgtcatcttgatgggagaaagtttagggcagacatttgcacggcctagtacttctagctagtcatcaaacatgaaagcactaattaaagtttgctactttgctagtgatagaccatagatatgtgcttacattatagtatttctttatgtacatgcattgtggttaaattaattaattaatcatccctttttcatcattctatcccatttgtaatatcactgcgctcaaaccacaccactaggcgtatatatatagtttggtcatagaagattatgcatgcatggcatggcatggatgtttatttaagttgtaaaatgactccccccgttcaaattattatggtttggatccttatttataggatatgtgatacatcaagttgatactaaaatactactactagtagtagaattcaagttctagccgaatatatattaaataacccctgatcctacacaggcgttgatcgatatatacatctgacttatttatatatgccaaattaagtagttggagcaaattgacctgcgggcctgctgtaagcattggttaaacttgacaaatggccggccttatgttgatttggttaagctaaagctagggaccatttattttctccatatatactactctctccgtttcataatataagtcattctagcattttccacattcatatagaggttagtgaatctagacatatatatctatatagattcactaacctccatatgaatatgggaaatgctaaaataacttacattatgaaacggatggagtactaatatctgatatggagtagtgaaaagatctgtcaatagttttgtgttcatgtacgtagttggtccaagaaaccagatcaagttttgttgactattgcaggctaagacctttgctatcttttgaaggaatgaccggcctgtcgttgacagattagtttctctcctcattaactactacttaatcagctaattaaatacttagagctttgatgctgtacagtataggacaacaagagttgttaagagaaactaatcagtggcgcactatgaaaacatatttataacaggttgacgaataacacaagagaaggatgaggaatgccagttctctcagaggattaggtgatggggtgatatcatgagctcagaaaccatttctagaaaaatcataagcttgcacactttctccttgtccttttcatgcagaagctgcagccgtcccactatagcagattacaatcttattttgactgcgtgcttgataatcctgctgcactttactttgtcctcagctttgtgtatatatttattattactctgtatcactaatgtctgacttgcctgttagagcacgcacttgctgtaaaaaaacgaaaggaaatggagtagttcataatcatcgtggaaaataaaacaaaaactttagtaattaaattaaattaaatgctaccagcaggagtatgtcgcaaacggcacgcagacaggatcacaggagctcacatatacctgaagaaaatgctagaaactgtagctctgaccgaatccgattcctgatctaattccttccgctggacacatcacacacatcggtgagatttcatgtgcagcatctctcccattttactggctgtggttggtatgatatgcacgctagccgtcacacgtacgctgaacaactgtgtatatgagattgtcctttttcctttaaccgaacggccggcgatcgaggcatgcatgggtgtacatgccgcctgctgcctacatgcacgtcagcatatagtagtacatgcatacaccgaagagaggaaggatcatatcgaaggtgctcttcgttgttccgatccgctcgaccgtttcccgcggcgatcgcgcaagccgctaggctacaaaaccggccgcgcaccgtgatgggaaacgtacgtcgtcatgggggcgcggggggtcgttatcgcgcgcgtcggcgccgcggccggttggggggatcgcgggttacgtacggggcgcggcgcgcgtatgcgtgagagatccccgtgtcgtcgctgggccggtgtgggggcgtgcggggcggacgggggggatgcggacgggggcgggagggaggcgaatctcgtggcggggcgcggggtggaatctaacaggagaaggtggtggtggacttggagtggacgggacgggacggacggccggctggttggcgggttggctggatggctagtggagtgcgtgcgtacgtgcgcctgcctcctgcgcgtcgcgtacgtagtacgtgccgggacccccacgatctttttcgcctttccgtccgttttctcccgcggaattattacgccgatcgacccatatgcaccccgcgcccgcgcgcgcgcgcgtcatcgccgcgctccatctcgcgacacggatcgctgtccgccgcgacggcacgtactacgtacgtaccggccggggacagcatcttggccccctctgctgcccggccgctgcgcccagcttagcttgcatgctacttcttctcgtgtacgtacatgcatatgtgtgatctagtactggccggccgatcgatcgagatcgatccaggcttgtctcgtcctatagtatatggatctgttgatcaccagccacaactaagggcatgttctaaacagctaattgaaaattgctactcctcgttttctgttatcatattttttaaactgttaaacggtgttttatgcccaaactttttatataggatatgctttaaaaatcaaataaaatcatttttcaaaatttaaataattgatactcattaatcatatgctaataattgtgtttcttgtttttacatacagccaaaacctgcagccgaaaagaacacgcctaacaacggaggcaatcgagttagtattatctattatatactaaaagtcctttaaacttcctagaaacactcttaagccgtcacttgtcacttctacaaacgtttctaagtcgtcacatggcactatctaatctcaccgttgatttttacactgatggacctgttattttacaccattagattagatttattatttaaaaaataataacttcctcatgtttatatcataccagcgctactactgttgtgccgtacgtacgtactaagttaataccatacaaacgttaatgttgttcttccggtacgtacatccatacacgattgaacgtacctacgtacgtacacaattgaaaacaaaataataaagcttgctaatgtctgccggaagaaaaaaaacatacgcatgtacataaaaaacgacagaaaaaaacatacatccataaaaatcgacagtctcttaaaatttgataatctacaatgtaaagttaaaatatattacttcacaaatataaatatatttagttaaataaatatttataataaatatccaatcaatgttccttaaaccatcttctaaatctatctattatataccaaaagtacattaaactttgtacaaacgctcttacgccgctgcctacgtgtctctctaataaattagataaattctaaaaatctattatatattaaaagtccaataaatatcgtacatatgttcttacgttgtcacatggcgctctaatttattagagaaatcctagaaatcgagagaacaaaaagaaaagcatccgatcttcaaatttcactgaaactggtggacctattattttaaatattagattagatctattaaaaatctcatgatactaatctctataaaaaaaacataatgtgcgtatgtgcgtacttcgtatgatcgccctcctcccgaaaaaaaaaaaacaaaacttaaatacctacaccatttacgataaaaaaagataaagcaaaaaaataaaaataaaataaaacacgcacacgtacatagtagaattggaaagaaacactaaccatcagtgccaacactgatgtgttgtcaacggtctttaatctacgattttattaaaatctttattactatacgagacacacttactgattctaagaatgtatttattttattttcacaaactaatttacactaactaattcgcctgattgcacttagtgttgggttcaatagtgtataacatttgtccatcaactatattcggcatataaatttctatcaaccataaaaaataggaaaaagcacgaattacctcctcaccctctgaaccatcgtgttcgaccgaattacccctgaatccgaaaaccagacattacccaccctgaattttcaatactggacgtataactctccttgacccaatccgaagcggttttgttctgcgtggcatacgtgtggtaatccagaggtcgagtcgccgagtgagctcgagacggcggcgaataaatttattaaatcgactaagcttaataaattataataaattagtcggggataccgtaagaacgcgtatcagctatgggacaccgaaaaaactggtatttagttgctggacacccgtgacattattttataatatccaaaggaaatggagagagaaacaaaaacaaaagtatgattgtgccccttgcctaccaagtccggctcgcatacacctccgacactgcaactgcacccgttgccggtgaggtgactgtctagaggggggagggggtttcgagatatggtattttgtagatttttatggtggtacgtctctttagctatatttttttaaggacgtgactacacagctagtggtagctggtttagacaaaccacctaccactccacatatgatagacactatccacctatacttcaaatacaattttctcttaaactactaatccaatttacgatatgattacaccgttgtgttcgtaacaattaaatctttataacaagatctcacatgattatattttgatgaaaaaatataaattacttttataatatatctaaattacttttagatttcactaagttacttcttaggcatataaaagtaattcaataaagcctaaaagtaatttacatatactatagaagtaacttataacaaaaagaaagtaacttctataatatatgttaattactttaaaactttattgaatttacttttatatgtttaagaagtaacttagtaaaatctaaaagtaatttagatatattataaaagtaatttgtgatttttttatcaaaatataatcatttgagatcttgttgtaaagatttaattgttacgaacacaacggtataatcggattgtaaatcggatgtgtaatttaagaaaaaaaaattatttgaagcatagatggttggaatattttttctacttgcttgatcaattagtactatagtaaagtaagattattcaagacacatatctggacaatggctgatcgtatctggacaatggctaatagcgtcgctcgttatgactaaatcgagagagctctcgatttagattgtgcgtatatgttactattgtcccttgaccgaccagaccggccagtacaccccctcatctatgttattgctatcattatgtggttataacatgtaaacacaagcagtttatgttttcgacccggtccgaaaagtatggaattcgctttaaatcggatcggttttgatatgttgtgtaaatcttggttcggaccattctgttttgcctctccctaaatttgctgtagtagcacgctagcacctcctcgatgtaatttgtactgaactcaattgcccacttattttctaattagtaaggttgtacgttttcaattaaaactaaaggagggtgtgatggattatggtaaattaattaagtcgctatcaccttgatgtatagaactgcgtggagtaccatcacctcgacacaccagaaagttttcgctttctgagatgtgggtcaaaatgggccaccagcagttccaattttcaacccaattctgagcaaatcatgatactagcggtccttttgcagcctttgtaatagttgggtatgcatgcttttggttttatccaatgagaaaaaaaataaagggctactaagctttttgtgcagtccagtggaggcttctcttctttccggtcatatatattttgtaatacaagaaaacatacacatatactgctgagaactgatcccttcagaagttgctcataaactacgaagcaagttgctgtggaccttgtggtttcacagccttacgactgtttgatcaacatccaaaaaaaaaaaggagaagaaacggagaaaggtatatagtgatcaaccactcaactcatagctagaagacccaaattaaagctggacagactgctaataataagaattgtttgaaccacacaatgtttgtgctattatattagtttacacccaaaaaatcaagaatcatgcatcagctggtacttactccatcaattccaattccaagtccatgtttcctggtctgttctgaacgtgtaaagtggtttttatttttaggctagcaaaattttcagtgtctttcaaccatgacatgtttttactatgtttacaaatagatactcccgacgttttgactttggacaaaatcaaactgctttaaatttaaccaaatttgtagaagtaataataatattttcaactcaacacgaatttattatgaaactatattcaattattgatttaatgaaattaatttggtattataaatattattatatttgtgcataaacttagtcaaattcaaagtagtttgactttgacccaagtcaaaatatcttataacctgaaacggaggaagtaatacaaattttgaatgttctacagcaacatattaagatcaattttactactaaattaacactcaaagtttgtgtagcttgctggtgggccgtgtatatggaggatatcaaaaattagtaatttgttcaaggacattttcagcctaaattgaagagagaaatttttgaaaagatgacaatgtccttagagtcaaaagcttctacgaccctagcaatgcacttggttgattgcagatttagagtggcataattctaaattttcacttcaacgtccatgttacgtacaatcctgtggtcttaggggcattctcgtctattgaagaatttctctctttaattggactgaaagtgtcttgtagcaaattactaaatttttaggtgtcgtttagtcatgtaattaacaatctttgatgtcctgtaacaatatgatttttaacattatgtaagtcaccactaaaagcaattaatcacaaggtgaagtttatctggttttgaaggtttagagtgaaaaataattagtttgtgttcagaatgaaaatggacttggatgaaagtttggggtccaaaattggactacccttatttaaaaaacaagtacacgacctcagcaaattaagtactacgttctatatatctaatgaagagttagcaaccaacttattcagcaagtaacaagggatcagttgtctcttggtatccatggtggcatggatgcttattagttttctcttggcaagaacttccatattatcccatgtgcttcactatatgatacactcaaattaatatgttgactaacaagtgatcagcaaatgacacactttcatgttgcattgtacctagtactatagcatatgcaagcaataagtgagggaatattgttttctttaatttgtgaggtttaacttgcagtggcaggagtagtctttcaccttattgttgctgaaccgaagtgtactggacaagcctaagagctagctatgcattggaccaagggaaaattgtaaccatgccattataaggagggtgagtgaggatcaaatagtgggagctcctttttaggggggtggaggtgaaggtgcgggcatggagagacatggcccttctttttctgcccccggcaataacccctttgcacaggtcctcttttagggcatggggttaatactagtttctccttgcctgtacagtcgcatgtctcttattgttatgatatgcagcaattggtgtttgttctttgcaggttcccctccatatgcaaactccctctctctacatatagagtatatgtacatgtttttttttcccatagcacttgttttatactatttttctcctgtcttgttcttgtataggagtactattttttccctgaaggtgttactgttccaaggagcgcgtggtagaaagacaatcattccaaacttctgcatatatatgttcgcgaggttacctagagaacgatgatgttttgctgcatttttagttcattctccttgggaacaacgttaatcctctatccagtgatgacaggaagcatctcgcgcatgtacatgtacttgtaatccttccctaccaacctcttagcgacagattcgaggaaatggaatgcttcttgaatcttgagcttaattgccactgtcatatggcaaatagtttcagataatgcagcagtacagttccatgatataattgtacccatgcaatgaaccaagctatagctagcaaaaagactgatttttttttgctcgagaaacgatgcaattaggtcgtgtatgagagaaagcaaaaacttttggtccgttcgctctcgcttgctcgatcatgcatggtggccatgacaaattggcaatggccctcagttttaagtggtgatcgccttgaaaaaagcctggagttcttcgcggtgtgcagcatgcgtgtatgcgagccctttttgtcaggcgacttgcacaagcctgaccccagaaagaccgacaaccatccaggcacgaaaattcatgcaatgctccaacattgcatccattggcagctagctcgccggtagcctctctcccctgccactactacacacattttatgcatttgccccatatccatcaccattattctagctaccactacatgcttacctctagtcctagtactagctagccacttcgccaagaaaatgcaatgcaaccgcacattccgtcacataaaaaaataaatctagtagctgatattggtatatcctactactacgaatataaacaaatattatggtctgttttggtttaatgccaagacttgccctaccaaatatttggcaatttaaatagtgttttgtagatgtttggattgatgcgaatatttgccaactcatatagtccaactctactaaaacattggtagtgccaaaacatgtctaagatttggcactaccaatagtttgataaggattaaggaatcaaaccacataaacccatccagattggtggtactataatatatcaacatccgatcctaaattgattttttgtgggacggatgaagtatgcaagtactccctcccatatgtctcgtgatagatttatttttaatggaatggatggagtggtagcttggtatctgctacctcctttgtaaaatgtagttgtttttagcacaataatttgtctcaaaataaagctaattcttgatttattcacatacctccttctctcaaccaatgaaaactattctctttcatatattttttcttctcaaccaatcacacattttctttaatcattctcacctattttcttaatactcgtgccaaccataaaaatgattaaattttgtactgaggaagccgtgaaggtgcagtgatggagacacccatattgccagtgagatactatatatgctagtacttgtgacttgtcctactcctactactactcctcccgtcctccgatccattgcttgcatggatcgatcgatcggtcactggttcacccacacactgttgagagtgcaacatcgtgatgggatcacatccacatctctatggactctatccccaaaggaggagtactttgcgaatggaatcatgcagaggaggaaagcaaccacgcattgttgcagttgcatatatatacatactccatggagaagagaagagggcgattgctgtgcaaaagtagtacgtgcacattgcccgcgctggggcctggttttgcagaatgattccatgcaaaagcggctaaactgctcgcgccattgacatatgcacatgtcctccgtccgccgtgtgcatcggcctttcagatgaaattcagaatttcaactgttgagagtagcagtaatacgcatgcagtcatgcagagtacgtcttgtctgaattggacgttgataccggcggaattaatggctgaagttctctgaaatgtatctgccagatcgatggtggcggatttatctgaaatgaatttatgtaacttacagtgattgcatggtactactactaattgattataagctctatatttgcttattgcagtgtgtacgtagtacggctatatatagttctattgagaatttcagtcgatgaaagaaagagaaaaaaaaaagaactgtgatctatatactgatgcatgatcatcgatggagagcgttggatggcgaaatggcgatgggggaagtggcatcgaaacggagagagtggtttcccccttttttctgcagattctctctggtttttgatgggagaaagataatggcacgtactgtgagcgtaaactgtgtggcagtttgtcgtgcctgcttgaacgtagcggcgaatggccagaacaaaaacatgtccaagatggcagacaacgacgcttgctcgccacgcacgtgccagtgctgcgttgcacagctcgacacattcgcagaaagctacccctttttaatattcatcttcagatacaagtattttgtcctaagatatactgatatagtatgtgtatattcaccggggaggaactataaacttttggtacaagttcaccacacacattcacccgaaaaaaaaaaaagagtttaccacacgcattcaccgtcaactcatccaaataatgacatactccatgcatcatctgcagagatcagtcatcagatgatcagatcaatatgcatcatctgcagcgatcagtcgatcatcagatgatcagtggtcagtcatctgctagctgctaatcaacggatgagccggaggccgtctggccgtgcgtacgaacgtcaccccatgaccccatgacccagctagctcctgctaacgatcgatatgattaggcgtattcacgagctcgaccaaacggaaataaacgcatgcatgcatgcagacgcagtgctttcaaatcgatcagctactagtatatacgtgtagtacgcgtactcctactgatcagcgtctcgatcgggcccaaataattaactggccggctgggctccggctgcagcgtgtgtcacgccccggcccgaccggccgggccagcgagatcgatgcatctagcttggtgtatatcctagtatagtcccgttgctagtccagttgccgagtgccgaccgtttgccaagagtacggaacatgtgtacatgtttgatggctaattgaaacgacgtgagaacagcagaactcatcgtcgtcacagattgatcaactgtctagcgatcgatacgcacatgtgcaaaagctgcagggcctgtgtacaaattaagctagcgctagctgttgttttaattgagagcttatcctcatttggtggatcaacaacaaccagctacttcctccgtcctaaaaataaaacaactaattatcataattcatcttagaaagttgttttttaaacagtggatatatatctagattcattctttaaaattagttttttaggatttatagaggggtatgactaggggtgaaaacgatcgagtaaattcctgatcgatcaagcgttattttcatataaggggtaccgtttccgaccataccgtttttagctatttataatttttgttttttctaatttctttctatattatattaatattgacaccaagtagtttaaatgataaatatggtcaattaccggccgatcgagcgtcattgtcaaagagacattaccatttccgaccgttttcacccctcaggtatatctagagatggtgtactgtagctaactacgtacgcactgataactgattgctgctgcgtaattgattcagcgattcagtggatgattagtagttgtccatatctaccccagcagatgctgaatgtacgttaatctacctccccccccccccccatnntcatnntntaaaacacttccggtaaaacatttacgcattctttttcttttccactttccaataattataagccgccccaaacagaggttataaatatacgctcagaaatccagaaggtggccaatctgtgttgacacataatttaagtccattggacttataagtccccggtcctaatccttctgctacccaaattgatattatggcaggtactatgcctatat

SEQ ID NO: 65835 - DNA, 7709 bp, Oryza sativa
ataaaaaaaaatttaactccaaagttgtagatcgcgttgagggctataagtttgatataaagtttgtcttcattagagttcacatgaaaaagttatgaatttttttaaatataaagtctttagatcgtcctatttgaattagatgatattcaaatccaagtttagggaccagggtgacacaactgaacaagttggaggacctaaacgagtgatttgcaagtttagggaccgggatgacacagtcgaacaagtttgaggacctgaacggtcgatttgcgagtttagggactgggatgatacaacggtacaagtttagagaccggtgatggactttactctatctattattacctctggttcttttgaactttgtagttgcgtcagttgggtgtaagtagatgcagcattattacatatatgggattatttggatcaggtgcagtcacaatagtgaccgtaacttgcagtagtagtacgcatcattggatataaattgaacggctcaggtcgcacatggtactgttcatattatcgtatcagcaaatactgttcatgtgggtactgtagcttttgatctgaaccggtgatcacaaaaatggatggtcgaagttgtgtgcagttgttaaatcacctaatcccaattcatatacgtggtatggctcccattcctttgatttgaaaatgtagtcatttatggctttccaaatcttcgaaagcatgatagagattttttatagcgcattttcagttttcatagtagcaagcaaataagccaaaatatcttgcattgtctgcattggtgtgagagcatctatttgaaggtgaaaatcagatacaaaccaagttagccttgaaaattgacaatgaaagaaaaggtgaaaatcatctacctgctgaccacatcttgaacaagttgaggcaatattagggaaattgtttttccaaacttctttaagaagattgattgttaaagtaggaacagagggttgatgaggatgaagatgagagtgaacttctttgtaagcacttttttgttgcactcacctgattgggtatgtttccagcaaagttggtcctccaaaacttgtggaataatttgtacctgtaagattgattcagtagctttctgatcaaacatttgtgaaattttttcagtgtcccatctcttatatatcttgataaaaaaatcagcaatatttataaaggcaataggtatggaagagtatcgaggacaaggtgaacatgaagacatgggtgcacagtgaagatggcatggacacggtcgggccttcacgctcgtgccaaaatttggtaaggctattttgttttcaatcacaggacgagtaatttcaccgtccttaagaaagtaggttaaaataactaaattttaaattaaaatttttttggtaccttgagatatttagtatctagagatatcaaatttgtcattaaaaatatatatctccagataccttctcaagaatgataaaattattcttataggactgacacacattactacacacgcaatacgttcacatactcacgaatgcatctcctaacaaacggcacattcctaatattgataaaattatttttaaaagtctacttaattacgcatgtgtaatatccgttggcacccaaacttgaatatcggttggtccctaaaattaatcttaaaccctagcattccacgaatattttaaggagaaaaacaaaagaccataatgcatttaattaatataaaagttgtatttgttgaatttgtagatgtggggtattgaagtaatgaaatttctcgttttgcgaattggtggtagccaagaaggtagaagttgatttattttgcgacaaacttcaatctttataagttggtttatttcgggacagaggggagaagtgccgtacaagatgacctggttgtccagacttattaattaacaaaataaaacacgtgtagtgtcgacgtgtagtgtgggcatgtcggatcggcgcgcacacacacgcgatgataacatgatagccagccggcaggtagatcgaaaatataggaaggagcttaattagccatggatggcgcgcaggtagctgcttcattcagttgcgcacccagagcatgtcgtcctgaggcaggaagtggcagactgccaccttcccgggcgccacgccgagcctcttgtacgcctccgccaccgccacgccgtgcccgtccacgtccccgtggcacgccgccaccgcctccgccatggtcccgtcggcgccggccagcgtcaccgtgtacgccgcgcccttgatcccgtgcaccccgaacacggcgtacgcgtagggcatcctgtggcatgccaccatgtcgcccccgggcaccggcacgggcctcacggcctccaccctgtacgcctgcctcggcgtcggcccggccctgttgaccacctccgtggacacggcgtggacgtcgcgggtgccgaggctggaggcgacgagctcgaccatggactcgagcgacgtggcgcagtagtgcttgtgcttgggcgccgtctcgctggcgatccgcgcggcctcgcacacggcgagcgtggaccgcatggcgtcggcggtcggcgagccggcggggatggagagctgggagaggatctccgggagcttttcggaggcgaacgggacggagtcggcgcggccgcgagggagcagcgcggcgccggcggtggcgcgggtgaagtggagcgtcatcttggagcccgggaagaggtccttctcgaggaagaacacggagcccaccgtatcctccttatccttcgaagctgaggccgctgagctcgccgggctgatgaggtcgcgaatggcgccgggcatcggcgaggtcgggagcgcgatcttccagtacatctccgccggcgacgcggcatggctggctcccgcggctgcgacctgaaatgcagtcagaaactagttgaattgaaaactatcaaagccaaaagttgcaactggaataagtactaattgtattacgttctcatcagaaattcaatgaactccatatgttgatccatcaaccatcttaaggtaaacatgttgatccagttagtttaaaattttagctagggttccccgcaaaaaaaaaaggttagggtacgtaattttaacttaatcttcaatctctaaataatatatatctctctcccaacttatctctgttctaggcttctagctcaaaacaactaaaccatacaaagagcgatatatatgtgtgtctgctcaccagaaggagaaggagagcagcgagagacctagccatgctaattaacgagctgtcaaggacacaagtatatgatctaattcactgataagagtgaaactgagcacaagcagttcatagcttttgggagctatttatagatcagggaagcgggaagaagacgaacaaataatacattgcattggccccactggattatgcagaataaaaaaatatgtcatgtagcaaagatgctatatcacattcacgatcatgccggatatctctattattgagcaactaggagggtagcctgcgcattcgcgcgggcatatattgtagtgtatttcagatatatacttataagtaatagaccgattgtgttaaatgtcgtatttgttatatagcaaaatatggcatattgatattatatatattgttggtttgattataaacagagtaatagttagattagaaatcagacgtggagcttataattattgattatttctcttttagttatacaaaataggaacgagagagtaatgaaaagcgtagagctcgagctagagtgggtgtgtagtgatggacgcatgtgagggtgatgtggagtggatttttttttgtaatttttctaattgatttaagtgaaagccaattattagatgttattttccttggatttgtaagatttttttttaaagttgtaacatgtcatggattaagatttttataaaaatagatttgatagttgaaaataatattagtgatacgtggtaacttaatatggctctaaaaggttataaaagttgactttgtactttcctaatttttattatgtagaatgattaacatgacataatacttgttgtcaattttttaatatttcagtgttgtttgcttgttggcctatgttcaaattacgtattttaaattttacatagtaaaatatgagtaatataaatcaacaattcaaataaattaaaaatcggatgttattaggttgtcattgctgacggtagttatagaccaattttgactgtcaatacttttgtagataatggagaactagcaatgcttgcatgcatatttatttagaaataatctagttccacttgtacttgataaagtaagtatttgtttacaagagatcatcacataaatggaggagaaatgattgaaaataaccgtttaaccaatcagaggtcgacatgtggcagatatatggatggatgtgcccagaatctcattgaaacacctacaaatgggcccaaccactatgccactgggccgaggatctgtcaggagacgtctaggacgaaggactggcccagggaggccaaccacggttcggccaaccttgggttccgctgacccatgcctggctccgatcgcccaggcccaagccgaaggcggttacataccgatcttctaatgacggttgtactggtattggcgctccaatcatcatactcaatctataaaaggacctccccaacttcacttcaatacacaccaagaaggaaatcaagtgaagaagctctcttaggctgagttcgggaatgaggtttgggaaccctcactccctggcacggaaaacggagcagcgattagggggtaattaactaagtatttgcttgttttttcaaaaatggattagtatggattagcaaaaaatacaccatttagcagtttgaaaagcgtgcgcgtggaaaacgaggaagggaagttgggaacaggaggtaacgagcgcaaccctagtttacatattttgctctagtgctagtagagttagaattaaatattcttccttagttcttcatgtcttgcagagaagtcgggtatggttctagtagctcttcctctcttgtaagactttattcaataattaaatattgttttttatatagttttggtcctttactatacttgcataattattcgagtaccaacttcggtttatacttgactcgtatttattatgtagctagcttactggagatatgcaatggtattggcttagtgttcatttatttggtaatatttagtaatgtaagcgcggtgattagattattagatatcattaagtggtgctatatgccacgcatacgtaaagataggccgctgatgctgacaactcaatacgtgtattcgttcacgtgcgtagatagggctaagaaaggttccgggtgcgggtacttctccatatctttaaccggttggatagtcatgacggattgtcgtaagaaactcgacaatttggggtggtttctcgatataccagtaggcatagttgtacattagcaagcatatactaaaataactatatattaaaaatatagaaatgatgcttttctttattcttctctagttagcctagacttataatttagtgagagtactctaaactatcccttctatgtgtcattcctctccccttcctactttgtatgactaaaagagaaataatctataattaattataagctccacgtctgatttctaatctaactattgctctgtttataatcaaatcaacgatataagattcatatacctatattttgctatataacaaatacgacatttaacacaatcagcctattacttataagtatctcaaatacaacctatgatacatgcccgcgtgagtgcgcgggctaccttcctagttttcctaaaagctacaactacaatagctcaatcttccctacaagctgaacttctggctctacaattgacaatataagtggcgatatttcttgattttgcaggtaccatatttttaacggacaacgagacgatcgcaaatacaatgaatatgagacattttgaagctgatccagcctattcgaatcttcagcggttactgagttaaattcaagcaaatattccttttagcttattgcaggtgttgtggtcttgtggataacgagagaggtcaatcgcatggctgacaagttagcaaaaaatgcgagagatgaccaatgaaatccagcatttgttttgccacaatatcgccaacctagcttatccaagcagaaggtgatttgctaaggatatgaaagaccatttcagtacgtactctaaattgtatgaaaaccatgtaattaatatgtttgagcaatggaataaagtttgagttctaaaaaaaattgcatccttttcatgttctaatgcatatcatctagaatatgcttaatgcttgggctggaatatatatacacggaatggtcatcgtaggcgggcctggcctgagtaaggtgtaaacatatccgagcccttaaatggccttcctgtgaaaaaccaagtcctcttcataggcagccagttttacagccagcatactatagatgaaaacggagcggataattcatggatagtccggataaagatatttttttatatgaatgtgaatatggtatatcagagttttcgatgaatatgaataatagaaggatatccgatgaacaaaatgctattcagatatccactgaaggcatgagacatatctcatttctttctaactctagaccttcaacttacttctttagaattttaatagtagcccatctcatgatactagcccacactattaatattacttaaatatttaaatatttttttgtaaattttactatattttatattataatttcagttagacatgtatttatatcaactctgatgtacatgttaaacttaattagcattgttgactctatgatcaaacttattatataaaacgatatatttatatatgatagtatttgtttctattagaaattgaagtgtttttcatgttctgagaaatatttatttccctattcgtgtccgatcatattcgatctttattcatattcgagataattcatatttgttttcatatccgagctttcgtattcgttttcctatccgacagaaaatacggaaagaaatattgtataagcattatccatccatatccgctccattttcatcctaagcacatacaggacactcaggagacccgcttgcgaaaaaaaactcaggtggagtgcttaagaacctatttgtgaagatgactttttcgcgggcagcccgtatactctcgggagcctatcgtattaccggcgagccttctcatggccggaaacggatcctctgactttggatggaaagtcacggtcttgcaattcacttcatcccagccaaccactgcatccaacggcacacatccatcttcccctcatttgcctgcatatgttgggagtagctaagaaaatattttacgtagtggtgtatacaaccgtgtaacattgtcatacaagatgtatggatcgatgaatcgtacatgcagacttattaacatgctgccacaagtatagtagtggcatttcgggtcgtcgcatacacatatgataagacatgatacgcatatagctccaaaatataggaaggagctatcttgagatcacacaatttttatcccctttca

SEQ ID NO: 65836 - DNA, 5125 bp, Oryza sativa
tttcagttgtggcataattaagctgagctctagtcaacgttttactagcatatgctatagcatggtgttttctatccttagtttgtccaagaacagctcccacggcaaaatcactagcatcgcacatgatttcaaacggcagcgatcaatcaggaggttggatgattggtgctgagatgagtgaatccttaaggattttaaaggactttaaacactcatcatcaaagtcgaacggaacatccttagctagcaaggcagttaagggtctagcgatttttgaaaaatcctttatgaaacgcctatagaaccccgcatgacccaagaagctacggactcccttgacattgacaggaggtggaagctgtcgaattacttcaatttttgctctgtccacctcaattcccctttcggagatttgatgtcccaggactattccttcacgaaccatgaagtggcacttttcccaattaagtatcaagtccttttcttgacatctttgtaagaccttgtttaagttctccaaacaatgatcgaaggatttaccatagactgaaaaatcatccatgaggacttccatgatgtcctcgatcatgtcagagaaaatagacatcatgcatctttgaaatgacgtgggtgcattgcacaacccgaacgacattcttcgatatgcatatgttccgtacgggcacgtgaacgtggtcttacttttatcatcgggatggatggggatttggtgataaccagaatacccatcaagaaaacaaaagacggaatggtttgctagccgctcaagcatttcatcaatgaaaggcagtggaaagtgatccttcttagtagccttgttgagtttcctatagtgaatacacattctccatcccgtgacggttcgttgtgggatcaactcgttgttcgagttttcaacgaccgtcatgcctcccttcttaggcactacttgaacagggctaacccactcactatatggcatgggataaataatcccggcatataggagtttcaagacttccttttttgacgacctccctcatcgcattgtttaacctcttctgaggttccctagatggtgtgcaagatggttctaagggaatgcgatgagtgcagagggccggacttatgccttttaagtcttggagggaatagccaaaagaaacatgatgcttttctaaaacggtgataagttgggtcgtctccctctcagagagtttgtcacttataatgactggagactccgcatcaccgtttagaaatgcatagtgtaggcctgaaggtaagggctttagctcaattggggcacgtgacggctgatccatttttggcagttcaatcgtttctccagattcatcctccccttcattgaattcttcgatggattcattgaaatagactctggggcctcgaatggagaaatggccatcaccttctcaattggttcaggaataggaagaggctccgtcaatgaattgattgattgcaacacaaggacagaggtggcgattcttcctatgttcaggttgaggacaccggattcgggcatatctaagagtttctctatgggatggcctatgagtatgtcgaaatcagatatatcgaacacatgaaaatctaagatgacctcaacgctgttgtgccgtgtgggcactccagagataatccctaaaccttcggtagtagagtttgtggaaattcggaaggttttgacggttggttccaacggtttgtcccctaagcaatcaaatgcaaaggttgctgacataatattggcaccaacagagggattatacagaacacggaccaaattacctccaatgagacacgtaatggttgaggagtggcatcgtatctgaatcgattcagatgagagctctccttcccttaaacattcattactcacgatggtggtcaacttcttcaccgtctctttaagcatagctttatcgagaggttcattagaattgaccttggtcggtggtctcttctcgcaggaataattcgaggtgttctcataatctttgaaaagatcctcctcgaattggaatggaatttccggaggatgaatttcttcttcctccggctcctgcgactgggatgaggattcgatagttgagtcgggttccgactccacgtgcagaggttcctcatggataatctcgacctccgggacggcttcgctttggccaaaagaatcattctcgaagataagatctaagagttctcttccttcgacagttgtcttatgtgcaaacgatcctccagcggaaatatcgagattttcaacagactccttatctaacctgtaccaaaaatgttgtaacaacacatggtcatgtaaagacaagtctgggccaaactgagttaacagtgagaaccttactcaggctgcaccgagggattccttctcgttgtcggaaagaaaggatgtctaatcgaagattgattacacaggttaatggaaagaaagtaaggcagaaattgcacttaagctactcccattcaccgtggaatttcttgacagacatagtgtaccattgcttcgcttcatctctatgagaaaaatgaaacaatttccacttaagagtttcatgtgtcatgcctacgatggatatgcaagaacacactagctcaaagtcccgaagatggaggtatgggttttcactgatactactagagaaggttttctctcgaaccatggctataaagccaggactgatttcatagccatccgaaagggttggttttgaagaacacgatggctcacaaagattagcccgaggagcagaaaggttttgaattgtgggttgctccattaaggaaaggaataaaagaagaagaaataaaaataaagattagcaaccgttctccggcaacggcgccagaaatgcttgttggtatttcttacgaccacagataaatccgcaagcgcacggaataccgctgtagcacttcaccttcgggtgaccccaaaaggatatcgaactcagggaacgcgtgtaatctacctaaggctaaggcaatccagggacaacaactataggtaggctaggcaagctagagaagacattctatgtgttttaattatctaagctaagcaaaggtaatttcctatctgttgcttcgggcaccgacccctgctggtctgccagcgtggttccggctatagctctatgatgtatccgaacgtggaggattattgggacgggattcaaagctatcaccacctgccgcctacctctgacaaatccgtggaatacacaataaacaaaggtaatctgtaacctagacaccacgtctaagttattaattactactctaatacttgtacatgaacttccttctttatcaagagtcctagtactagagcacttagtatgaatactaaacaatgaacccgcaaagatgaaaacctatcttacttagactaaataattaaataacataagaaaggaacacgaatgcttactttatagaagaagttctccgaacctggagcagagtgtaccgacagctccggtactcctctagaattcctcctaagaagctacactcgtcgaggtagaaatcggatgagcgccaaacttccgggcactcctccagagcttccccttactctctaccttattctaatgtacaaaagatacaatagagcctcttgtaattcagctcaaagttgtgtctattggaatgtgagtgagctcctccttatataggctccaaatgacagttaggggcatgggaattgtctaaaacaacctgcaaccgcctctgggaagaaatccgagccgtctaggtgaaagcagatggcgggaagcgctaggattggttcggccgaacccaaaaactctcctcccggcctctccttgggctgggaggttgcttattgggcccccaacaacctgggctatgttttggcccaattctaaatggtttttattgacttattgggcatctaatccgtgtaaatatgtcctgaatacgcggagatgcattttgtcatatgacggatgtgttttctcctcaaattacttgcatacacatatttcaccaacactagtggaaatgattagtaataatacctaccactaagttggataccatgttttatttcattatatacaggtattgacggtcagatattatgatttaaggaccgtcaacaatattcaccaacactcgtggaaattgttagtaataaatcctatcaataggtttaatatttcattgatttgcttttttacaggaattgatagttatatttggtatttaaggaccgtcaacaatttcaaaacatgagtaggtattacctctcatcgagagggcctaaggctgtattcgataccaggagttcctaactcccccctctcgttttccacgtgcacgcttttcaaactaccaaacaatgtgtttttttacaaaaagtttatatacgaaagttgcttaaaaaatcatattgatccatttttgaaaaaaagctaattcttaattaatcacgcgctaatggaccgctccattttccgtgtgagggtgatgggttcccaacaccaaccaacgtgcacagcctaaacctgtctaaacctttgtcctgatatccatccaaatttagatctcatacgctaccccttttactactgttgatataggacactgacagttggcgcgccatgtaggggttgcatcaagttttacaatgacaatcgtgatgaaatcatctttaggagtcgtcagatttgtcttccctccaaggaagacatttagtttcggcagttttgactttctcaccgacaacttcagcaagcattcagtcttcgactcagattcaaacaagttggcggggttcgagacttcctcggtcccttttggtctctcgaatgcggctgtggcccactccagatcggatttccatggctcggcctcaaattggccaggggagtcaatgccactagcttacccggacaacatctccaacaacggcggcaaactaccctaagattctgatgcaactctctccgcttctcgctgcgacgatttgggacctacaccgtccccgtgaattcaatccaggcatgattcgaccatgtccgaacatggtcccagggaagtaagcctcctgatt

SEQ ID NO: 65837 - DNA, 4133 bp, Oryza sativa
ttgtctttgcgatagacgtgtcggacctcgatcccatcgaacctcttctctaacttcctgacttctgcgagatattttgacaactcggggttagagcatttgtagtctttgtgcacctggtttgtgactagttcggagtcccctttgacgattagtcgcttggctccaagtacggctgcagctcgtatcccggcgagtagtccttcgtattctgcagtgttattggttgccctgaagttgaggtggattgcgtgcttgaattgatctccggagggagatgttaagataaatcctgcccctgctccttggctgttgagtgcgccatcgaacgccattgtccatgtttcattgtcaccttggttgtctgatttgttatctggcatagtccaacttgcaacgaagtcggcgagtacctgggatttgatggcagttcgcggcacaaaatggacatcaaattggcttagctcgactacccatttcgcaatgcggctgacgacgtctttgtttctcacaacttcgccaagggggaaggaggagacaactgtgactctgtgggcttgaaagtagtggcgtaatttccttgatgtcatgatgattgcgtaaagcagtttttggatctgtgggtatcttgtctttgcgtcatggagagcttcgctgacgtaataaactggtcgctgtactttctctctctcgacgataatgacggtgctaacggaatatggcgtggcggcaatatagagaaataattcttcattaggttggggagcaacaagtacaggggggtttgataggtagcgcttgaatgcaataaatgtctcttcggcttcctgtgtccatacaaatttgtcttgtttcttcaacaaagcgaagaaaggttgtcctcgttctcccatcctagcgacgaatatgcttaatgctgccatgcaaccggttagcttttgtacctccttgagtcttgtgggcgacttcatgttctcgattgctttgatcttctcgggatttgcctctattcatctgccagagacaaggaatctgagtagcttgcccgacggtactccaaacgtgcacttctcaggattgagcatgaggcgatatcgtcggagtttgtcgaacgttttcgcaatgagtcgcttgtcttggttttgacaacgatgtcgtcaacgtaagcctcgacgttgttgccgagctggttgctaagtgcaccctggaccgtgcgctggaaagtattcccggcggttatcagtccgaaaggcatcttaacatagcaaaataccccgaacggcgtgatgaacgctatcttctcttcgtcctcttttgcgatgctgatttggtggtagccagagtaagcgtcgaggaagctcaatagctcgcaaccggctgttgaatccaccaattgatctattcgagggagaggaaagtgatccttagggcacgccttgttgaggtcggtgaagtcgacacatattctccattttccgttggccttccgcaccataactggattggctagccactctggatgaagtacttctctgatgaagccagctttgagaagttcgtcgagctcttctcgtatggcttgtttccggtctggtgcaaatctctgcagtctttgcattactggcttggcatcgggtcacaccatgagtttgtgcccaatcacctccctggggacccccggcatgtcggacggctgccaagccaacacatcggcattatcacggaggaacgtgatgagcgcgagttcctatttctcgtttagtgtcgccctgatcttgacagtcttgtcggggttagccctggagagtggaacgatcttgatggtgccgtccggcttcggcgtcttatttggcttgctcactttcttgggtggctcagtcgtggcgggtgggctgggtgtttgctcgaccatgtcgaggctccgcttgtcgcactgcaccgccagctttgcgttcccttgaataatgattgttcccttcggtcccggtatcttgagcacttgatacgcgtagtgagatgcggccatgaacttcgcaagtgcagttctcccgatgatggtgttgtaagctgtatcgaattcagcaacatcgaaggtgatctgctctgttcggaagttgttggcttggccgaaagtcataggcaacgtaatcttacccaaaggtctagacgatgattggggagtaattccatggaagggttgatcggttggtgtcaactcactttgcggaagtcccattgcgtccagagtgctggtgcagagaagattgattgagctgccaccgtcgataagaactcgcgctaccttgatgttctgaatagtgggttcgaccacgatcggatatcgtcctgggatgacggaggttttggggtggtcttcctctgagaactctattttctgctcagaccacttcatcttgggtgcagccccctgccacgtcgaacagacttcacgttccactttcttgtattctcgcttggaggaatacgttgtggagccgccgaagatgtgtgagacgtggaggtcggagtctggatacgcagaatccggttcgtgaggaggcatctcttcgttcttctcgacaacgcgtactcgcttgcctttttcaaacgccatgtgcttctcgagcgactttttgaaaccaatgcaatcctccagagaatgtttgtccgttttgtgtatggggcaccatgatttctttgtgtcgctgccttgtgggtctgggcgcttgggagggttcgcgtattctgctgcgaggacttccgcttgagctttccttttcctatttttgtgatttttcttcttgcttgactcagatgcgtctgcggctggtttcttctctcccccggtcttcggtttgtcgttcttgcgtcttagcgcgtcatccacatgggcgcatcactcaacgatctcgaataatctccgagtagttgtgatgcgtcttgtcggcaactcctgggtagtgtagcgatctctgacaccggacttgaaggtgcgaattacagaagagtcggtaatttcgggaattgtgtttctgcactcgttgaagcgccgaacgtattccctcaatgattcccccgagttctgtgttaacgcgtgtaagtcgtcttcgatcgcgtggtgcttgtatgttccttggaaattggcgacgaattgttgccacaggtctgcccatgaagagattgagtaaggaggaagatgcatcagccatgaacgtgcagaacccttcaacgcggttggtaaatagttcgctaacgcgttgtcgtctgctccggcagcatagagcactgtcgagtagacttgaaggaattcttctgggtcggtgctcccatcatactttttaatggctctgggtcggaatctctcgggccatcggacatcacgtagggaacgaccgaaagccctacacccagcgttgggggcggtgggttgtcggcggtcgcgtgaccttcgtggatgtctgtctgacgatgaagaggatgcggatgatgacgatgacgatgggtcgcttggttccagcgtacggttacgaggatgatgacctggatctcgggaatcctctcgttgtctctcgctgttgtctcggcgccgatctccatcgtcgtcgtcgttgcggcgacggccatgaccagtattgtctggcccccgttgttcgcgatcgttgtaatctcggtcctcgtttgggcggtttcctcgatcatggcgccgtgaagagacatgacgccgagagcgatttgcgtcgtcccgtgtgcgtcgtgcttttcggcgaccgttgatttgatctcgaagatcgccagtgccacgaggtggaggggtagcctgtcgaggtaattccctctgctccggatcttcaccattggcgtcgccgattcgtggctgatcttggtgtgctgcggtagcggcttcttcaaacgcgttgctgaggttggtcatcgattcccgtaatcgttctatccaacacttgaggtcgtcgttcagaacgggatcgtaaggagtttccctcagtatagcttgaacagccctgatgtgctgggctggagtagtcgattgattcgccgcttcagcgttggcttgcgctgacgtgccaacgccatcgatagccaatacctcccgcggcgcacttgttgtcgatgac

SEQ ID NO: 65838 - DNA, 7031 bp, Oryza sativa
gggcgcgcccagcggctgccagatgggcccggccgtcagccgccagcgcccacgggtgcggctgacgcgtgggacccacagcgccggccggcgtcagccgcgtgcacccggtccaccgtggaccgagaggctgacgcgtgggccccactcccgtggacccggtccgcgcgccctctctcccggctgacgcaataaacgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttctttttcgttggtcgtgtagacgctgcagcttcggaagatccgctcttcgtggaagttgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcatggcaccactagtttaaatttaggtagatgcttcgcaatttaattaggtaacattaggcggttttacaactatagactttgggaaatattcatatcacctggatactctggaattgttggattattgtggaattggattcacaccgccccctctattcaaaatccccaaaagtggttttaggctgggctcggggtgcatggttttgatagtagcacctcggccatataaggaccggtcttcgggcctctgttgcaaagcactaccgtacttccacatgtctagtgggtaaggcttagtttgtggctcagtctagtcataaacaatagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccataggcgggattgggtcggtactcttgtctatggctaggatgggttggaaactatgtcacgtctttcgtctgtataccgtggtggtatgtggcacgtggttacacgtgaggaagatgtgtcttgtgggcaaagatgtacacctctgatcagagtataatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataacattgtatagttctaggatcgtgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttctggtcgtggcaagttggtatcagagccccccttgaccctaggacgagccgtagaccccaagccttagcaatattttcacaaataaaaatcctttgttatttgtgaaaatcctctagtctctctctgtcttgctgcttcatttatcaccaaaatctgacctttgaaaatgttgcttttctttttgtttttgtttgtagatggccggcagcgtcacccgtcgtggtttggacatgactggcttcgtcttggagctgcgaggcatgtgcgtggtcctggggtatccacatggagtggactaccaggccaggccgcttccggatcaggagggtgatgatgcggagccccccgctgcttgggaggtcactgcagtgatcctctctggctctcccgagcggacttcgctggcagtcaccgcgggtggagattccttccccgccgcttgccagaacgccgccctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacgccgcggcatggtcgagaacaacctgaagatcctggagctgcgtcaggagaacctgcagctcaagaaggacctggacgcagtggagacgcagctgcaccagctcaagatcgcccagggagagatctgccgccccaagcgtcgccgtgtctgccgcagccagaagatcaccgcccgcaagagcacctccaggcccgagcttgttcgtcagtccctggcgtggacttgtttcgtcgagacccctcgtgccgagcctgcgcccgtggttccccaggagggggaagcctccggcgttggaagcacggaggatgcgctgttgctcaccttccgccctggcccgtcgcagcagtagacgagcagttagtaggcttgcgcgtgtgttcttcctcgtttgtcttcttgttgagtcgtgtggggcatggttatgccggtgtgtggcataactatgtcggagcctgccttattttattcgcctaagcaacttgaactttaatgaaccaattcaatagcagtaataaattcaagaattatagtagtcgtgggtggttcgtttaattgttagctctttccctgtttgctggttctgtgtggggttttcagatggtgacgaccagaagaaatgctgccaccggtgatggcaaccaacccgaaggcagcaaccacaaccaccagggtaacccacctccacctcctcctccgcctccaccaccaccaccagacaccaacgccattctcacccaaatcctcgcccagcaagccaacatgatgactgctttcctccaccacctccaaaatccaccacaacataatgctccaccacctccccaacactctaaactcgccgagttcctccgcatccgcccacctaccttctctagctccaacaaccccgtggatgcgttggattggttgcatgccgtggggaaaaagctagacacggtgcagtgcagcgatgaggagaaagttatcttcgccgcccaccagctgcagggacccgcatctctatggtgggaccatttccaggctacgcagccagaggggcagcctattacttgggcccgcttcaccgccgctttccgaagaacccatgtgcccgctggagtcgtggcccttaagaaaagggaattccgagagttgaagcaaggcaaccgctccgtgatggagtatttgcattagttcaataacctggcccgttacgctccagaggatgtgcgggaagatgaggagaaacaggagaagttcttggcaggaatggaccccgagctgtccgtccgtctagtctccggggactatccggatttccaacgactggtggacaagagcatccgcttggaagccaagcacaaggaactggagtcgcacaagtgccgcttggcgaatttccgcaatcagcagggtgctaaccagagggtccgctacaccaatccctatccagggggatcctcctcgcagcagcaacaacagcagcagcagcaacctcgctccgcgcctcgacctcaattcgtggtgcgcatcccacagccgcagcagcagcagaatcaacaagggactcgtgcgccccgtcctcctacgccaactgtgcagcctggtcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtcattcggggtcgtgtgaaccacgtgacggccgaggacgtgctgacaactccagacgtcatcgttggtacgttcctcgttcattccatccctgctacaattttgttcgactctggagcttcccactcgtttatatctgtgccattcgttgggagaaatcagttgggggtagaaaggcttaggaaccctctgctcatcaccacccctggaggggttatgacagcaaagtactatagccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccagaacaaccggttgttttctttgcacccccaacctctgtcagaagttcagaactgcatcagattggactgtcagaaatccccattgtcagagagttcggagacgtgtttccggaagaactacctggtatgccgcccaagcgagagattgagttccggatagatcttgctccaggaaccactcctctgcataagcgaccctaccgtatggcagcaaatgaactggccgaagtaaagaaacagttggaagagttgaaagaaaaggggtacatacgcccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcaacttaaaggtgccactgtattctccaagattgatcttcgttccggatatcaccaattacgtattcgtgaagaagatattccgaagaccgcattcaccacgcgatacgggctgtatgaattcacggtgatgtcgttcggtttaaccaatgcacctgccttcttcatgaacttaatgaacaaagtgttcatggaatacttggataagtttgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagtcaaattcttagggcacgtgatatcagctaaaggagttgctgtggaccccgaaacagtgaccgccgtcaccgattggaaacaacccaagacagttactcaagtccgcagtttcttaggtttggcaggatactaccggagattcatcgagaacttctccaagatcgctcgacccatgacacagttgttgaagaaagaagagaaatttgtgtggagcccgcaatgcgagaaggcgtttcaaactctcaaggaaaagctggtttcctcgccggtgttaatcttgccggatactcgcaaggacttcatggtgtattgtgacgcttcgcgccaaggattggggtgcgtgctcatgcaggacggtcatgtggtagcctatgcctcacgtcagctacgacctcatgaaggcaactaccctacccatgatttggagttagcagcggtggttcatgctctaaaaatctggcggcactatctcattgggaatcgctgtgaaatctatactgatcataagagtttgaaatacatcttcactcagtcggacctgaatcttcggcaaaggagatggttagaacttatcaaagactatgatgtgggaattcactatcatcctggtaaggccaacgtggttgccgacgctctaagtcgaaagagccattgcaacactcttaacgtccgtggcattccacccgagcttaaccaacagatggaagccctgaacctaagcatagttagtcgtggattcttggccgcgttggaagccaagcccaccttgctcgatcaaatccgcgaggctcagaagaacgacccggacatgcatggactcctcaagaatatgaaacagggtaaagccgctggtttcacagaggatgaacacggaaccctatggaacggaaagcgggtatgcgttccagataacagagaacttaaacagctgatacttcaggaagctcacgaaagtccttattccatccaccctggcagtacgaagatgtacttagacttgaaggagaaatactggtgggttagtatgaagcgggagattgcagagtttgtggccctacgtgatgtgtgccagcgtgtcaaggcagagcaccagcgaccggccggacttctccaacctctccaagtacctgaatggaaatgggatgaaattgggatggatttcatcaccggacttccaaagacccaaggtggatatgattctatatgggtagttgtggatcgattaaccaaggtagctcgattcattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcctatcacccgcagacagatggacagaccgagcgtctaaatcagatccta

SEQ ID NO: 65839 - DNA, 793 bp, Oryza sativa
cacgcacgtccaggaatgcccgttgggttatttccggtcgtgacagatcgatatcgattaccctaacgaatcgatctgaggctggagtcgctccttgttccttgccgttatccctgatggggacgtatgacttaggagacggagttttcatggcgccgaggaggactttgcagctcgagaggtcgtgattctttgtcttgtgaataggacaataaacatcccgagttggagaagtacactgaatttgtcacgcccgaaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagca

SEQ ID NO: 65840 - DNA, 1949 bp, Oryza sativa
tttttattaaatacctgcttaattctataattcctagattcttctgggattatttgagctaaggaagtatttttagtaaatggaattgcatttaagaaataatttaaattgaaaaaggttttaaaagtcttcttttggctttgggccgaagtcggcccaaaacctctcttctctccctcctcggcccagccggcccagtccgcagccgcgcgcgcgcgttcggtcgctgacaggtggggcccgcttgtcggatccgtcttcctcgcgtcgccgccgccgcccgaaaccctagcgcaagccgccgccgtctccttccaaattcggccgcgtctttccttatccggccgaatcgtttgagggaaaatgatcctcgggatctcctctaccttttcttctttggaagcttcgcctaaatcggtttggaaatcgatggattcgagttcgaatcggatcggttttcctctctccaagccgagctttccttcgccgtctccgccgccgtgggccttagccgccgcctccttgcacctatttaaggacccccgagctctcctctacccgtcgccaccctcgccttcgcctctcgtcgtcggaagagctctagcgccgtgtgccctagcttcgccgtcgccgccgccgctccagccgtgcgccgccgtcgtttcagccgtcgccgtcgctcgggaagaccgccgtcgggttcgcaaggtcgtcgccgtcctcgtccgccccttcgcagccgccggagaccgccggagcttcatcgccgtcgtcaacccgaaggttcccgccgcttcctcctcgtcgccgtcgccgtccgttgcttctccgtcgctcttttggtcgtcggtgagttcgccgtgccgcccgcttcgtcccggtgccttccgtttgcgttctcgcgccgccgttcgccggcaagcgtgcgccgcccgagccgtctgcctcgccgagccgccgccgccgtcggtgacgtcattgctggcgtcatcaaggccgtccgccgtgaaccgccgtggacccgatcgatctcggccgtccatcttggatcggttagatctcggccgtccgttcgtgtgagccgtcgcccgtgcgcccggtccaccgaaaccctagccgctgacgcaataatccttcttttccttttcaaaaataattcattattgcgtcataattcaattaaaatcagtttaaaggttttaatccgatttaatctttaaaaattcatatctaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcatttatggttatatttaatggtagctcacgatggtcaatcgtgattggttaattaattacttgcc

SEQ ID NO: 65841 - DNA, 861 bp, Oryza sativa
aaagagaagagaaaagctactagagccatacccgaactcttccgaaggcttccggacacctgatttcaacactatttctattccaccagctagatactactaaactaaacttgagagaaatgagagagctattgcttgaggtctgtgagtgaagtgagaaggcgaggggtttatatagcctcccaatgatggttgtgatggttggaatggtcggaatgatgtgcactagggttcccgaccttccgaaaggttctgataaacaacgatttgggcggagtcgcgacacaaatagatctggcttcttgaatgcgcacgctcttgagccccgcaattgcagcaccatgtctcctttggttatcacccgtgtcgaaacgcggatgacctcgccgagaaggctaatccctgtttgccaatcgaagaacacaaacaagaacgagatagaaaacaaccaaaattgcagatgaatgattaagctcacaagttggggtcttacaaaccgatctagcggcgaaactgttctcgacagaataatctaagcaaaacccaactctaaacgatgacggctactgaataaatgtgattagggacgtcctagggttgtcctagggcacacacccccttgggctaagcccaagacacaattacaaggcccaaaacccaaatcaaattcggactggatgagatacgtggcttgttttgaagattcccggtagctcgataggaattttgatgtgggaccacaaccatctgaaagtagactccataagctttccaacaagtactcatgggccccgaaattccttctagatcagcggctaggaccgttcgaaattgatggtgtcaggagaacaaggggatcca

SEQ ID NO: 65842 - DNA, 3524 bp, Oryza sativa
ttttatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacctctcttctctctcctcggcccagccggcccagtcagccgcgcgcgcgcgccctcgctgtcgctgacaggtgggtcccacctgtcaggcccgtcgtcttcctcgggccgaaaccctagtttcgcgccgccgagctgccgccgccgtcggtgacgtcattgctggcgtcatcagggccgttcgccgtgaaccaccgtggacccgatcgatctcggccgtccgatttggatcggatcaatctcggccgtccgttcgtgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaaaaatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacactgattaccttattccttgataccttgggttatattaatttgactagttgagctttatttatattggttcaactagatattagatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacagctttatcttttgtatagcatggttcattgcggggcaccagactgagaagtggcggagataagcccacgggggtcgctggggagtccatgccttgtttataagggggtgattatgatccaggaaggtgcgctgtagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaataaccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattatattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcttaaatctcttttaatggttctcattcgaaaatttattccagtattattagtactgtacatccattactgtactaatggctcatttttcagcaaaagttttacaatattgttttatttaatcctgctgcaataaaataaatttaacaagttgattttataactttcttttgaaacctgttgttaaaaagtacaaaatttgtaactttgttttcaactatttcaaattatcttgcaagtttggtttactttatttacttaccttttactttgatttctaaactttattcaaattaatccaaaaacttgtgctattaattggatagatgtcttaactctctcctttcacttgtctttagatgccgcgctacaagcctgagtacctgtttggtgttgaagggtttgtccaggagttgcgtactatgtcctttgtcattggatttggaactgcccctttttatgcccagattcgtcatgatcgtcatgaagagaggtgccgtgtcaaagtcaccttaaacagtaatagtgaagatattccatcagtgatgttcgaagctggaggaagaaattatatccatgcatgtcaggaagtggcaaggatcgccataggagagctccgtgaccgctacagtgatcagttggccgatactgagtatcgctaccatcctcgccaaccacagggaagtgaccgtggcagttaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagctagaagacaaggtggatcgcttggagaaggaattagccgcattgaagggagaagcaccgccgcagaaggccaggattcgtctcaccgcaaggaagagaactttgtttgtccctcgttatcaattggcgccaaagatccgcgtggtggagaaagaagttgccccagcaaatcctccggtcatcatcataagtagtgatgaagaagaagaatctaagcgcaaccattccaagattgagtgggtagcaa

SEQ ID NO: 65843 - DNA, 18406 bp, Oryza sativa
ccggcgccctcgatgcaccagacgcggccgcggaccacgatgtgggcggcggagggggggcgttcggatgcggtcgaggcgacgccacgcgtacatcgctaggtcgaaccactcggcatcgcgctcgatccatcgctgggcagaacggacaacgacgacaccgagacaccgtcgccacggtcccggttccttctcgccatcgagcttgccgcctacgccaacggccgtggccacgtccccgtcgcctccttgactcgttccactcctcgtgggtgcgcttccgtgtcgcctacatcaccccactgctccagctcctcgtcgacgcctgcgtcgtgctcctcctcgtccagagcgccgaccgcctcgtccagtgcctcggctgcctctacatccatctcaaccggacgggcgaggcgagcgcggcggggacggccagctcgggcacgtgctcgggtggccaccttcctcccgcctccaacgcggagctcgccccgcctccaacgccggccgcccaacttctctccgcctcctcctccaccggcgcggatctcgcctccccagctgctgttgcggctgccgccttcctcctgccgcagcctcccgcgacaccgctggtcacccgagctcgcctccaccaccgctgcccgccgcccaagctatgcctccgctggcggccatctgagcgagcggcctccgcctaagacgacgacgacaacgcctaagagcgggcggccgagtaagagagaaagcagagggattggggaggggagatggatgacatgtgggtctaggtgtttttttaatgttatttgcttacaggattgccacgttggagctacgtgtgcaagttcaagtcgaaaacagctcaaaatagtgcttggggggggggttatttgttcggtttgcaaagttgggggtgaaggatgtccagatttttggttcaacggggtaattcggtcgaccgcgatagttcgggggagggtaattcgtactttttccttttaagattaacattggtgtcagctgagtaatcagtgccgcattcattgtgctggttgggaaaaccggtacctaagccggttttccaactggcacctatctgtggttctgtagtagtgtaagtaagaagaaaaaggaacagtgtttggaacacttccagctctatctagcttgcgtgctaccaagtatcattggttatcgcgtcatgctacttatgatacctatcatgctactatcgagtatcagctgatactgttaagtataatgctgtgatacgtattaggtatcatgggactactaagtatcacatgatactgataaagtgatactaataagtatcattagtaatcacctgatactagtaaaacaatactagctagtactccctccgtcctaaaaaaaaacacaaaccctgggtttctgtgtctaacatttgactgtccgtattataagaattttttttataatttctatttttattgttgttagatgataaacatgattaatactttatacgtgacttgtctttttaattttttttcataatgtttttaaataagacgaacggtcaaacgttggacacggaaacccagggttttttttggacggagagagtaagtatcattagtaatcacctgatactagccacgtaagccacgcgttgcgtggctcttaaagacccgtttgaaaatgtgtatatatggctcaggccaacggtgccctactattgatatctcgttgatgggcaaataaatagtgacactatagctggtaggtttacagatatcaatcagcagttttttctaaaatccaatggcactgtaaattgaaaaatcaacatacaaacagcttcggtaacacattctgaaagtaacagaagcataaaggaagtagtattatattaattagttcgcttcataatataagatgcaacttaagtatgaggaatcagtcaaaggataacgttgattacaactttaactaataatctgcaatcatatattttctcagcgatctaaagtggtaagtaaaaccatccttattttcattcgtcatttgatcagcctcaagtgatgtgcacttgaatatttagtatttagcagcataaattcagatatcattttagcccttggaaaagcatatatgtaaactgctgaaaccctgtctatgaacaaaactatttttactgtaatcataaatgaatacagtaattcactctccatggacaaattcagcatgatcataaatgaacatagtagcttagcttatttttatggaagaacatcaatcaattgttgcagaaaatagttgagcttcaactccttaaaatagtatagcatgtaggacacagcaacaaaatctagcatttaccgagagaagtgtaatcctaagttttcatgctgttggtggcatgttacggttagggaaatacacccaggatcatttgtgcaaacatcaattgatgctagcgacccaatccctccaaagatattgctgggatattttggtgtgcttgcttgtaatttatgaaattgatattcagaattaattgaaaattttatatacacttcaatgcatcatctattgtgagctgagaagttaatttgagcaacatatattggtcaattttaatttatctctagttaaagtctattagttacatccagcaaacagaaatttctaattaaattgaaagccattggctttaatcttatttggcttaaagggtaaccttccctggtttctgttcaagcaatttatcaagcacgaaacgtgcaaaaactatatatcaagatgggacaactaaccaaatgtttgcatactggctttggccatcttcacacaccgtactttaacactgactcgcaacgaattacctcagattctagcatgctattccagctggtacacaagctttactgggttctagcctccaatgctgcccatgtagcatcttgaagggcgatggccaaccacgcctcaagcccgtcgtcacacgcatgtcgccaagaaggagagcaagggcaacgcatgatgtggagggggaagccgatgcctttggcttggaggtgggggtcgacttcgatggctatctccgatctgccatcgtggatctgattttacagcaccaaactcgcctagaggcagcggcaatagctgggaggaggcatggctaaggcgctcgagctcactggtgaggtggtgcaggatccagtgcgcctattctgggacgcggtcgaaactggtgatccacttcatggtggcggtggggaggttggcgggctggcggcggcagtgtggccgtgtgcgatgaagagacaaggaggggaacattctctcctttttttttggttacctagggacgtggaaggatgtatttgaaaaagagctttctcgaaggatccagaagagattttgcaaatagagagatctgacggatgataatgtccggaggatatatcgaacggtccttgatttctcgatgatgtggcccaatcagattgcaagaaactttagttctttcaatactttagattggtgaagtgatactaccaagtatcaccggatattagtaaagtaatactactaataagtatcactatattagtaatcaactggtaccgatactactaagtatcatctgatactattgttccattttgatctaacctaaccgtttctctggagaggccaaagcagcaaagcagccatcaacggaagaacgaggtgttgctccacttcttgcttcgtcatcggcttcttcactcgttgcatgtttgcgccatcgattatcccgtgcggtccacagcccggcgctgggattgcctggtttcagatagagccacttatggcccgcctggaacctaaaggggcttgcgtctaggaaaatcacatgtgtagtagtgtcgttgccatcaactagtaggtcaacctcttacaggtcacggcggtggcagcaacggtggccgttggcaatggtaccatgcacttggactgtgaggagagcgagcagtgccaaaggttgatagtggtacaacacgtggtcagatcaggcttgcgttggttattagtcttatctgatggaaaataagaaaataacgttcctagatttaaaacgatctctatgatgtggacaagattggagattttgacgactagtatactttcattcacaaaaggacataacatgtgtgcatcatgaggaaaagtatgttggactctggtacacgaaatttgaattcttcttgagcagtccattcattggctgggctagcattgatcagggaccattagaaaaagtcttgtcaccagtaatctcgccgtcccaaaactcatcaactgttttatatggaccggttttgtggacgaagatgtcaagagttcccctccactctgggagggtgcttatcttgtgacgatcatcattggtgagctcccaatcaaagatgcctagattctctcttaacctgctcttgttgaagctcttgacgattacacaatctccttgctcatacacccacctcaagcatacctacacttccagtttgtactttcagttctaaatagtttcatatctagttaataaacatgatatgcacgataagattcactaaacaatgcaacataggtatatatagtattcaccagaacaattattaccataagtttcatgtatcatcttatcggccattaaacaaaccacttttgccttttgtttttcctgctacggtctctaaatataattgcatagctggaagcttaatttatcatagcacatataaaaaattgacatatattgcagtgttctgtttacctgggcaatagttttacccctctccatggcaatctgtttgagaagaggacaatccatgacagcattgttgctccatggtgtaccctttccacctaaaggagagtaggcacagagctgaattcctttctccttgcagaactccctcaatttattttgccgacagtaggggtgcacctcaacctgcaagtgttcatgtaatcccgtgaacaatattaataaattaatcaatgtacatgttgaaatgttttggacaaagagaatagagaaaaaaatgtatatgtacaactataatataaacagtaccaagtagtactaagaaaatgttgtctccatactcataactaaaataccatttttcctttttcctcgcaaaaaaaaaactaaaataccatttccctttttcttcttacaacccctcttaatcttttatgtccttgtctctctcatctgtgcatggccatgacgagtaactacttaaaaaaatactacctccatattttaatgtatgaagccgttgactttttatccaacgtttaactattcgttttattaaaaaaattatgtaattattatttattttattgtgacttgattcatcatcaaatgttctttaagcatgacataaatattttcatatttgcacaaaatttttgaataaaacgaatgatcaaacgttagtcaaaaagtcaacggcgtcatacattaaaatatggagggagtatttgttaagatgatccataagtgatttacgtgggcatttttccaacttgcctgcaaccaagctagggcctatagaaatcatggatttgtgtaggcaaattccaacccgtgcagaaatcaattttcacggtgtggctctctcaaggacccacccatgaaaataaaattccagtttaatttttatagacataaaaaacccacaaaaatgactaaacttcaaaatgttatagaaaaatcactttatgtccgattgaggtgaaccacggttctccatgatccttgtaatatttttcttcatatggttgggtccatatttacttaaaatatttattttaatatggttgctcactgccgtggtctttatatgagttgatatatatgttatgcatcttgacattaatgaatgatcagacacaaaaaagtattccatgaaagtattaatattgtcatattacagaaaacactaatagaatatcgtataactttggtttacctcaatcaggtttaaaataaatatctagaattgtttttaagtttggactttctaaccctcgtaaaaaggaaaaagttcatataaccccctaaacgttgaataaaaatccatataacaccctaaactttacagtcggacatcatccaccccgaactttgcaatacaattcatgttacccctaaattagtttcagacagtggttttgcatattttaaagtttaaacgagcgatttaaaaaaactcgtataacatacttacatacctcaatcatcggtcttaaattatagtatatagtaacatcatattagtattatattggtattcatttattcaagtggagatttaacatatatgtccaaggcatatgtcacatattcaaaatcatccatcgaatatgcaaattatgtagtaatcattttgtaaaaccaccatatgggttacatgaatagtattgtaaagtttaagggttggatatccggttttaaagttcaaggtgctagatggaatttcatctaaagtttagggggtatatggactttttccttgtaaaaatagatatcaaagcttgtaatgaatattaggcacctaaacgatctcatatataaaaactttcaactataaagttgtagatctcattgggatctacaatttcctggtagaacatttctccatccgaagtcatttgaaaactaaaacaaacaatttctaaaatatatctgagaatgaaaaatgaatatttgaacacacctcaacaatctgaaataaacgaactttcaactgcaaagttgttgatttcgtcaaggtctacaattctcatatagagtttgccatcatctaacttcatttgaaagagttacttttttttcatatttgaaattataaatgatctcaaataaaaagactatcaacacaaaagttgtacatctcattgagagatacaattttcatattaagtttgtcgtcatccgactttatatgtagttgcaatttttttttcatattttagtggtattcccatattttatgatggttttcttacttacaaccatccgctaaatatcgatttttaaagactgatttcacaggtatctgaatgtaaaaatagacttaccttcatagctagatggatttcttagatacccgtctgtaaaaagtaggttttcgtaggtgatttatgacctgagacagtgtcaattatttttgcaggtgtattttttcttggctgccggagaaaaaaaatgatatcttcctagaaacgtttcttagtactgagacatatatgcaacggaggtgagagggcgaggcttgattggacattatggctgagtttgacagttacgtgggctctagctgatcgtgaagcttgaccggaatcgccgatgtggacacttttttttttcattttttaatattgttatcccactaaataatgctaatgggtttttctctagttgatggtatatatatagatgcaattccaaaagagtcaagattattataatgtataggaatgtttggaacttttacttgatttgctgcaggagagatggttgcgaaggagagcaatgtctcgagcttcttgcaactgaagttgctaacaccaatagccttggtgagtcctagcctttggcactcctccatctccttccacactccctccatgtccatcatcacaaggtcatccttggaatatgtcattgactccggatcttcagccaacctcatgctcaccggaaagtgaatcaggtacagatcgagatactccatctgcatcttcctacaatattcgtacaaatcaaatcaaccacacaagccaaatgcttgatcatatatgcaccctctattttttttaatgttggttagttaaaaaagaaagacaacaatgatggtgatggttccgccatcctaccaccaccgccggttttgctaattggcgcagatgccgagatggtcaccggggcatgcacgcaagtgctgatttatcggtagctaattggcctaatccaattaggatggtgcgattagcgccagcctccaataatgataacggttagtatttcctttttccttttttgcgggactttccttttttaccggagatgtttactttggttagttgtagataataaccataattaattttttttatatttaatgatcttcttttactaatagattaaaaagaaaactatacgtaaagttaacttttgaaaactttttcaatccagatttaaaaacttaaaactttcaactctaatttaaattttttaagtcaaattttaaaaactttcaacttgtagtctcaaatttgaaaaattttcaactcaaatttgagacttttaacgcagatttgaaaactttcaacttaaaaattgaaactttcaacccagatttaaaaactttcaactcaagatttaaatttttttatattgaaaaatttttaagttaagatttgaaaacttttgaccaaaaaattttttggtaacacgtgtgctaccgattaaaaattcgaaaaaaaaacatgaaaaaaaagaaggaaaacacgtgaggggagaggaagcgaaaaaaagaaaaacgaaaaagatggaaaaaagaaaaacgaaaaaagatactagtgcccatgcaccagttagcatcctggccaccaccgccgctgtcatgtgaaaccactcacccatttccatgcctccctcccacaacctgctgctagtaggctagtttctagcctatttcatttttattttttactatttgtcttttcgtatttctaggcggctagctattagaatttcttgacgggtctcagattatactacatggatcaaatataatattctagctaggtatatagaaaatttatatcgactggttagagtagctacgcagctggacatgaagaatgacacgaataattaatgatcccggtgcaacgcatgagcatatatagctagtccaacaaaataagttgcagttatactcaccggagcgcacgcctaagagatggcaggacatggccggggtgcgcgtgggcaacccatagcttggacgtgatgtagagctcgtcccgcgacgcgacgaggccggcgcgcaccgcctccgccacggcgtcgccgaggatggcctccgtctggtacacggccgccgtgtcgaagtgccggtagccggcctcgatggcgcgcaggacgacatccttcaccgtcgacgggtcggtcgcgccgagcgggaacgaagccgtgcccatgccgacccgcggcatcggcttgccggagctcagagccgcctccggcatcatccccctcacatggtcatgggatcgaaccgatcgagagaaattgaagataaggctcgacagccaattaatctggccatatattggtacgcgaggcctcatatcagcgactcaccgtgtgacagctacagcccgaacgacccaagttcttcatatttttttttgggaaaaggaaaagagaatatttgggtgctttttgtcgacggcactcgctagttgcaacactatctccgttatttaatagataatacagttagtttatttttaaatttctaatatttattcatttaaagtaaaacgagtatcaaaagttctacacgaagcaaacataatatatttttctatttgcacaggacttttgagaaatgatgaatagtcaaacatattaataaaataactacatcatatctattatatactaaaagtccattaaacatcctataaacactattaagccgccacatagaactcccacaatcgctcgtacatcgccacgtggcatttaatcatctagccatcgattttcactaatatacggtgggcccattattttataccattagatttatttatctaaatagaaagggataaaaaaagtggccctcatatcctacccctcccgtccagtacatatgcttgtgtacgtgcgtatgtgcctcccccatatattttatttctcttctatcttcctcttttagttagatggaaaaaacattttatgatttatccaaatacaatgataaaaaaaaggggcccgtataccttccccgcctatccagtatgcacttgtcttttctctcctattttcctcttttagttatatggaaaaaaatatcacctcccccacatatttcttctctcctatttccttcttttagttacatggaaaaaatattttataataacaaattttaaacaattatattatctaaatcatataaataatttttatttgtgctcactattagattattttctgtaaaatttaaaattgaatatccaaattaactatattaattattaaagaaattcaatacttttagtcatatatattctacgaattatagctattgttcattgatccatacattttttaaaaaaatataatatattttaaacgttctgattaataatatgggtgggcaagtttgaccgcaagaaaactaaccagttgaactacgctcacttcataatgttggatataaagacaaccataatttttaagctacatttttaaaatactcctatgccttttaaaccggtagaagcattatttctaaccgttagatctatcttatatagaaaaagtgtttattcatggtacatgacatttcaaaaatattactgtgcaatgataatacttcgtcgttatcgtgttatttctaggttgcgtggagtctctcatctactctacataaaatgttcatagatagatcgcttcttaaaataacccatgtatttagtggagcttcatttcccacccaacatcctttaacatattatgataatatattatacatcaaaagaaagaaaaacaccttacgttttattttacacttactttactttcgttgacatgttttctaagaaaataaatctacattcttttgaaatgattaagaagattataaataattgcttataaatattacttatatatgatataatataaaactgataggttaaaatattattaaacaattaattaacgctaacaaaaataatttatggagaaatcgtggcggatgttctccggttaatatattgcttttataaatacgtcaaaccactactggtgaaagggttttcactcacggttcgtaaccccatatagtcccgattatacaactaggaccacgaatctatctctagtcttgggtaaaataaccagaactaaaaattatctttagtcccggttcctattcaaaccgggactaatgtggtttttgcaccacctagcaaagatcacttctccagtagttaacatagcgtatgacgtacgcccgcgcgaatgcacgggctacctttctagttttataacatttaaaaggaggtatagtccaacacatatttttcatttgctgatatatacatcacatgtactgctagtgtgagagtactccatccggttagaataacatcacacgctgctacttctaatattacgcaatttataactgtgagcaggcagatcaagcaacgcatatattagattacttaaacccgtgggatctttggaaggttagggacgccacgtcatcggttttttcaaaaacaccactcacctctgattaatcacgttttgggttaatcacgttttggaaagtaagtgtgccacgtcattgtatttttttgcaaaaaaacgcctgcacttcctgttaattgtgcgttggttcctgccgctatggtccgttcgatcacgcgcgagggactagcgtgtcccagcgtggctgctcttccaccatcgtgagatcgttggatcagaaacggacggcctagatttggcaagaaccctagccacctcgcgctcgcctctcttctcgctcgtgctgccccaccctcctccctcgtgcgggtcgccgcctcgttatattataaaccaataggtatatagttaatttaggctgtgttcttcccccaattttcccaactcatctctcttgtttaccgcgcgcatgcttttcaaactgttaaacggtgtgttttttgaaaaaaaattctatacgaaggttgctttaaaaaatcatattaatctattttttcttttaaaaaatagctgatacttaattaatcatgcaataacacagctagttttatttttaaacttgtaatatttattcatttaaaataaaacgagtatcaaaagttctacgggaagcaaacataataggtttgtctatttgcacagaactttcgagcaaggacgaatagtcaaacgtactaaaaaataactgcatcatattctaataacatttaaaaggcggtatagtacaacacatacttttcatttgctgatatatacatcagatgtacagctagtgtgagagttactccatccggttagaatgacatgacacgctgctacttctaatattatgcaattttataactgtgagcaggcaaccaacgagatcaagcaacacagattttatttgaaactagcaggtatagagttaatttacgctgtgttattccctagtttttccaactcatctctcccttttttcggcgcacgcttttcaaaccgctaatcggtgtgttttttgtaaaaaaaaattctatatgaaagttgttttaaaaaatcatattaatccttaatgaaacatgcaataatacatgcttcattttgcgtgccagggatgaagggttcccaacccctcctcctgaacgcatcctaaccttgcatcagaaataggtgtggaaaaaaaaaacctcgggctcgtgagctcagcttgggcttggctcgagctcggctcggctcgaatgaaaaacaagccaagcccaagcctcctttttagctatttgttgaaatgagtcaagcccgagttggctcgcgagccgcttgtttgggaatgatatatgtcaatgatttacccctgcttttcctaatgattactaattatatataaagagatgtttcaatgggaaggctcgcaagctagctcaatctggcttgagccaggaaacgagcagagtcgagctcatgttttagctcgtttccttatccaagctgagccaagcaagcctagtttgttgtgagccattacaatctgagacgagtcaggcttgactaggctcgtttccacccctaatcaaaatctatttatcttctattatataataaaaatccattaaatttccttaaaacgctctcaggttgacacatggcactctaaaaatgttctcaagctaccacgtggcgctagaaaatcctaaaattctagaaaaaaacaaaaatatccatccctgattttcacttaaatatatgggtccaatattatacaccgttagatttatcagaaaatactacgttactgtcctctccccgcaccgcaggcgctaaaattccattaaacttccttaaaacgctctcaggcggacacatggtactctaaaaacgtttccaagctgccacgtgacgccagaaaatcataaaattataagaaaaaaatatccatccctgattttcacttaattatatgggtccagtactatacaccgttagatttatcacgaaatacaacgttaccggccgtcctctccccgctggcgcgtgcgtacatgcgccatcctccctcctcttttttctcaacggtagttaattaagatcaaaagtattagtatcgtgttaactaattttaaatagtattggatttatatctccatagggcatagaccaccagggcacatagccgtatctcccagccgcaagtgtactaatagatgtacatgtatgtatatacgtgtatgtgtgatcatttacaagaaaagagcacgtggctctctcccattggctctatcatgtccgggcgtccggttaattcaaatgcaggtacatataataaaaacttactatctacaccttccatcccaaaaaccaaattcatagtgaggatttgacataaccaagctaaaaaagaatagtacaaatctaccaaacaaatcaactaaggatgcttatccaaaccaacatcaatttgggtcgggctgtttatacaagccagtctatacacaacaaacagggatcaaatacaccctaattaaatctacttcctccgtttcatattataagacttttaaaccgtttcatattataagactttcaaacattgacaacattcatatagatatatatttatagattcactaacatctatataaatatgggtaatgctagaaagtcttataatataaaacggatggagtacatagtatcactgttagtgatgtatgaatattggttcatgttacaaaccttcaacgatgtaccattgcctgttcttaacatgtaccagaggtgatcttctcaacacataattggttggaccagcataatattgatcaagaacaattaaggtttttagttgtcaccagtgatctcaccatccccttgactccggattcatggacgaaaaaatcaaggcatccccttgactccgggagggtgcttatcttgtggtggtcaacatcagtgagctcccaatcaaagatacctagattctctcgcaacctcctctcattgaagctcttcacgattatgcagtcaccttgctcatacactcatacacccatcttaggcatacctgcactacaattgcaaaatgtttcatatatatacatgttagaattcatttcaaaattacctacacacacatagtttcactttttcatacatataggaagtgataaactcctagcctctacatcgaccaaggttgtacaaagccaaaaaaagcatgacaaaaaaaggcatggtgttcactataatagatatattggcattatcattttgtcaaatacaaatataacaacaatttctatttgccatgggtctttttcttcttatgatatctaaatttaatcagttcatccaaagcttatcttgttgtagctgatccaaaactgagatgacatagtatagtattgtgtttacctgggcaactgttttgcccctttctaaagcaatctgtttaagtgggcagtccatgacattgctacaccatgaagtgccatttgcacctaatggagagtaggcgcacatttggattcctttccctttgcagaactccctcaacttattttgccggcaataaggatgcacctcaacctgtaaccgttcgctgatcacaataagtgattgtattaagtattaattaattatttcttctgagaaaaaagtcttgacaaggataacatgtaggtcagtatttataattttaactagttaacgatatatatatatatatatatatatatatatgtatgtatgtatgtatgtatatatatgcagtgtcacataaatggtgccattgaattggagatgtttaaaatattaaattctgtacaaggtaatgttatggagtgaatgaagttgattaaaaaatgaaattcaatcttggagaccatatcaaagagctaatatgccttacttttctcaatcaaaagattaatatgtacatatgtgtggaacaaaaattgatactgctggtgagcccacttttgttttaggaaaaataaaaatgaagaggggcagtgatgccgttttctatatttttttctctcctagttaactcgatatattattttaataggagaagtgtccattagcaaataaccaaagttttagagtatcttttagcatagccacatttttacggtatctcttggcaaataccataaattttggatgtttagtagcaaattttgccaagattatattgttttgtacaaattacctgatttgctgtaggagggatgattgcaaatgatagtaagggtatcaagcttcttgcaggtgaagttgggtaatttggaaccatgccattataattttacaaagtttgagatatgccatcggtatctcaatgacatgtaggacccacatgagtcaatgacatgtgggtcaggatggtatatctcaaattttacaaaattataatggcatggttccaattttccctagaataataaatgggctaggcccgatttattctattaaatctcaaaggcccataataaatgttaaggataataataccaccttgggaattaaatgaggagtatctcaacttaaatagggagttattggaggctccctattgactggttgaggtgaggatcggaaagccacacgcgcgcgcgcgagccgggcgggcgtgggggcgaggcgtgcggtgcgcctacgcctgtctctatcctttttgcaatggaccatcccgagattgcctccgtaatgagattgccttcgtaacgggcaggcgagtcaattccaattgatcgcgtcgttactgcggcaaagggcggatatcgctcctacgctacaaggaaagatctaatccgatcagatgcggctactcactttccatctgttgttcttcctcctcctcctcgtgcacgcctgagctgctactgttctgcttccccgcttctgatcgcttgtgcgcacgagaaatcggaacaagcagggcctccggaaccataccttcgcctgagatctgcaccgggtaggcaggtgatcaggtttttggggagtgcttctgcacgattgctcctcttcatcgtcgtcatctgctaccatgtctggtgccgccgtcgccgctgttgctgctgccacacctggagatggaggcgcgcctgtcgacgggggatacccatagaccggatatagagggtattggggtacgctggtacgaggatctacgtagtacgatatcaagcaaacaggaaacagggattatactggttcaggccccttggtagttaatagccctaatccaattgatatgggattatatgatggaaaccacagattacaaaaggaatagtaaagctcgatgataccgacaggatcgtagtcgagttgatccgactagatctcccggcgacctggctttgataagctccggcttcgtaggctgtggtagatgtgttggctctaagatttaatgccttaggtcctcccggggggtcccttttataccgtaggtcaactggtctccatgtaggactcagagacatcggacccgacatgatataatgacggccgatttctatccaagtaggactctttccatctatagactccatgatagacttccttaacttatgctgagaacgtccgtatatgcgcaaacataccatatcgatacgtgacgtatatcgaagggtagagggtataccttacccgtaaccctgacaatagtgtcgtaggctctccagaccttccattatatttgagagatgaagtgaataattcaagtcatcaaacaagcataatgaaacatccgatgcctcgagagaggaatattggagacattgctgggcccttagcctgccagtcaacttcagcctgagatgtgcccgtcaaaccactcgaaggcggcgaccagatgtgttacacattcaagagacttgacaaaaatggctaaagatctacaacctctcaaatattcctaactcatactcatgtgaatctagttcccaggatgtgcactagatccacactttcatcttaagcatgattatacatagcaaacacaactaagatgaaagaaacttaagacttacaacaacttaataattacataggccgaccggccaaatagacttattagagaacagtggaagcttgactacccaatcacaagcacaccgactaggggtttaccccattaagttctcatcctagaagaaacaatcggaactcgcatcactcaaggactaagactaaacctgcaaacaaaaggttatatcaacagcaagagtcaatacattaaacaagttaatgtactagcaaactgtagcgcccgttccgtcgtggcgcctagcgggaaaactatctcttaaaaactctatttgcgaaatctgttctttgcttgttgtctagtgtccgtgccatctcagatctgaaatccccgatctatcgtcgagttcaatcccgaatccaaatccttcccaaatcaattcctccgcaaaagtctattttgcctcccccgggttcgatgggccgaatctctctcggcccatctccccctccctacccggcgctgtctctctctctgtccctcccccctctggtctacccgcgcgccgcgcgtgcgtgcgcgagagccgcgccgagcgcccctccctcgctctgcccgcgcgtgcgcgagagccgcatggtcgccgcccgtgccgcgcctgcgccgtctgcgccgcccggccccgctgccctaccgcgcagccgctcggccccgcgaaccagcgcgcgtgcccgagctgcgccgctcaaaccgccgcgcctcccgttgtaacccgcgcgcgcgtgccgtggtggccgaccgcctggtcgccgccgccgtcagcctctgccgcgctagcccgtgcctgc

SEQ ID NO: 65844 - DNA, 4092 bp, Oryza sativa
ctgagccgtagatagtgaggcgttcatggaggagcccaaggatgcgaaaacgacggagtggacactatgggaggatggcgtgctgctcccactgagcaggaggaggacaagccacttggccgtggtgaggttattgtgcactacgaatgctcctagcacaaccaattgtttgtggcttcagcttcatcgccatcgcctagcaggcacgcgctgtatggttttctccaagctagcagctgtggacatgcgatgacggaatgctggcacttagttttcccatcttcttatctaccttttaggcccattattttttagctttctaggagtgcttagaaatggcatggtcatcagctccaacccaaaggacacttggtttgcaccggtagatatactcatacttgctttatatagagatgcggaaacgacggagtggacactaccggtcgatggcgtgctgctcccgctgagtaggacaagccactttgcagtggcaaggtcgtgcaccgtgattgatcctgcgatagccatcgtcggtgcattcatcttcttcttcgccattgcccagcagacatgaatcgtaggattttctccaggcaaacaacggtggatgtggtgatggctaaattttggcatttatttttcccatcttcttgtctaccttttaggcattttttattagttttctaggagcggttcgaaacggtatggtcatcaactccagcccaaagaacgcgtggtttgcagcgataggcatactcatacttgttttatatagagacacgaaaataacagagtggacactacaggtcgatggcgtgatactcccaccgagctagacaagctgtgaggtcatgcaccgtgattgctcctgccaaagccatcgtcggtgccttcagcttcttcgccattgcccaacagacatgaactgtaggattttctccagacaagcaacggtggacatggaaacaactaaattttggcatttatttttgccatgttcctatctaccatttaggccttatttttcgtatttttctagcagtgcttaccaacgacatggtgatccactccagaccaaagaaagtttggtttgcacagggcggtatactcatactttctttgtatagaggcgtcttggcaaagaaaaatgtgtatgaaaggttgctcttaatgactaaacaaatccattcagttttataaagtgaggtttaagcatactagaggagagcaaagtggtttcaacacaaaataaaaatgtgtcttccagttttcggttgcttgtgtgagaatcataacagaagagaagtgtgctataaatttatagctaattgtagcacagattccaagacgctgtgtatacgagaggtgagactagatattaatggtgtaatatacatgaatttataggtaagaaggaaacatatcctatgcacacaaagcttcccgtgcacaccaactagcaaatatcacagaaaattctacaaaaaaattggacattccctcctaatagtattacacgttcgtgtgaaatcttattttcaaattcattatattttagctgtaacaaaaaaagataaaattctgacagatttttacccttaaaactgtcatatttttttacttttttgttacagctaaaatataatgaatttgaatacggtactttacagatatatgtaatactattaggagggaatgtccaactttttgtagaattttttatgacatttgttagttggtgtgcattgagtatgcacgagaggcttgtgtgcataggatatattcccaggcaagaataggccattagattagctatagatcactacaagagtgcaattttcttggcggtccaaccgccaagtctaaaaaggcagggatattacgatttcttggcggctaaccataagaaaatgtcttcttagcggtccgccttttaagaagattgtcaactttcgaaagcgccaagaaaaataaaccttgttgctttggaccgacaagaatatactttactcggcggcaacaaaactttttattcttaacagtcagaaccgcctatgaaatttcttattctattaaagatagtaggtgattatactattaaacttgctataaatgcatgaaatacattagttagtagaggtaaatgcaagcaatccacctcagatgtacgtgggttaaaaaaggggcaaaaatgtttctagatctttcattttttttctttagcactgtactggttcactttataagcatctaataaagtttcctacgtttcggacccccttcacttctccatcataaaacaattcccaatatacgtaagttgtgttttgtgtgctgagtattatgtctgtaccgcttttttttcaaacatacatagtcttatagcatcacaaaaagattacgtataatcttgcccaaaaatttattgttgacttcccccaaaaatttattgttgggcttcctaaagtgaaaatagcaagtaaaaaaaattgatctctccgagagagagtctaaattttatcaaaaactaaaagtgggcccaattctccattttttttctccatatacgcagattagattgcgtgctctcctggcgcgggagagtcacggttgggagtcggaggggagcactccctctccctcaaatcaaaggggcgagaaatactggaaatggaactccaaaacatgttgacgactgtagggttcaaatcaaaggagcgagaaatacagggaaggaaactccaaaacatgttagaggactataagggatatgttggatccgattttctaccttaaaaacccttaaaattagttttgagaagaatataggagaattgttagtgattctcttaaatattttctttcggctgtttagttcacgataccacttgtcgccgtagcgttagcacatgaatattcctaataccagtcaataaatgggtgatgggtgtgtttgatctctacataaccgggaaagtaaaatttcaaatatgttattacacctaggaaattcacctctcttataattattgtgtttttttatcagtgtgaggattttttgtttgaaacattagcagtgtggggattgaaaaaaggattaattggtaacaaggatttgcggaaaattgactcaccgttatgtggcagcgatatgagatgaccgccaaaccaagagcacaaatcatcttaatttattccattgtccgagaaagtgagcaaactaccaaaaaaacaagagaagttggtgattgtcttgtttgattaagcacatacggagtagatttttagaggaagcaactcagaatcgggcgccgatgggagggagaaaaatcggacgccgacgtcatgctgacgtcagtatgatacatgcgtgcaaaactactttaaactatttttctcttaaattatttatctaaatcatcgttgcaattaaatctttaaaacaataccacacatggatatattctgacaaaaaaattagcttattattgaattattttaaatgttgcaacgatgttccaccaagtatattggaattgtttcattaagtagatcgaaaatgtttaaatagtttaaattgggcgttgtttcaccttatataaaaataatggttcagtaaatagcgaaagaatgtttcaattcactgtaatatttgatccatacatagtaaaacgttataagtacactaagtgaaacattttttatgcaaaaaaaaatgaaacgaattcccttaatagagggtttccaaaatatgtgggtgatttgttgcaaaggaatgttgcaattcactgcaacattagatatatacatagtgaaacattgtgagtacactagatgaaacagtgaaacattatgagtacactaggtgaaatattttttagggaacaaaaaatgaaatgaatttccttaatagaggtttttcataatatgtgggtgatttgttgcaaaagaatgtttcaattcactgtaatattatatctatatatagtgaaacattgtgagtacactgggtgaaatatttttttttgagatacatgacaggtggggcagaacacatggtggggcccgggggtatgtgcgcgtcgggggggg

SEQ ID NO: 65845 - DNA, 8693 bp, Oryza sativa
catgtgaagcttctgaggtcctagggatgacacctgcacggggaatcggatggtggctcaacggagaaggaggatttggcggtggtgctcagcggccggagttggggaagacggagtcgatctcccagcttgctccaccgatcttggtggttcttggggcgttttgcagagggggacgaggagaccttcacggcgtagtggcttggctcggggcggacaggttcagccgggcgacgatgacgctgaagcggcggcgaagaccggtgcgcgcctcctcctcgccggcgcctgcggaccccatgccgacgcctgcggcctcctccgcgttggcgcctgcaacctcctctccgcgccccgcgtcaccgccgacacctccttggaccaccgcgccgccaccgggcattgcggcgccaccgctgtggatcaccttctcgcagcagtcgccgaccaagagaggtgcgctgtcaccgggagagccgcctggatcgggtctagtgttagggattttcaccatttcatctcccttttcccttttaccgtgaaatactgggtatgtatatttgtgagtgagggaaatttggtctttgtaaaaaaacataacggttgtaatggtgtggaatcaacgggatgttgacggtgatggcatttttggaagaaatatgcttgtacaatggtatttttgggaagttgcacttgtcgatggcatttctaggataagggtgtttgttgatggcatttcatggattttctcattaattaaataacataagaaaggatcccgaatgcttacttaatagaagaagtttctccgaacccggagtagagtgtaccgacagctccggtactcctctagaattcctcctagaaagctacactcgtcgaggtagaagtcggagagagcaccaaacttccgggcactcatccagagcttcccctcactctacctattttctaatatacaaaagatacaatagagcctcttgatttagctcaaagttgtgtgttttgaagtgaagtgagcttctccttttatagtctccatatgacggttacaactatgggaattgtccaaaacaccctccaacgatcattgggaaaaaatcaggagtgtacacatggaggtgaacgggttcggccgaacccaaaaatccacctcccggtctctcttttggctaggaggttgcttaatgggcacccaacatcatgtactatgatttggcccaattctaagtggttttgattgacatgtgggtcctccaatccatgtaaatgtatcatgattgtccggaggtgtattttgttgcatgacagacgtgttttctccttaatatgcatgcatacttatatttcaccaacactagtggaaatgattagtaataatacctaccactaagttggataccatatattttatttcgttatatgcaagtattgatggtcagatattatgatttaaggaccgtcaacaagttagatggctttgcctctgcttttcaaaaccagctaagttttaacaaaatgctagaaactcaactagctcagatggctactcttgtccctgctaatgaatctaggaggattccagggcaacctgagccctctctagagaactttaatgataaccacaaggggaggaaaatccactcgcgaccagccacatcctaacactgcaggaacaagaaagaacaataaggaggcttcaccatctaacacaaatggagaagaagagacaattcagcgggagaaggctgcgccgcaggagtactgcgacaccaacctgctgccattcccccagcataaccggaagccatccatcgatgagcaattcgctcgctttattgaagcgatccaaaagatccacatcaacatacctattttggatgcgatgcaagtacccatgtacggttgctatctaaaggacattctcaacaacaagcgaccgatgccaaccgcggaagtggtgaaactaatggaggagtgtagcaatgctatactcctccaacttccggagaagaagaaagatctggggtgtcccacgaacaggccttgtgcgaccttgaagcaagcgtgagtgtcataaccaaggatgtcttcgacaaattgaactacacagtgttcgcaccaacactgatgcggctctagctagccgattcctcggtccgttacccagcaggtattgctgaggatgccctagtaaaaattcgggatttcttcatcctggtggactttgtggtcttagacataaactctgacaaggagacgccgctcatcttggggcgtccgttcttaagcatcgtggaagccaacattgatgtaggagctggagaaatccggctcgacctcaatggaaaggaggagaagttcgaattccgaccgagaatagaacaatgctctatggtgaagatcaagtacgggccaaatccacaaaatatccgagaggtcgaagttaaaccctcaaagacggatagcctcattgcattcatgaagaacttcctggagaaggaagcgatgggcaggcaccgtccagatccaaaggtggcatcaagaacgcaagctaaaaagcctgtgacaccagccgccaagaagccacaggatgcacccaagacgtaaaatgactagcaagtgaagaaatcgacacccactctctcacctccggagcagggtgccgcatcatcaagctaagcatgatggaggtatggtcttgctcgtcggactaaaaacgacgttgcccttgccaataggtaatttggtatgtatctcatatttgccttttgcatcaaaacatgtttattttttcaaaattttgcattaggaataaatttgagacaaatttataaaaatcaaattttgagcaaaaataaaataaaattttggccaaattgaacgtggctcccactcaacttatcgttgggagccaacggccaaaagtgggcccagttgggcctaccaggccttgttcggccaaaccggccaggcaacggtcagttgtggcactttcaggggcaacggctagtaggtcccacatgttagttctagccgttttggggcctctataaaaaggaattggctggtggaggagagttcaccccaaattcaacatagtttcactctctcacacactctctcgcgctctcaaattcatctcaaacctagaggagttggtctcaagtttatttcctgcattttgattacatttttagcatctacgagtggctttggtgcaaggctaactggcgggtagaattaatccttgttactagcttaacccccgctcgagtttgtcttgtgctcttgctcattttgtctgcaggcatgaagagacgaatcacgcacttgtttaataattggtcaagctgtcaatcaagccatcaccaagaagagtcgagtgcactttctttcatcgaggtctcgttggaggaagcagacgctttgccaagactgcttagcgactcagacctcaacctcaaaggtgagcgggaaatgcaagcctatcatatgctcaaggatcggccgtttgctcacacaagagcatacgacccagaacttctttagaaaataggtatagatgttgatttctacattgtttggaatgctttaggatgggagaaatttgctgtggtaattaagcaatggttctcgcttacttaccttgcaatttctaggtaccttgctagaagtagatgatggcattttgtcacgctcggaaaatagaacactatattccgtttgtgagtgcataaatccttgtcctatgaggcaaggtacacattacaaagttggtaaataacaaagtatataagcaaaagcataaatagagtactttattacattggcaaccaaagttccaacactaaaagataaacgataaaagccgaaagctatgttgggccaccacaggcgcttgatggcaggcacgagctagacatcaaagccatcatctccaaagtattcctctgctggaagggggaaaatggagcaaggctgagtacaaccaccatactttgcaagccatgccgggaaaatgcaaatataatgcaagtgagtacaaagaattcatttataacgttattttgcagaaaactattatttcaaagcatgtaaatatttaactgtatttgaataaaacacgaacctatctctagtcaattattatcaagccgcgctccaacgcgatcttgcctttatgcaggccaaaaagtgataactccaattattcaaatttcaatagaattaaactctaactagggtacattgcttggtttgcccataaccgagggcgtggctattcaaatagattagaggtgtacatcgttacccaccaaacccgtcttcctcacatgttgccatgtgccacatgccaccgcggcatatgacataagctatgacataactcatcgtttggtaccgccctaaacaaagaggaccgacatagacttcccccaccaggtgccctaggtcaagcaaacagtctatgcccccgagcatacagccagagacgtcgaccccatcaagggcttcatccatccctatccgtgtcttccttgtttatgaccgtactagacgatgcattaagcctttcctattagacaggtggttgtacggaatatgctttgcaacagaggcccgaagactgttacttatgacggccgagatgcgactagcgaaaccaagcaccccaagcccagccgaaaacatgtttggggaattttgaaggggaaatatcatgtcaaggttaaacagccactaaaccatattaaccattatttaaaagttattcccaaagtctaattattggaaaacatctaattgtttctatttaagcgaggctaagcatatccctaaatttactagtaagcaccacatacataaagttcccactagttttattttcctagagttatcaaggatcgtaataatacaagtaataaagctaaaacaaggagaatcggtaaggctaaataaaacagtgataagcgcggaaatttaataaagtgaaatgcaataatttaaataaacataattttataaattaggacaacaatatgatcaaaatgacatgacttgccttgctcgctaccaaaatcttcaaaatcaacctcgaggtagagcatctctccggatctgcagcgtctacactgcatacgcaaagaaaaagggctaaaacataaattaaaaccatataagatgcagaaacaaagcactaaaatgggttctttactgattaagggaaaattagcaatttgaacgagtcaattccgagttcaaatagtcaatatatgaccatttgaattttagatgttgtctgaattgcattttgcgaatttgtggattgattttgtaaaggaaacctactgagtgtgcgtgctgaaacagcaaagagagaaaaacagagaagagggagagaggtggcagaggacatggcagtcggtctccaccggcggccatggcgcagcgacacgggagaggtgagggtggcggcgaggctcaccagagcagcggggacggcaatgaaacagtgatggtgacgagcttggttttttgttgatgttcgtcattgtctccgaggtcttgatgttctttttttgttgttagtttcttcttcctctttggtttcattacctggtatatctcaaacatgaggtgttagagccctgttcttcgaagaatcccaggcatctcccgctcatgacatttgcggtcatcgttgttgaaattcttggtgggaaggggtacaacctgagccgtagatagtgaagcattcatggaggatcccaaggatgcgaacactaccgaaggatagcgtgctgctcccactgagcaggagcaggacaagccactcggccatggtgaggttattgtgcactgtgaatgctcctagcaaagccaatcgtttgtgccttcggcttcttcaccatcgcctagcagtcacacgccatacggtttttctccagtctagcagctgtggacatggcgacaacagaattttggcacttagtttccctatcttcttgtctaccttttaggccatttttttagttttctaggagtggttggaataacatggtcatcaactccagcccaaagcacacttggtttgcaccggtaggtaatactagtacaaaaaaaatagaccagactgacggtccaaccggaaaaaaccagactcagagtaatcacggttcggttagataggaagaccggacatgcatttgaaccgctttagaccagatgaactgggaaaaccggcaccggtcaaaacattaggtccgatgttgggccattccaagactaacttaacgctgttgggccataaatgagagtgcccctttggtttttttttgtgcaaaaatagggaacaaaggtgctctagctaggattcaacctcaggtcactgagttggagggaaaagtcactagcctttcgactagcatggaaaatacacataatacatgtaagatacaaccacggttcaaccgtcgggtcaacggttggattggtggaccggtgaaccgagaggtcggccgggtcacccaccggtccggctttttacactatggtaggtatactcatgcttgctttatatagatatgcggaaacgacggagtggacactaccggttgacggtgtgctgctccagctgagtaggacaagccgcttagcagtgattgctcttcccatagccatcgtcgatgcattcagcttcttcgccattgcccagtagacatgaaccgtaggattttctgcaggaaagcaacggtggatgtgggtacggctcaattttggtatttatttttcccatcttcatgtcaaccttttaggcattttttattagttttctaggagcggtttgaaatgatatggtcatcaactccagcccaaagaacgcgtagtttgcagtgataggcatactcatacttgttttatatagagagatgcgaaaataatagagtggacactaccggtggatggtgtgctactcccactgagctggacaagccatgaggtcatgcaccgtgattgctcctgccatagccatcatcggtgccttcagcttcttcttcgccattgcccagcagacatgaatcgtaggattttctctaggcaagcaatggcggacgtggcaacaactaaattttggcatctaatttttgcatcttcctgtctaaaatgtatgcctttttagacaatcattcagttttataaagtgagttttaagcatactaagaaagagcaaagtggtttaaacacaaaataaaaatgtgtcttccagttttcggttgtttgtgtgacaatcataactaggcttttatttttgaaaatatttggtaatagctacaaaataaagaactgctcattcgttgatccttcacacagcaataggacaaagctaagagtacatcctttttagaagagagtggtcgctgatatccaaattccgtaatgaacttgatgaaatttcttgcacatgaatcaaacaatctatcactagtagattttacaaacaagcatgtgttgttcaataaatcaaataccatcacatctagagaaacaattgtaagctccatatttttctactacatggctcgagatcacgagaaagaatactgcaagcacaagcacatggtcacaacctgcttgagctacgccgtacaaattattcaaagttacatggaggtccctctgttctctatgtctatgtctctgtctttgtcattgtccccgagttcttgatgttcttttttgttgttagtttcttcttcctctttggtttcatcacgtggtagatctcaaacatgaggtgtgagagccctgttcttcgatgaatcccgagcatctcccgctcatgactttcccaatcatcgttgctgaaattcttggtaggaaggggcacgacctgagccgtagatagtgaggtgttcatggaggagcccaaggatgcgaaaacgacggagtggacactatgggaggatggcgtgctgctcccactgagcaggaggaggacaagccacttggccgtcgtgaggttattgcacactacgaatgctcctagcacagccaatcatttgtgccttcggcttcgccgccagcgcctagcaggcatgaatcgtaggattttctccaggcaaacaatggtggctgtggcgatggctattttttggcatttatttttcccatcttcttgtctaccttttagggattttttattagttttctaggagctgttcgaaacggtatggtcatcaactccagcccaaagaacgcatggtttgcagcgataggcatactcatacttgttttatatagagatacgaaaataacaaagtggacactacaggtcgatggcgtgatactcccactgagctagacaagctgtgaggtcatgcaccgtgattgctccggccaaagacatcgtcggtgccttcagcttcttcttcgccattgcccagcagacatgaaccgtaggattttctccaggcaagcaacggtggacatggaaacaactaaattttggcatttatttttgccatgttcctatctaccatttaggccttatttttcgtatttctctagccgtgcttaccaacgacatggtgatccactccagaccaaagaaagtttggtttgcatagggtggtatactcatactttctttgtatagaggcgtcttggcaaagaaaaagggctgcaggaat

SEQ ID NO: 65846 - DNA, 13076 bp, Oryza sativa
cgttgtcagtagcacacgcatctaggcggcggcggccggtgcgcgccgcggtggcggccaccggcggcgatcgaggtgagcgtaacgtggcggacgagggtggccgcagggatcgttggatgggggatcgatggacctatttatagccctcgatggatttagtgtgttaaatatagtacggagtagttagcaacagaactaacagaccgacgtacggatcggttcatcatatccaccgactcaaacacgtcacagtggacgccgatacttcgtttcgtggtacgtacgtttagacacgatcagtttcgttcccaattataggaaaggttttcctttaaaaaaaaattagtataggagagcacgtaccatgccgtcttttaaggttcagttttattttatttttctgataaataatccctctatacaattatcaataaaatcaggtcatatctttgttcgttgaaaagatatctcctgactttgtgtagtttacagttataccacggaccccactttactatagtccacatgttacgcgctggaaagcgatctcctgattttgtgtagtttacagttataccaccaacctcacctacatgttactgcaagtcggccggtctcttcattcgtctccgttcggtttttggttttgtcgccgtttttcttttcaatccttttttttttttgcacgtggaagggtttttatgggtggacccgctttactcccgttttttttaccatccggtagttctttcgtcgctggtttttccttcgatctccagccgccgtggagccgaaccttactgcaacttcgatttgcctctcgatgtttcttcctccaattaattaaaaaatcgattatccactcatttctcattattttctccatgattttgtctttcaattcgacttaaatttggaaaattatatccctatttaaccgttagtggccgtctttttcccgagttttttcaattcggctttaaatcttccctgatttccccttttaattcgggaaattcaattcctatctagagcaagtacaatagcaggttacaagtcaactataagcacatatatgaagtagaagagaggagagtcacggctttaattcggggaattcaattcctatttagagcaagtacaatagcagaatacaagtcaacaagtaaactataacaccatatgaaagagagaggagagagaaagcgtgctacagattggtagcgagctactacacggattccaaaagttatatgtgtataagaggtgagactatatattaataatatagtaagcaactattgtatgagttgactattaaattggttataaatgatttggatttagtagttagctatactattaaacttttgctcttataagtaactatttgatagaatgagctattagattgactatagatgatttggagccagtggttggctatactattaaacttcctctcaaccatttggagccggtggttagctatactattaaaacttgggagaatttgaaccatgccacacaaaattttgtaaaatttgtgatatgccaccctgacccacatgtcattgactcatgtgggtcctacatgtcattgagatacgggtggcatatctcaaattttgcaaatataggttggcatggttccaacaaacccaatccgtggtagatgatgtccggcaagcgagcttcctggccatctttattcccgagttttacatattttgattttggaaaaaaaaagggaaagagatgattgagtggatcaaaagccctaaaccaattttaaattttaataaataaagaaagatcagaggtgattgagtggataaaaaccctcaaccaatttaaaaagatcaagaatgatccaattttaaaacatctttgccgaatttgatgggaatgatggcatcggcatcggcatcttatggacagtatgtgcgagctgagccggcttctctcgtggactggccgtaaagagactgaaaatcgtggactgggccgtaaagagactgaaaaggaagaaaagattgggctttagtccaaaccgggactgaaaatgaagaatttattagctttcagtaaaaaaaatatttttcaatttatttctcacctcccaacaactatatattctatttctgaaaaaatatctttacttattacaacgactgacatttttcatagcattagagaaaaaaaaccatgcatgattatgtgttgcaaatgctccttactcccgtagcacggatgaatgatttacgggattcagttttatctaatttttctcattttatctgatttttgtatcgagttcttgtttatcgtaagaggatttagtatgaataatttcacattataataggtgtgaaataaattctctaaatcaccctgagattaactgaacaaaatcacccctggtgtgaaattaccctcaattattttttgtgtgagagattaaccgagcaaaatcaccccaatccttttgtgtgagagattaaccgaactaaaatcacccctcgtgtgatagattaaccgaacaatgcaaaatagaaaaatatccccaaccatatatactccctctatttcaaaatgtttgacaccgttgactttttaacacatgatcgttcgtcttattaaaaaaatttgtgaaatatgtaaaactatatgtatacatcaaagtatatttaacaataaatcaaatgatataaaaagaataaataattacttaaattttttgaataagacgaatggtcaaatatgtacttaaaaaatcaacggtgtcaaacattttgaaatggaaatggagggagtatggattaagaaagacacgttaaggatacaaggaaccctaacaaacattgtgtctcaaaacggcagcaaccaatcgtagacgcgatgatggcccacgtaatctgatttggttatacaaacgtgttgccacactgtggcagcctcctcctccgtgtacttgtgaacgctccagctaattttgtcatacacgcctagcacactagagtcagtgtcataacgcaagctaccacacgtagctgataagtccgatcgtcgccgcgcgccgcgccatggtgccgtcgttcccgcagccggccagtgcggcggcggcgacgcggccaataccggggagctacggcccgccgctgctcggcccgctccgcgaccgcctcgactacttctggttccagggccccgacgacttcttccgccgccgcgccgccgaccacaagagcaccgtgttccgcgccaacatcccgcccaccttccccttcttcctcggcgtcgacccgcgcgtcgtcgccgtcgttgatgccgccgccttcaccgcgctcttcgacccggccctcgtcgacaagcgcgacgtcctcatcggcccctacgtccccagcctcgccttcacccgcggcacccgcgtcggcgtctacctcgacacccaggaccccgaccacgcccgcaccaaggccttctccatcgacctcctccgccgcgccgcccgcaactgggccgccgagctccgcgccgccgtcgacgacatgctcgccgccgtcgaggaagacctcaacagggcccctgaccccgccgccgcctccgccagctacctcatcccgctccagaagtgcatcttccgcttcctctgcaaggcgctcgtcggcgccgacccggcggcggacggcctcgtcgaccgcttcggcgtgtacatcctcgacgtgtggctggcgttgcagctggtgccgacgcagaaggtgggcgtcatcccgcagccgctggaggagctcctgctccactccttcccgctgccgtcgttcgtcgtcaagcccgggtacgacctcctctaccgcttcgtggagaagcacggcgccgccgccgtgtccatcgctgagaaggagcacggcatcagcaaggaggaggccatcaacaacatcctcttcgtgctcggcttcaacgcgttcggcggcttctcggtgttcctgccgttcctggtcatggaggtcggcaagcccggccgggacgacctgcggcggcggctgcgggaggaggtgcgccgcgtgctgggcggcggcgacggcggcgaggccgggttcgcggcggtgagggagatggcgctggtgcggtcgacggtgtacgaggtgctccggatgcagccgccggtgccgctgcagttcgggcgggcgcggcgagacttcgtgctgcggtcgcacggcggcgcggcgtacgaggtgggcaagggcgagctgctgtgcgggtaccagccgctggccatgcgcgacccggcggtgttcgaccggccggaggagttcgtgccggagaggttcctcggcgacgacggcgaggcgctgctgcagtacgtgtactggtccaacgggccggagaccggcgagccgtcgccggggaacaaacagtgtgccgccaaggaggtggtcgtcgccaccgcgtgcatgctcgtcgccgagcttttccggcggtacgacgacttcgaatgcgacggcacctccttcaccaagctcgacaagcgggagctcactcccagctaagctttgctgccgccattctctcactcgatctccatgcacatatgcatgaagaaattaattaaattcaagttgctagctccattttttctctttgagctgctgataaaaaaaacatctctattcttctgtgcaataagccaataattaagcattaatcagagcgtacaagtaaaaattgttttcactgttttatgtggatatatatatgtacagggatccaccaaaattaatttgatactacgtagtacgacatttgtttagggatcaacgattcacgtttcacttttttttacagcgtcaacatatataaacacatagatatgagagtatttaatatacttattactgacatactcgcttcgtcccataaaaaaaaaccaaatcctatgtatgaatggagtattctagtagtacagtagtgtaaaaaaccgccaatagattgatcctgaatttcaggtcaaggagacaaagcaactactccatagaatcatagtattaggatatgtttcatccagtaaaaaaatatatttgaagatggggagtaagaaacacgaaacggaaaaacgagtgaagaagagaagacatttcagggtctgcttgtttctgatgccaaaagcatttttttagataatgccaaatgcgtggacagaatgcttgttctaataccaaatgcatggacagaatggttgataggtatctgcttgtatcttgctcgatggaaaccgcatggacagcgacgcatttcttctccttttgcatgttactactgaacggttgacacaggatatattactggcgaaaaagtacatgttaacatgggttcaaacagtaacacgcatttcaatcaagtgtgcaagtgcaaacacaaaatgatcgtctgtaaccgtagcgcgtaaacaacaagacgtacagttatactacctccattccaaaattttgacgccgttgacttttttaaaaatgtttgtccgttcgtcttattcaaaaaatttaagtaattgttaattctttttctatcatttgatttattgttaaatatacttttatgtatacgtatagttttacacattttacaaatttttttaaataagacgaacggttaaatatatttaaaaaaagttaacggcgtcaaacatttagggaaggagggagtatatgccaaacatatccctgtatggctatattgattggcaacaaatacagtactattgatcccgtgttgtgccaaccacaacagcgacaagtatcctgtcaatttgtggtgctaacaacttgccattgataagtccagattaactagaatagacgcaccaaggcacatacatgtaaatgctagctcctggataggcaaaattgatccaaagaccagctaaactgccaaatcgttgggaaagtttacataaatgtgtctcccttgcaggtaaacaaaaacatatagtgagctgaagaaggctagttcttcgtgcaagagatcagctgtgcaatcctcataaaagggatcggctgatcatagctgatgaagaaaatgaatttgttgatttcatgaataacagtggcactaaaaggcattctgaatataaatgaaaaatacagtgttagaaagacaccaaaaacaaacaaacaaagacttgcaaggaaaacagtacaagacaaacagtcaccatagttctacttctttcacatgtgaaacatggctaggaaaggaaaatgaaaacctagacatgtaggaattgagtatacgagaattgccatggtttgtaatttgtactctgtagtttgtaccataggcattgcatttattcatttactatggcaagagaagaacagagaaccaagagcagttcaagaatagatagcagtctgttagaggagcgagttcaatgcagaagagaagttataatcaattggtatggaaacaatggatgtatcaaatggcatcggaaaatgtcgttgctgcactcacatatctagctacaaaaaggacagatggcttgaaggaggagctagctacgtacatcatgatggtattattccaaatacaatctgaaacaggtttgtagcctgagtttaaatgataaaaaaaggagtaactgaatataattttaaatggttggtttgccaagtcagtaagctatacaagcacagcaatgtacaaggttatgaatatattaccaacaataatctgtctcaatgcagaaaacatgtcgaaataacaaagcacgaatgaacagagcaacgtctgtcatacaaaaaactaaaatttcttgtgtggtcttagcagagccacttatagccaacccaagtacagcgaaacgtagtcatggcagcttaatttctcaatgaaattcataacaagcacatgttcattgattattaattaaacatgttttcttttgctaaggcaggtaaatgtacctgcccatgtttgcctctatattggaattaatttgtttgttttctttccatataaaaaagtgctgggaagcttctattgcatttgtatacacttcttatatattctgtaaattagttaacttattattattattattatctcttacttatggaagaaaagtaattaaccaatgttgcgtgtcctcacaaggatgtgtttgttctagttctcgtaaaaagaaaagaaaagaaaaggaaaggaaagagaggaggtgggtttggcccaactagaaaggcatctcgtacgtaagcccacttagcccaactagagaacgttgtaggggttgcgggaatcaacagccgccgggagaggttaattagggttccaaacttgcatggagcgagagatcgagatgagcgagatggagacgggtaaggcgatcgagttggtgttgaagcggttggatgaggtgcgtacgcgcatggatggggtggagaagctgttgcgtatactcatctgcagggaggagaagcgagcgaaggttgggaggaggaggaggaggtcgacaagatgcagatggtgacggcggcggcaggtggcggtagcagcagcaggaggaggaaagccatcaagagaaactttaaggctaaagaagcagaccgcaaggagacggaagaggagggcaatcaggtgaagaagatcaccagccagcagctgtaagtgtatttaagtactccctccatattttaatgtaggatgccgttgactttttaacaccactcgtcttatttaaaaattatatgtaaatataaaaatacttatgtcaaaaattttatgcaaatataaaaatacttatgtcatgcttaaagaatatttgatgataaattaagtcgcaataaaataaattataattacataatttttttaataagacgaaaggttaaacgtttgtaaaaaaatcaacagcgtcatacattaaaatacggatacggatagagttttatctgtaccgatggatgatccgatccagctattatccatcatccattctgagtttattggtaatgatgatactactgatatggtcaatttaaccctaactagttagtataccaatgttactatgtgatatatctgggcctcccaaaaggaagaggaagaggaagaaggaagaagacgccagcgagaagaagaagaagaagaagcggcagacggaggaagcagaagcggagaagaagattgaggcgaggaaagccaaaaaagaggcgtacgagcggtacctggcgaatttctttgattttgagcccttcccacgcacacccgaccacattctcaacgagatgcccgaggaagagcgtgccggagaaaatcaacttgctgccttcgctgatagtattatggaacgtcgcaggctcctataccagagatgcatcaaggactacatggacaaggacaaggacgatcacgaatagcaagtgtcttcgtctgtctgtgatcaaagctactactactggagtatcctattctgagttggactgtatcgtatcgtctcacttcattatataataatgactatgtcatgatcgatgtaatcggcactgagatatattaatattaactactccctccgtttcaaaatgtttgacaccgttgactttttagcacatgtttggccgttcgtcttattcaaaaaatttaagtaattattaattcttttcctatcatttgattcattattaaatatatttttatgtaggcatataattttacatatttaacaaaagcttttgaataagacgaacggtcaaacatgtgcctaaaaagtcacggtgtcaaatatttcgaaacagaggagtatatattagtactaatatcagattcttctactgctgacttcctgaatgagacgaacattcgatgcaaaattagagaatggttggtagtacgactgagatagtcagatagatgatcacgttgggtgtgtgtgtttgtcttggagggctgaaaacgacagttaagcttagacctgctggccgccagctagactccattgtttcgcttatttgcaaacagaaaataatttgcaaataaaacttttatatatgtgttcttagtgataaaatgcaaaggctgaaaaaactacgattaaaaaaaacctcaaaatcaacttaaggttgttcaattttggtttataagcatacgcataagtcaaaagatgaggctgttagtgttaatttcccagtggccaacaaactgtttttgatcagtgaagaaattaattcaaatgaatgaatgacggagtattggagcttgcacacttaagtatcttagttacataaatgtacgagcatctccctcacagctaaacaaaaacaacgcaaggctagtccttcagttctcatgcaggaaatcagctacgtaatcctcgtagaaaggatcgagtttgaaccaacgtaatccttataaccaacgtaatcataactaagaacagtggcactaaatgaccacactctgaatataaatgaaaaaaaaaagcaccaaaaaagatcaagaagaagaagctgctgctttcaaggaaaacaatacacgacaaatagtcaccatagttctttcacatgttaggaaaaaagaaaatgaaaacccaaacatgtaggaattgagtatacggattgccatggtttgtaatttgtattatgtaccatagacattacatttactatagccagagaacagagaagcaagagcagttaaggaatagagaaactatcaatgggtaattcctacatgtttttatattagaggagcgagttctatgcagaagagaaactatcaatgggtaattcggtattggaaacaaacatgtataaattgacatcgaaaaagctacaaagaggacagatggctttaagaaggagctacaagatgcattccagccaaacttgaaacaagtttatcacctgagtttaaatgacaaaaaagcagtaactgttcctcgagttgaatgttcacaccaaaagttggttgactggatcacggcaaatgatggatatgaaaaaaaaaaaaaagggtgcagaaataccatcaaaatgacttatctttaccatggaacctggaggcaggtcgagctaaaaaacatacatatctaacaaaaatagtacaacagatacacatcatgtaactgaataaaattttaaatggtcagtttgccaagtcagtaagctatacaggcacagcaaagtacaaggttgtgaatatattaccatcaacaatctgtctcaattcagagaacatgtcgaaataacaaagcacgaatgaacagagcaacatttgtcatacaaaaactgaaatttcttgtgtggtcttagcagagccacttataaccaacccaagtacaggaaattgtagtcatggcagctcaatttctcaatgaaattcatagcaagtacatcttcattgattattaaacatgttttcttttgctaaggcatggtacataactaaatgtggggtttctaaaaaaagaaaaggtaaatgtacctgcccatgttgtctcccaggctaaaaaagaccacttggccaatagctcagcaagcaaaaacaaaagaaataaaacactgctcttcaattcaaaaggaagatagtactatcttctcatgaatggataaaccgctacgcacccatggcaacccgtttgcccctcttggatgttgatgatgcattctctgccaatatcctagacaaaatgtctgcttgctttgagtaccctccagcttttaagctgtccatcagggcatcgcaacccttttgatccacgacacctcctttgttcttgatcttgcaaagcatggagtatgcaggcaatgtcttctcctcagtgtacagggcctccaagactctgtcataggttgagaagctgacatcaaagtccctgtccaatgcaaaatcagccaacttatgtgcctccatcactttgtcattctcgcagagggcaatcagcaacttatctagatcaggcaagcatccattttccaccatcagattgacacggccgattgcttcctccacatggcccctcatgaagagagcttccagaatcttatgagccatgtccatgttctctgtaacccccttctcaatcatactcttcataaccctgctagcagtctgaacccggccactgttgaaaagcgctaccatgacagacatgaacagggatgggctcggtacatgcccttgttccatcatactgtcaagtgccgtctttgcatcagctggctcattcttcttcaggaagctatcaacaagcagtgcatgcgattcagggtcagtacggacaccacggcgtgtcataatggcaagaatctcctgtgctgcttctggcacaccttcctttgcatgcccacggataagactgttaaaagcagccttgtcatcaacgcctttcttcatcagctgcctgaagaaagtctcagccttgctggtgttcccattgctgcacaaatactcaatcactggattataagctggcccttcaagcacagggctctttgggctcaacagtgtccccttctcaagaagctcatccatcacctcaacagcaccatcacactttccacccgcgcacaagctctccatcagcaccccatactgtcttggatccacaagaacatgcttgaactgcccactcttctggtgcacatccaacgcaccatccaagtcacccgctcggcatagcgtcgtcacaagcctcaaaaacactgacttgtcctttggagtgagccgccgctccgccatgtcatccattgccttccgggcctccacaacccttccctcatcatcacagagccctggcatcagagcagcaaacgtcttctcgctcaacctcaaccccttctcccccatttccgagaacagccccactgcctcctccaccttacctgcttcaacatatcccttgatcatgacattgtacgacaccgagttttgtgcaaaaccagctcctggcatttcgtcaaacactttgcgggcactctccagatcacccgcccgaacccaagcattgagaagagtgttgtacgtcgtcacatccggtgtcaccccgtgatccttcatgtccccgaacaccctcaaggctgcctccatcttcttgcacaggccgaacccccagatcaatgtgttgtaggtggacaggtcaggggtgacggcgtcggcgatcatggcgttgtagatccgcctggccatggcctctcggccgcggcagaggatggccttgaggacggcgttgtaggagagcgcggtgcgggcgatgccgaggtcgggcatcaagcggaagagcttaacggattcctgcgggatgttggccttgccgtaggcggcgatgagggcggcgacggtggcctcctcgggggcgatggagaaggagggcatggtgtcgaggaggatgcagcgggcgtggttgagcatgcggtgggaggcgaggatcgggatgaggagggagaaggtggctggctcggggctgaagccggcgcgacggtaggcgaagcggaagaactggagggcgaggtcggcgcggccggcggcggcggccccggagatgacgccgtggacgagcggcgcggcgagcgtcggggagagcaggcggatggagttctcgaggcgggtggtccacgggcggcggcggatcatgtagaggatggtctcgtggaggggctcctcgcggcggggcgggttgggggtcgccgccgccgcctccgccggcgtcacctccggcacagcctcggcctcggcctcggtctccgggggaggtggttccggcgtgtcgagggtggagaaggcatggcggaagagaggcgcggaggggttgttgcgggagaggaggcggagggggaggtggaggtggtggcggcgcgacatggctgcggcggcgtggaggagtggagctcggggagaagagtcgagggtttaggaggaggaggaagaggctcgacaccacccacgctaaagagcgtgatgggcccatatttaattgggccattaagtgacttgtggttctgggccttttagaacccagcccaacacggcagtgtagaaacaagggattcatacgggccgggctcaacagtcaatac

SEQ ID NO: 65847 - DNA, 37101 bp, Oryza sativa
agaaggaggggcacaggggcgctacagcatgttgccaagcacttcattgccagttcaaagcccctgcaccacctaggagcctggaccacgccgctgagcacctcatcactagcacaagctgtagtttgcgaggagtagtgccgctgggaccaccacctaatcaccaacaagatacatgcacaaggtcagtctttatttcatgtgtgcttttccataatgtgcggcttgtttaataatttttgccatgatttcagagaaagaccaaatcttacctgaaatatagcctagagtgatggtgtcattctctaggcatgtacggaacattatgttagatagggcttctacaactgaacaatggaaagtaatctttgcttcactcgtttcttttctctcctatttttcctttccccatcatactctttctcctaattttctattttatgttcaaatgaaaagttgaaaacaataattttaagatagaatttgggtgttatagcgtaattacctctctatatatatagaatggggaaattatagtataacacataagacttctccaattcagtctaatctagcagctcgatctgtcattatctcctcaagaactagagagaatatcaacttcaattccgtccaaaaccttgggaattccacaataattggcataaattcagatacttttcactctgtattatgctctagataattgttgtgtatgaatgtttggaagtgtgtaggactgcaaactgtaatcctactgtgtatgtatgttgatctgaaagtgtacatgtatggtactgcaaaatgatgctctgcatcacaaaaataaatgtgtgttccacctggcatgtgtttgtgtttgtattaggtaagtgcttatgtgtttatagtaagcaactgcttatctttagcaccgtttaatttgggattaactcaggaaccttcatccacatgatgcaccactcagcaatcctaacaaatcttcatcccttgccaactgggaaagtagctagaaggtatcatgacaccctcacttcttacatttactatttggacaataattgaggttgagtaggagagaccaaataatggtgctcagcaccaaaaaataagtgtcttccacttcccgggtgtttgtgtgtatatcataagtaagaacctatgtttgtgaatattacgtaagagtttcaaaattaaagaattgccttccgttgtacttgatgcgcaacaaaaccaaactaggagtacatatgctatgatcattgagaagagagcgctcaatcatatccaaattgtgtagtgaacttgatgaaaattgttacacctccatcaaaaagtctaccagtagtagagtttgcaaaatgtggcatcctttgcttgttagatcaaatacgatctcatctagagtagtaactgtaagcttatcatgacgccctcgctgcttatgtctaccattgggacaatggttgaggttgtataggagagaacaaaatggtcctcaacaccaaacaaaaaaatgtgtcttccatttttgggtgcttgtgtgcttatcataagtgtctatctttgcgaatgttaggtaagtgtctcaaaatgaagaattgtccttccattgatccttgatgcatgacaatatgtagtggagagaatatgacgatcatcttgtccaatccccgatccatatggaaccttctagaaatttccattatgctgtttccattctattgaaggcaacaataatttttgatcttggttacatgctcaaaattagactactgaagcatagttcttgcccaaatcagaaaaatacaatcccaatttcttatatcaacaaacaaaaatagcagtcgcacgtacctcgtaagtactaattctgcacatcggcacactgcacaaaatcataagctagctagctagccatatgtatccatggagctatttagatctagactaatttttatatatgggatgaaatctcgcatctgatgtcctcttacactcacacagataaaccgatatagagaattaatcataaacccatcagaaccatcaaacaattaacaatcgaaaattaaacatgcatacgagcaaagctagatatcttgaagtattattattgcagaaaaatattgctgcaataatgactagatcatggacataaggtagtagaacctcatccttcacttgagtcccgagcacctcctgctcatcatattatacctcctcatcacggagatacttggtggaaatggacacagcttgcaccatggccggcagggcattcacttatcaattttatttatagcattactgccagtttgtaataaaaactagcagtgatattgctgccggttttatttgtgagtggataaaaggatttgtcgagtcggtgtggatgtgtgattaagtattgatccctcaggctcttcctctagcatgtttctccctttcactgtcagccttccaccattgtcgtgtgttagatgtgtattagataggttgtatttattgttttatgtcttttggctttccatgttcctgtcttttggttttccctgtatctgtatatatatttgggctattgccctctgatgtatacaagtcgtattcataacatggtatcagagcatggtttagacttctcatcttcttagatttttctctctcggcttctccatgatttgatttgaggattatcggcctcttcatcttgaagccatgatgttcctcttgatctagtatggtgtcgctgagaatcatccatctctgctccccaacatcatcaatttcttcagaacagtgtagagggttggtggttgtcctcatcaccggctatcgtcgcttctcatcgccggccgccgtcgctcgtcgcgggcccccggccgccgtcgcccctcgtcgccggcctctggtggcgggactccggccgccgtcgcccctcgtcgcgggcctccagccgccgcccctcgtcaccggcctccggtcgtcgccgctcgtcgcggccgccgtcgcccctcgtcgcgggcgcctccgcctgggttgtagggcgccgtcgcttggcgtctgtttccccgatccggatctggatcgggaggtttaaaaaaaagaaaaagaaaaaaaagaaagaaagaaagaaaaaggcttctctggctctgctactgttgtgctctgatcgcacgtggtggctctatattttgggctgaggcattagaaaaaaaaacttgctgccgcttgttctgtttgctctctcgccgtcgcttcttccttcttgatgatgtcgtctttatccggcactgtgtctgttcctcattgcccagttctttttgatggttgcaactacagccattgggctcagcacatgcgtcttcatatgcgtggtcagcgtctttgggatgttttatctagtgagctaccctgtcctccttgccctattgctccaactatgccttcacttgcaagtcaagctactgatgacgatagagaaaaggctaaagagcagtttgatgatgccatggaaaattatcagagtcagtttgctttatacaaggcttggttggatgaggatgctcgagcttctgctattcttgtagctagtatggagattcatcttactggtgaggtggttactcttacttcagcccatctcatgtggacacacctacatgatcgttatgctcctactagtgatgctctttatcttgctatggtgcgtcaggagcagtctttgcagcagggggatagtacggtagatgagttctatacacagttatcctctatttggcgtcagcttgattctttgggaccgactatttgtcatacctatccgtgttgtcagcgtcagcgttctcacatggatcttcgtcggatctacgattttctcacacgtctccgatccgagtatgagtccactcgtgcacagttactttctcggcatccgcgtgttactatcatggaagctcttacggagattcgttctgaggagattcgtcttcgagaggcgggtattctaccacttccttcttcagtgttagctgttcgtactgtggcttcttcggcttcttcgacaccggctgttcattctacagtttcttcctcttcttcatcggcgcgtcctcctaccacagttgtaccatctactaggggtcaccttcactgcacctattgtgataaagatggacatgtggagtcattttgcttcaggaagaagaaggatttacgtcgtggcaattcttcgaagggtactagtggttcttctcagaagagttctggaggttcagattcacaggaaattcttatgttacttcgtcgccttactgcttctgctgcgacaggttctgttggttctgtggctctaccttctgcacagtctggttctgctgttcttggttcttcatcttctactgagggatcatcttctgcttcaggtactattccatggattctagattctggtgcttccttccatatgactcatgatagatctagtctttcatctatatgttctcctttagttcctactactgttcatactgccgatggtactcctcttgctattgttggtcgtgggactctttctatttcttcctttagtgtccctgctgtttcttacgttcccaaattggccatgcaactcatgtcagccggccaacttacggatcatggctgtcgtgtaattcttgattctgactcttgttgtgtccaggatcatcgcacgggtctcctggttggtactggccctcgccgccgtgattctcagcgtctttgggagcttgactggcttcgtcttccttccgctgcgcctgctagtcttcttgcttccactgcttcctctacggtgtcttttgctcagtggcatcatcggttgggacatctttgtggttctcgtctgtcggctttagttcgccgtggtcttttagggtctgtgtcaggagctgtctctttaaatcaatgtcaaggttgtaagcttggaaagcaaatacaacttccctatcattctagtgagtctgtatctaagcgtccttttgatcttgttcattctgatgtgtggggcccagccccttttgtttccaaaggaggtcatcgctattatatcatatttatagatgacttttctcgtcatacttggatttacttcatgactcatcgctctgaagttttggctatttataaatcttttgctcgcatgattcgcactcactttgattctcccatccgcgtgtttcgtgctgattctgctggtgagtacctttctagagagttgcgtgtttttctttccgagcagggtactctttctcaattttcttgtccgggtgctcatgctcagaatggtgtagcggaacgtaaacatcgtcatcttcttgagactgctcgtgctcttatgattgcttcttctgttcctcctcatttttgggctgaggttgtttccactgctaattacttgatcaacatccaaccttcctctgctctacagggtgggattcctattgagcatctttgtggccagcctcctgattattctaatctgcgtcttttcggttgtgcttgctatgtgcttcttgcaccacgtgagcgtacaaagttgacggcttagtctgttgagtgtgtttttctgggtatagtgctgaacataagggttatcgttgttgggatcctgtaggacggcggatgcggatttcacgggatgttacttttgatgagtcccagctccacatcctctcccgatgactctcttctgtttctcacttttcctgatactcctgttcgtgctagcattccttctcctgtctcttcctctcagctggcaccttcttctgagaattctgcatcttcttatgtgcctcctcttacccaggtttatagtcgtaaacctcgtatccaggagccttctctggatgcttctccggttgctcctcctcgatacaattttcgtgatcgtaatttagttacgattcgtccagaggatcgctatggttatgttgctacagttcttgctgaaccttgttcttatcgtgatgctgttgtccatcaggaatggcaacatgcgatggcagaggagcttgctgcacttgagcgtactggtacttgggatcttgttcccttaccttctcatgctcgtcccatcacttgtaagtggatctataaggtcaagactcgctctgatggaactcttgaacgctataaggctcgccttgtggcgcgtggtttccaacaagaacatggtcgtgactatgatgaaacttttgctcctgtggctcacatgactactgttcgaacacttcttgcaatagcttctgctcgtcattgcaatatatcgcaacttgatgtcaagaatgcttttctcaatggggaattgcatgaagaggtttacatgcggccacctcaaggctatttagttccagagggtatggtttgtcgtcttcgacgctctctttatggcctcaagcaggctcctcgtgcttggtttcaacggttttcctctgttgtcctggatgctggtttctcagctagtgctcatgatcctgctctctttgttcacacttcaccccgcagtcgcacaattctacttctctatgtggatgatatgctaatcacaggtgacgatgcggagtttattacttttgttaaagcacgtctcagtgagcagtttcttatgactgatcttggtcctctttgttattttcttggcattgagatttcctctactcctgaaggatttcatttctctcaagccaagtatattcaggatcttctggatagggcctctctcactgatcaacgcacagttgaaactcccatggagcttaatcttcatctttctgccactgatggtgaaccgttagctgatcccactcgctatcgtcatattgtagggagtcttgtttatcttggtgtcactcgtcctgatatttcatactctgtgcacattctgagccaatttgtttctgcccccacacaaattcactatagtcatcttcttcgtgtcctccgttatcttcgtggaactatctcgcgttgtcttttctttccacgctccacatctttacaacttcagggtaattctgatgctacttgggccagtgattcctccgatcgtcgctctctttctgctttttgtgtttttcttggtggttccctcattgcttggaagactaagaaacaaacagcagtttctcgttctagtgcagaggctgagttaagagctatggcccttttgacagcagaggttacttggctacgatggttacttgaggattttagtgtttctgtgacttcaccgacttctttattgtcggacagtacaggtgctattagtattgctcgtgatcctatcaaacatgagcttactaagcatattggtgtggatgcctcgtatacccgcacacaggtacaggatcaggtggttgctctttagtacgtgccttccgagttgcagttagctaatttctttaccaaggcacaaactagagctcaacacaggttctatctctccaaactcagtgttgttgatccaccctgagtttgagggggggtgttagatgtgtattagataggttgtatttattgttttatgtcttttggctttccatgttcctgtcttttggttctccttgtatctatatatatatttgggctattgccctctgatgtatacaagtcgtattcataacatcgtgcacctccccttcccatcactgtctttggccctctcgttagcctattgttgcatctccttctccctagatcagttatcgttgcctctccctctcccctgatatgtcgccttcgcctctctctctctctctatctcttctcagattcgccaccatcaccctccctctctctctagatctgccactcctctccctttctcaatccctaatgactccatcaacctcggtgcttgtggttagggtcatcagatctggcggcagggccactagatctagatgttgtgccacctcttccattgccgacaggaaggaggccatgggcggaaaagggaggggagcatggtgacttggcaatggcgagaagagggagagtaggcgagacggaaaggggagggtggtgggtcggtgacaatgaggaagctagggaggagggagagcggactacgtgggggcctacaccatgctgccgcagctcaaggcccctgctccgcctaggggcctgcaccgtgctgcccagcacctcattgccagcacaagctgcaacttgcaaggagaactgctgctatggccaccacctcatcaccagcaaaaaaaatacgtgcacaaggtcagtttactatcatgtgctgctcgtttcataatttttactgtgattttggagaaagatgacttttcctgaaatataggttaaaatgatggtgccattgtgtaggaaaatatggaacattatattagatagggcttctccaagtaaagcatttaaagtaaattttcctttctcttatggttctttaccatcataccttttctcctatttctctattttggaccaaaatggtgcccacaaaaagaaaaacaaagtgtcttccacatcctacatgttcgtgagtttatcatcactaggtgtctacctttgcgaatgttaggtagtagtttcaaaattaatgaattgccctttcattgatccttggtatgcaacaagaccaagttaggagtacaaatgctaaaggtccttgagaagagagcggtcaatcatgtccaaatcatgtagtgagcttggtgaaatttcttgcacctccatcaaacaaagtatatcagtagaaaactttgcaaagctgggcatgcgatattcgatagatcaaataccatcatctagactaacaatagtttaggttgaaacaaaaaatgtgtcttccacttctcaggtgattgtgtgcatatcataagcatgtgtctacctttgcaaatgttaggtaagtctttcaaattaaagaatttcccatgcatcttttgttcctcgatacatgacaatatatcacaagcgactatgatgatcagtttgtccaatccctattccattttgaaccttctagagtcctctatattcctatctacattttattgaacgcaacaagaagttcttaccataatgatctcaattgcattcccaaaattagactattgaagcatagttctggctcataccagataaatacaatccaaaattcttccagcaacaaacaaaaatagcactcgcatgtgcctcataattactaattccgcatatcagcacaccgcacaaaatccaaaattttatatatggggactataatctcccttctaatcccctctcacactcacacagatcagctaatgtagagaattttagccataaatccatcagaaccatgaaacaattaaccatcagaaattaaacatgcatgcatgattatctacaagcaaacctagatatcccaaagtattattgttgcaaagaaaatattgctgttgatctggttcaagatcacaacatgatctcctagaggaatacaacactgcagacaatggtagctgacatatatgtgttatcctccctaaggattgctggttggcctccatacatctgtcacatacttacataccgggttgaaaattccggaatgaaaatttggaaatttccgaaacttcgggtctattggtgggtcccgatagacagtgagctccggtcaaaaatttcggcaaaacactgttcatggcaaaatccccaattttctggtaaaaatccccagtgtccgatcccctcctcactcacctttatccgccgtcctcccccaacagctcctcccatcattccagcacaagcgagcagcaccagcggcggttgctcgaaccagaggcagacgggtggctggagtggctggcggtggctccgcggctctccggtgtgacgacgacaacacaagccacacggcagcgcgggcctcgcatcctcatgctggagtgccagcgacggctccgcggcttcggctcgacggcgacacaagccgcagacctcgcatccttgtgtttggttggagtggccggcggcggcgcggctgtcgggcgccgccgcgacgacgacagaaggcacgcaagccgcagaggacgcgacgatacaatccttgcgtttcattctccgatcctgtccaaatttctgtaattttggattggatggactcaatgcatgtttatattctgatatatgtcaaatttcagtaatttttgttgttcaaattcaaattttgtttggaaattttgttcgaaatttccgaaatatttctgaaatcttgttatttcgctgacccccgaaaaatttccctttcccgatagattgaaccctgcttacataccatccgtatcgagaaagtagagaggaaaagttaagcccaacaaagaaaggagaagctgcaaaagagagacagagatagagggcagaggggaatgtaaattaagagagaatatttaatgttggatccatagttggataaaatggattgcaatatatactagtttctatttaaagtatccattttttatgtgccaagtatagacactcttaacagtgtctataattgggaatgctcttatgttgttagatgtttgtgtccttgtatatatcattatttggtcactagtagaaacttagaatacctagagtattatgctctgcactgcaaaaaaatatatatatgttccacctagcatgtgtttgtgtttatggtaagcatgtgcttatgtgtttatggtaagcaactgtgtgtatttgccacatttagttttatttttggattaactcggaaaccacaattcacaggattcaaccacccatcaatcgtgacatatcttcatcccttgtcaaccaggaaagtaaccaaaatgtatcatcctactctcacaggtcgctgcttatgtttaccactggggtggtgcttgaggtgaattagatagcaaagcagtgtccagcacaaagcaagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtctatctctctcatccgattcctgcgtttttcttgcgctccaatcaaacgaccattcctgtgtttttcctgtgttttgcaatcctctgttttacacttcaattcctgtcagaatcctatgtttttcctattcctccgttttttctaccctgcgattcaaatgggccctaaatgtgtcttctacttcctgactatttgtgtgtttatcataagttagtgcctatcttcgtgaatgttagataagagtttccaaataaagaattgcccttcaattgtttttttttttactggggaaaactaccagggctttgcctagtagtgtaattttatcagagagaaaatatgtacaaggttacatggaaaacactaaaaaattacaaagttttcattgagaagaatgtgatcaatcatatccaaattttctagcgagcatgatgaaatttcttccacatccatcaaacagactatcaatagtagattttgcaagactaggcatgcattgttcagtagatcaagcactattgtgtctagggcaacactagtaagctccaaagtttttaggtacatgatatgtgtgactgaggaacagaacttgttgctgccgatgacactatgcttagtcatggtgttacatgatacatgctatgtctaacttagtagccatatatgcaatagatgtatgttgtagtgaaagggcatagcttagagaggtgtagaatactgtagtctttgttatcattcacttcttcctcttcttcattttcatcacctggtagatctcctacatgaggcagtagagcctcttcattcaccaagtactgagcacctcctactagtcatattccggctcctcgttgccgagatacttggtaggaaggggaccaactctattggggcatccacgtaggagcctaagggcatgcaaatggtggagtgggcgccactggacgatgatatgttgttccagctaaggaggtcaagccacttggatgcagcgagctcacgcaccatgaaggctcctaccatggccatcatcggcaccttcagcttgtttgtcaccatcacctagcaacagcataccgtagggttttcccgggtagtgatggatgtggcaaggacaaattttttcctttttttctttggctctcaattttcacttattctaatatactttttagtctttatttttgttttttctacaagcagatggcaatggcacggtgaccaattccaacccaaagctgagctagtttactccgattactatgcttgtactcacttatatagtgttgcccgcattttcctagcgttgtccatccctccacctaggttgagtctagtctggcttagaggttaggcatccagctgtttggttgtttgcgtgagcttagcctggctagcattaaattttgtttggttgattgtgtgagagagacggtttagaacatatttcattttgttcgatgcataatgtgtgagtgcagttacctatttagttggatgataaggttactgctaccatttataggccaaaatactttggaaaatattaaaatcaccttcttcaaattcaatcactatatatcatacaaaaacataaactgtagcttccatacatagtactaatcctcttggttactagatatttgaagcaatcaaactagtgacaaaaaaaagagagaaaaggacaactaaaaaagagaaggaaaaagaggaggcttcgttgagttcaccaccattgcctcccgctgtgctctggcccaccgctcgccgccatcgccatcacgacagccagatctggtggtcatgagctcgtgcctgcttgattcggctgtcctgctactggagagggtagctggaggtgttggagggctctagcagggacaacgacgtgaggaccagatggagggcgacagtgtggaactgatgaagggcaatgatggcaaactaacggcaaggttatgtcgacaatgacagcaatgccccttgagcctccagatctatgatcctctcaagccctccttcctctcgccatcctcctttctccatgatctagatgaactagagatcttgggcgccagattttcagcagtggagctcttcgcccctaatccagctcgtcgcagctaacgaaggtggcaggagggaactggttggtgacttcattgcaaaaccagcaaaccctagttttatattttgggggacaaattactaggcggacaatgtggtgactggtgacccaatgtcagcccctggtacgcggtggtgaaactcatggacacacggatgcagggtgggctgtgctactacacgcgtcaggccaggatgagcagtgaagcttgatccggccattcctgatcagtctagctgcgggcattttgaatctgttgggactgtcttggacatgtgcaggcaaccaaacaagtagccagttgcatgcaaagatgcaagtcaggccgatacaaccaaccgaacatgtcctatattcatgtgttttaatccttctttttttgacatgaatttctttcctattccctcgattttcctgtactatatttttccaatcctgtgttccaaacaagcactaaaacctttaagaagagagcagtcaattatatccaaattgtgtagtgaacttgatgaaatttgttgcacctccatgaaactgtctatcagtagctgattttgtaaagttggttatgtgttattcagtagatcaaatgccgtcccatcttgagtaacaatagtaagctctaaattttcaggtattatggtgcctctcgctgctaccattgaaataatacttgaggttgaatagaagagaataaaatggtgctcagcaccaaaaaaaatgtgtcttccacttctagggtgcttgtgtgaataccataagcaagtgtctatctttgtgaatgctaggtaagtctttcaaacaaaacagttgcccttctgttgatccttgatgcatggcaatatatgatggagcgactatgatgatcggccttctagattcttctatattcctgtttccattagactattgaaattagaatatttcttacaataataatgtcaattacatgcccgaaattagactattaaagcatagttcttgctaagaccagataaatacaatccaaaattcttttagcaaccaacaaaaatagcacttgcatgtgcctcataattactaattctgcatattggcacaccgcacaaaatacaattttttttatataacgggattataatcacccttgtaatcccctctaacactcacacagatcagctaatacaaagaattgcccataaatccatctgaaccatggaacaattaaccatgagaaattaaacatgcatgcatgattaactacaagcaaagctagataacccaaagtattattattgcagagaaaaaattgctgttgatctggctcaagatcacaacaagatctcctagaggaatacaacactgcaagcacaaaaagaaaacacaagcaggtccgcctcttttgtacttcgttctcatctttgtcttctttgcgttgttctgtcctcatgtatttgttgccactggtttcttcttcttctttggcttcatcgcctagtagcttattcttctccatcaccccgcagccatgcaccttacggttttatccaagtagatgtggatgtagccattgctgattttttttttccttgtatctctgctctctttctttggctctcaggtttcccatcttttatctactttttaggcttgtttttccattttttctaggatcagctagcaaaactccaacctaaagccgacctggcttgtgccgctcgttgtactcatactcactttatatatggcagtattggcaaataaaaatgtttggaaggcagatagtagtgactaaagatatcgtaattaaaaaataaaatgtctcttaaaaactaatctgatggaagatgaatgttgtggtcctttcgatatactcacacttgtttaccggttttcatcctgtatacatgtataccaactatactgcattaataaataataaagtatgatgaatgtcagtaatcggaataatatatactagttgaatgcccgtgcgttgctacgggaaaaattatttgtatcataagtataaatcacaccatgtcacctactaccttagggccaggattgttttcgtctgccaagacctccgcctaatctctcatcactaccaggaagtgtaagccaaagaggcgtcgtgcttacacattattctacaacaatattatgctcaccctcctgagcatgtgcagtgcacatttgcacaacatatatacactagagaatattataagcacttgtaaaatttggaaatattgtcatatacaaattcatggcccattgccaaaagactcgaaaataaaaacccaacaaaaatatttataaattctatacaatcactttgatgtataaagatctttgcaagtagtacatttgctatttccttaatataaccattggcatgacaaaactttcaattccctataaaaataatttacttcaactatgatggttccacactattctgtcaaggagaacagagaggagagagcagagagatgaagagagggaagatggggagagagaggaggaagaagaggatgggagatcaccggcaccctcaccggggacgagctccctccgcagcctctgctcctcatggcatgtggcggcaggtgggacgtcggccgtctctacacatccccacacgacgcacgcgacaggtaggatgaggaagaaaggagaggggagagaggaggaatgagagaggatgacatgtggggcctacgtgggccccacatttattattattttgtgtgctgctcacatgtgggcccactgtttttattatttttctaggatcgaattaccacctaagcgccacaccaatgcacgtgtcacgaagacctagtcaaaccaaccaagtaggcgccacgttagccaaaaccaccgagaaatcatgtttacactgattttgatagtgaccagttatatctggttttgggttaaagatgaaaatgggattcggtctaaagttaacactggtagagaaaccatctttggtcggtcgacccaaatccataatagtcccggttccattaaaaaccgggactcatttttagtcccgattaataagaggaagatctttagtcccagttgttgttaccaaccgggactaaaaatcatctttagtcccggttggtaactccaacccggactaaaattcatttttagtcccggttgatttcatgtcaggccgtgtcagggctctaggatctttaatcccggttagtaacaccaatcgggactaaaaacgttccgattggtgttactaaccgggaataaaaatcaaaacacactatataatctatagtaccgatcatcttttcccgtccacataacaaactccttcctctatctcttttttttcctctctaacttcttatctctttccttatctctaactcccctcctctccttccttttttccttcaccacacagtgaagaagcgtgcaggaagccggcgcggcggctgcggcgggcggccagcgcggcggcgccgagggccatgcggaggcggcctgcacggcggcgcggggggccgcacggtggcgcggaggggaggaggggaggcggcagtggctgctggccgaattgttttttctttttttttttgagatgtgaatctgtgatgtatttttgtgtgagatgtgaatctgtgacgaattttttagaaccctgtgatgtaatttttttaagagtttgtgatgtatttagagatgatatatttttttaagagtttgtgatgtatttggagatgatttatttgagaatttgaggatttggagatgttctgtgatatgtgatgatttggatatgggaggggatgatgtgaaatcaatattcaatattaaaaacagaaaaaaagaaaaaatatctttagttccggttgatgttactaaccgggactaaagatgctccccacatcaaccgggactaaagatggggattttagtcccggttggtaacatcaaccgggactaaagatcgatttttagtcccagttatttgaactgggactaaagatagcgatctttagtcccggattcgtagtcccggttagaaaaccggtactacaagggggttataaaccgggactaaacaacacttctccataccaaatgaacttattcctttctcctgttcacatcgaagtcgcgcctgtgcatcgcgagctcatgagtcatgcacgagtagttcacgaccggctgaattccaagactcggattcctcgtctcccctctttaacctgaaactaagatgtgtttcctgcgacccttctcagaacctgattagttcccacgcagaaactttttattccgtcatattaaatgtttagacacatgcatagagtattaaatatagaaaaaaactaatcacgctgattgcgtgtaaattgcgagacgaatcttttaagcctaattgctccatgatttgataatgtggtgctacaataaatatttgctaatgacggattaattaggcttaataaattcatctcgcagtttacagacggaatatgtaatttgttttgttattagtctatgtttaatacttcaaatgtgtgtctgtatatctgatgtgacacgccaaaacttttcgttcgcaaactaaagaaggcctcattctcttatccatccaaatgatgctctctcctcttccaccaacaacagcagtctgcagctcatagctgccattcaacaatggagatctttctatcctcttatgtttacttactgctggtcagtcaggatataggtatatcaatgcatctgcttctttcgggctccatcctttttattcgctggctgatttggtttcttgcacactacccaatttcaatccacaaagaaggctctggtagctaatgaatttctttcttttattatagacacttgcctgacaagattgcaagactccagtgtataaacatgtgcaggtcattgcagtagcactcaaagatgagttttatataggaacaaacatgatcaaggtgagtatatatttttctaaaatcatctcagaatgtcaatttcaaggagaataatattcttcagttttctgtccagtatctaagcatctccctaaaattcgtcatgaatgaattggctacagcagtggcaaaagggttcgaccatgaaaattgttcttcttattttattaattgtttttataacctacctttctctaggatattttcatttttcactttgtaatgtgaagcaaagtcaggtagcggtctcaatagcacaaatctatttatctataatagctgaaaaatatcatctgtaatgacttaggcgtccgttatagtacaataggtacataatgtgacatgtcatctgtaacggttggtcgaccattacagatgtgtgtcatatgtaacggctcggaaccatgagtcgttatagatgtaaaaataattaggcaaaaaaaattacggttcacatcttgtgaaccgtcatagatagcccgttacagttgtgagaatctgctagtgtctattggtggtctttttttttattaatgttctcaatctgtcaatatagtcggcactagcgggcatgattcgccagcaagcgtgattattcaatgtacagaacgcaccaactgaagaagagaatgagctgtttggtccagtcagtctcatgctcccattgacacaaagtttattgcattgtataattatttaccgctttcatccaaatgttctctgaaaagaagatctaagtgcatgctatctttatctgttgtccaattacatatatgtacacatgaatatctacaaatctccgtttaatgcgtggtatatcgtctaattcttttataaggataacgaccctccaaaatttcttatttttctttcaatccaaaggaggcacaaaagggcagaaagagcttttggtgtcattggaaaaaaaaactatttcaataggtttgacgaccccacttagattttaattgaaaggagtcatacatagacccattttggaagcttaattaatattctaataagcaactggttggtatttagcttttaagagtttcaaaacactaggtatcccaaattttaacttctagtctatttcatagattttgtagctacgtattttgagaagctaggtaaaaatcggaagtgttgaagccgaagaatttgaggtgttatgttttttcttaagcttatgtttcccagccaaaatttgaacatatatataaaagttttattcacaaattatttttcgtttgcaaatatgtcgtaccacgaataaacccaaggcatgggggctttgagacaagttgctaaaagctgccttaaacaggtccataagtcatatagaagaccaatatgtaggatttgggggggtgcctgcaaatcaggcgcccgattttttttccaaaatcggatgctgtttcaccaagtagataaaaaatgtttcactaaataggttaaaaatgtttcagtcttttaaaaagcaaaaacacaaccaaatcaccttatgaaacattttgctacagcgtatgaaataacggtttccaaaaaaatcggatgttgtttcaccctatataaaaataatgtttcaagtttcaacaaataacgaaacgatgtttcaaatcttaaaaaaatgtgaaacacggtcagatcgttagatgaaaaaatttggttcaacatatacaacaaacgatttaaagccattgcaacacttaaacccatgtatattaacaaaccacgtgtccatcaagatgaaattattaaacattatcaaaaatctgctgtaacatttgatccatacatagtgaaacatcataagaacactagctgaaacattgttggtaaaaaaatgaaacagatcctccttaatagggcgtttccgttatatctggatggctgttgcaaaagacgcgtggtggggcatgcgagcgtgggctgcgcggggcgcccaatctttttgggcacccgagcactggcaatttcgaagatttggtgagtggttattcattcaaaatcctaaggatcttgcaataacgaaatcatgtggaatagaaccctccaaaatctcataaatgtactccaattaacaataatagtacatcacagagtcaatcagtggtgctagtacagtaacattttcaataataaaaataatacaagaaaactcctgtaataaagcacacctatatcactacatgtaaccacttaagcaagcaggtgagcactgcaaaatcgccaatcccaaccgcgccactgtcggtgtcggcatcggcgctggaggacctcgagctcgaaatcttgcctcccatggcctccacctcgaggcggtggtggtggtggccgtgggcgacgccgccgcccttctcctcctccgcctcgcggcaccacaagggggaggggtgggggctgggcgggcccgcgctggtgaaggccgtcgggtggctcctcctcgccggcctcctcttccgtgtgctctgctccttcccctcctccacctcttcgccggagatcagcgaaggtgcgagctctctcgtttcctgatcttgaatgcggatgcagtgggaaaggggattgggagggtttaatgctgtcggtgggtttggggggcctgcgagattcggtgcatttcgacatattttgctgttgttggagcgaacattagtggttttcttgggtgttcttcggttccatgcctccacgagttagagattttgatgccacttgaatcttgctgcgggttggaccaaatgattagtctgaatttgttttgttccgttcatcctatctcgtggaatggcgtgcaaattttgttttgctgtgttagtaggaaaacatttcgaattggtgaacgcttttttcttttttgtttctcaaattctgggtagcgctttttccggcgggtttggtggggaaagctccgaataaactttctctgatggagcagtttggcagttacagatctcatgcttgtgcaattgcgattggacttttcttttttcttatcctccaagtggaaatatttaatctcttctctatggaagactagagattcagttctttttattctttaagaaccagaaatctcgaaaacaatatttcctttatatacgtttgcttcgtatggggaagacaaataagaaagctgtctgttttgatcttgtcaaccactgcttagtaaatatctgtgcaaagaatataaatatgcccttcaaatgtagccagtaaattagttcttcagctaaaacatgaaacaaaattaactcttctgttcatctgtcatatgcaaatgttgtctcactacttttagttcctatcctgtacttattcacattatttgatttgttatattgtcctaagtgggcttctgcaattttaaattgtactgtctatttttatgagaatgatactattcgtagtaatcttgaaatttttttagttcttgttgcatattattcccattagaaatcacttggtaggatctcagtaacacgtagaatgcccatccacagtcaaccatgcatttactcacggcatgttgacttttgacatatgtgagtggtaatttgtaaacaattggctgtagcagaatttgcttatcttgacaagctggagcaactaaagtactggtcgttaaggaaggattgtggctatggtgccaagcatgtgttgcttctccaagttttcttttggttgtgactgaatagttaggatgtaatatttatggaaatagttttgatggcaaatttgtatgaatgaacacttgaagcacaaatgacaaacttcttaaactctttcactagttcgaatgggtaaatgagaaaagtggctgatctatatatccacaatttcctgaaacctaaaatgtagtagtattttgtgaacattgtgagtcctcaactattcaagtattcattcacaagttcaagacctgctattgtaccaacctaattcctgtgataaagatctgccttcccacttttgttccaacaacaaacagatattttgttgaactggaaatagttgatgttttatgaatctattactgcttgtgtatctaaaagaagattttagggctactttccaccacagtacgtttaggatacttgacataagaaacaacgtataaattgtgatgtttctttccgtagtgctcttgtcttgcatctcatataggatatttcttttgtagggaaatgtaacctttttgatggtgaatggataccaaatccctctggcccagcctataccaacaaaacttgtcgatttattgatggtcaccagaactgtatgttgaatggtagacctgacatgtcatatttacactggaggtggaaaccatatgagtgtgaactgccacaatttgatgaagtgagatttctaagtgctatgaggaacaaatcctggggtctgattggtgactccattcttcgtaatcaagttcagtcactgctttgccttttgtctaaggtaaaagttatgaacattacatattttcactaattcactttcccaaccctgttatgaagcaatgttcatgctttccttgaataatcatgttcctctgtgcacctttcctaattcttaaatataacttaataagggatgatatatgatagcaagcaagaataccagataagtttcatgttaccttccatgcatactgaacattatccccattagtgttatacagataaccatcctgagcagacctgcttgctgttttatttaggctgaagaacctattgaagtgtaccatgacaaggaatacagaaacaggagatggcacttccaatcatacaacttcaccgtgtcactcgtctggagtcccttcctcaccaaatctgaggtatttgaaaatgagaatgggcaatccacctctgaaatccagcttcaccttgacatacttgacccaatctggacaagtcagtatgagaccttcgactatgttgttattgccggtggacaatggtttctcaaggtcgcggtctactgggagaatgatagggtgataggctgccattactgtcaggacaagaagttacgtgaacttggatttgaacacctctatcgcaggactctgcaacaaatcttcagattcattgcatcttcaaaccacaaaccagctgttctcttcaggacttgggcacccgatcacttcgagaacgcggaatggttcaacgggggaacttgtagccgggttttgccttacaagaagggagagtacagcggaaaagacatggatcgtatcatgagaccaattgaacttgaggagttcaggaatgccatggcggcactaggtggttcgcggaactctgcgaatctgaagctcttggatacctacagcatttcgtccatgagacctgatggccatgttgggccttacaggtatccattcctgaaaggtgacaaggatgccaaatcagttcagaatgattgcctgcattggtgtgtaccaggccctatcgacgcttggaatgatctcgttatgaagatggtattgggctgatgaagcctctgagataatactgaaagagtaaaatgcaccagcggtccttaaacttgtcaagaggtttcacttaggtccacgaacttgcaaagcgcacatcgaggtccctaaacttggtttattatatcatcctggtctaaagccacgtttgaccgtggtcttgtctacgtggcatgccacgtggacgatgacatggattttttgaaattttttctccctccttccttcttttttttctcttttatgaaaagacgatgacatggatgacgtgtacaaggcattttcgtcttttcgacaaggaagaaagagaaaaaaagaattaagaagggagaaaaaaataaaaaaattccatgtcatcatccacatggcgtgccacgtaagcaagatcgcggttaaacgcggcttggaccgggatgatacaataaaccaagtttagggacctcgatgtgcgctttgcaagttcgtggacctaagtgaaacctcctgacaagtttaaggaccgccggtgcattttactcatactgaaaatgcagggtttgtttcaagcacattctgcaaatctcgaatcagggtcagtttcctgtgctcggtcgtgtactggtttaaccgaaatttgtaactagtaaaacctaaattttgtggttgtaaatcatatttcggttttgggccgggaagtggcttattgtttaatgtgtgcggctgtaacttttggaagtcaaatctgtttgcctgctctcatctttatgtgaaaattcagggcatgcagtaggagaaagttctttttgataataacatatatctggtcaaaggttattacagcattgcaacattaagttgctaagttgaaacaattaagttcagatgtcttgaatcgtccgcgatcgctaatcggcgcgccaccagcgcgcgtttcaggcccataaggcccagcaccggcgcgcgcctccttccacgctttttttttcgtttttctttagcgatttttttcgttttcttttccacttttttctgattatttttttaatctttagcatgttttgagtttgaaagtttttaaattttgagttaaaaagtttcaaatctaaacttgaaagttttcaaatcttgacttgaaagttttcaaatctcgatttgaaagttttcaaatttttcaaatctggacttaaaagtttttgaatctagttgacagttttgaaatttgactttaaagtttaaaatttaaatcgaaaattttcaaatctaacttaaaaaattttcaatctattagtaaaaaaatcttcagaatctttcctaattactatcattagtgttaagtatattaactaatagaggtagttaaatatattaactaatagtgttaatagaggtagttaataggggagaagtgctcgctagcggcgcgcacgcgctagcttggtgccccctgaatcatctgcctcggccctcggcaatgtcagattctcaaaaaggcttgtaatctgttcatagcagtgctggtcacgtgcttgttgggcctaggcatgcccttggaaggataatgccctactatttttaatgggtcccaccagtattattctactcactttttatttcctctctcttctctgcctttcccgctagtggaggaagctgaggctccgggctgaatgccggcccaagcagtgatagcgtcctcaagcacaagcgtcgggcaaagtagaagtatataggtagtacgtggtcgtcctcaccaccagcctaccaccaccaactccatcgattcttctccgctgccaccaccttcccatccccatccatggaatagatcgggcgctacaacctctcttcatcagggccagaagatgaggacgatggtgccgccgagcttgctagatccggcatggggctcggcggatctggccttgagggtggtggagtaagaaaaagctggatgacggcatcaccgagctcgccagttccgccgagagcaccgacttcatttcccgccaccatcttcccttctcctcacatgtgtctctccccaggttgccaccaacgccccgtcgagctcgtggtggtgaccttgcttacaacggccactcgttggatgcctgtcaccgcctacatgtgttgtggaggcgtcgcatggggccacaccctctcccaacgcactgctcgagtcgtgcctcgtcgcgccctaacaaatccctgacaaggaacataggtctcgacttgtttctgcagtcttcacatggtaataggagaggcaaacatggcatgaaatctcttacatgagaggctggggctgaacgacagttaggcacactgtaaaagccctaatgaacacgtaacaaatccccaaagtagtcatttataccaaagctataaggattcgcttaggccataacagaacaaccttagtggaaattcataacttagctacactccaaaattcataaatttagtaagagaaaaaacatcgacacgattacaaatcgagcatttgaatttcctaaaaattgagtgttgtttcactactcgtaaagaaaatatttcacccaatagattagacagtaaacacatttaaactatgattgaaacattttggtgtaacatatgaaacatcgagtttcacgctattaaaacaccaacaaatccatatgaatcaatgacaatgttatgagacaccgtcaaaattttcataacaacattttaatccaatacaaagtgaaacatcaaaagttcatagcgcatccatgctaccggcggtgaggcatcggtgtccatgccgacctcctggaagaagagaaaagaagggacgcaccacctatattcgcaagcttgacacgaaagtcactgcatgctgccgcatccacatcatatttttcgacgccggtcactacgctgctgtcgagcgacgcccacgggaccagacctccctttcccctagcttccagcaacacaacaaccatagatgttcatttggctaagttgtcatgacagaagaagagagagggagggagagagtgagagagatgggatgaaactagtggataggaatgaatagattaccgttcatcgactaaaacaaatctgagccatcggattgaatcggaggcctggatgaccaggatgtgtgtgggtgtgggcatctgatttttgcctagcataggatgcccgggcgggagcattctaaaaaaagaaaagaaaaaaaaagtatctaaagaactttcgtaattttttttgggtcaaaaactttcagacgtaactaaagtataattaaaatgtaattatattttaactgcattgtaactataagtgtaactacgatattactatgtgtagatagcattgggtttttatgtgtaacatgtataaaaatttctttctagcaattttctctcttaatgcatagaataaatctcgaggtgatccgatgtttataaatctgaaagttctagggacataaaactttcataagttttctaccaaatctgaaaaaaaaaatggtataacaacaaaaatcaacaaaaaagatgtagtcagtccaagtcaatctcggatgcactcctcgcacaaagttgatttttcggacaagtttgatacatcgattcggatttaggagcacgtcacgtagcgagaaaatttcgatcgaaataataatccctaaaactttcatagaaaaacaaaagattattttgtgcttcaactcaggcatataatcgctttgtgcttgtctgcttagccacctgtatttagtcagattggcagcagcttaatccgtcggctaaattagtaccagcgaaacttgctggtcatattgttgacggcctgaatctgcagctccaggtcacggatctgcctgcgcttcgccgccgcgagcacgagctcctcggcgcgcgcgtccttctcctcctccgccgcgagcagccgcgcctcggcgtcgtcggcccgggcctcggcatcccgcctccgcgcctccaccgccgcccgctccgccacggccacggccagcgcgcgctccagggtgcccacctcctcctccaggttcgccgccgcctcccccaccagcagcctccgccgcagcagcgccgccgtgccctcctcgccggcgtcgtcctccgccgccgccgccgccgacgccgcgccgcccctgagcgaggccagcaccgacgagaagcatgacagcggcatgtttttgagtcgcgttgagaaaacgaaaatccaaagacggcggcacgtagagaaattaattacgttgggaaaaagtgatgagcccatgggcttttgataggccgattattacgaaggaatacgagtccgattacgatgggaagtaagacgaggtgtcccggtctgaatcgaattacaccggtctgaatcgaatacgttgtttatacgcccgaacaaagtgagcgaaagtggttccgagtcggatagtatcgcggagaaaaaaagagttccgctatacatacgattattttttatacgatgtttgtacgatgaaacgtctctcctaacatttgtagtgacgaaacagatccctccttcactgcaaagcccatatccaaagcccaggctcctcctgacgacctggcctgctttctcgttggtctggttgcacatccaaccaaagcaatcttctttctaatcatatcttaagcaatattcttcctaataatatgttatatagtaattgtactcagcactcatttatcatgtggcaggttaagcaaattactcatacatatatgttccttgcaccttgcactatcaaatagaattcccttctttggttcttgtaacatagcttcctctgttgattgctcatttgaaacaaacttctcaatttcttggtcatctgattcattttggacctcctcaataataaaatcatctttgtctgatatggcaatatcatcttctacttcattggtagataaattggtctccattactgaaacatgtaaattgaaacaatggcatgttttgcaaagcaaaaattcagattcattctataataaaaaagaagcatttcatggccatggacattacccaggaccaaaaaagaaagagagggagactagtgtaccaaaaaagatgattgcgaagctaaaggaattcaggcaaataagatggcatacctatgtcttcgtatgccgtatgctctctggattaaatgcagaattgcagatgcgctgataacatggaatagggaaagtcaggtttagggtttaacaaaggaagatgtaaagttagatgcaaagaggctaattgggctttagggcccatgacgctcttgactgccgtgtgcgcatgcgccgtgcgcttgagttaggttccctgccgtcggcgttgttacgtttgatggtaccaatatcgtacaaaaaattcgtatgcgtagcattttccagaaaaaaattgaaaatattttttagtttggacgcggataggcgcggctgccatgcttgggccgggcggctgggccgagagggaaagagggagggaggcccgggagagagagaggagaggaagaagagagggagggaagagagacttgggccgcgggccgagggagaggagggggactttgggccggactgggcccaaaggaggaaggagggtttatttttagtttttctttttaataaactctaataattgttttttttcttaataactattttccgtgctctgaaaatacaagtaaaatttgagggcaccttttagaccaaggaggatttaacggaaattctccgggcaacacgaatttttcttgtatgtattttagtgtttgtcaatttcttttcgaattttaattaattctattattccttttagagaatgatttttaattcgggatgaatttatcaggacgtgacattggtgataaggtggaggagagaagttaggagagagagagaatgagccacccccttatggcatagcttgtgtgcttcaattgtgcatattgatatgacagaagaaagtgatagttttagatggaactttcatcaaaatggtcaattcacagtttgatctatgtatttagctttaataataatggttatattgagaggaataagattaattggaaacttaagatgcctctcaagattaagatttttacgtggtatctacttaaaggaattgtgttaactaaggataatttggctaggaggaattgaaatggtagtttaagatgtttttttataaaaaatgaaaccatctaccatctattcttcgattgctatttttcgagatttctttggagttactttggtttacatcctccacaaagtatatctcatatgtttgggaattggcttgttggtgttgataaaaaaattaagaatcttattcttgttggagcatccgctttatgttgggttctttggcttagtaggaatgacatggtttttgatatatcaccatcaaaattttatttgcaggtacttttcagggcaacgtaattgctccattgttgggcttaattataaaggtgtgaagaagatatcagcttaattaatgatggcatgtcgtaaacttgagtcaacgattatgcaactctttgttaactttggatggaggttctcaaatagaattaaatagttgtgggatctttatcttgtgtcagtatatattagttgtgcttgtttgaaattttcattggactcactatgtgagtttgctattgtgtgaactatgtaataattggttgtagctcgtttgagcaaatgccgggatattttattccattatcaaaaaaagggggcaatctctatataatctctaagaaaagtgcaatatgttgcacttgctatcttttaattaatgagaagatgacatgacttaaattagatgtggtatttacatctactacaaaacttgtcctaagtactgcacatgaaccaacccggggtattgaagtaataaaatttattgttttgcagacaggtggtaggcattgatggtaggcaagaaggtagaagttggtttattttgggacaaacttcaatctctataagttgttttatttcgggatagagggagtagcaccgtacaagatgacctgggtatgcagacttattaattaacaaagtaaaacacgttagtgtgggcatgtcggatcgtcgcgcgcacacgcgtaaatttatgataacatgatagccggcaggtagatccaaaatataggaaggagcatgtctaaaataattagccatggatggcgcgcaaggtagctgcttcattaattcagttgcgcacccagatcatgtcgtcctgaggcaggaagtggcagatggccacgctcccgggcgccacgccgagcctcttgtatgcctccgccaccgcgccgtgcccgtccacgtccccgtggcacgcggccaccgcctgcgcccttgagcccgtgcaacccgaacacggcgtacgcgtacggcatcccgtggcatgccaccatgtcgccgccgggcaccgccacgggcctcacggcctccaccctgtacgcctgcctcggcgtcggcgtcaacgtgctgatcacctccgtggacacggcgtggacgtcgcgggtgccgaggctggacgcgacgaactcgaccatggactcgagcgacgtggcgcagtagtgcttgtgcttggtcgtctcgccggcgagccgcgcggcctcgcactcggcgagcgtggaccacatggcgtcggcggtcggcgagacggccgggatggagagctgggagaggatctccgggagcctttcggaggcgaacgggacggactcggcgcggccgcgggggagcagcgcggcgccggcggtggcgcgggtgaagtggagcgtcatcttggagcccgggaagaggtccttctcgaggaagaacacgttgcccaccgtgtcctccttcgaagctgagcccactgagctcgctgggctgatgaggtcgcgaatggcgccgggcatcggcgaggtcgggagcgcgatcttccagtacatctccgccggcgacgcggcatggctggctcccgcggcggcgacctaaattgcagtcagaaacaagttgaattgaaaacaatcagagccaaaagttgcaactagaataagtaaaaattgtattatgttcaatctctaaataatatatctctctctcccaacttaatttatctctgttctagctcaaaactactaaaccatacaaagagcgatatatatgtgcttctgctcaccaaaaggagtaggacagcagcgagtgacctagccatgctaattaacgagctatcaaggacacaagtatatgatctaattcactgataagagtgaaactgagcacaagcagttcatagcttttgggagctatttatggagggatgctggaagaatacgaacaaataatacattgcattggccccactggattatgcagaacaaaacaaatatgtcatgtaggaaagatgctatatcgcattcacgatcatgccggatacctctattattgagcaactaagaagttagcccgcatgcatcctaggctgcatttgagacatttataagtaataggttgattgtgttaaaatgtcgtatttgttactatatagcaaaatataggtatatggattttatatcatcggtttgattataaacagagcaatagttagattagaaatcagacctggagcttataattgtaaactatttctcttttagtaatacaaaatagcaacggaagaggaatgaaaagcgtagagctcgagccaaagagggaaggagtaggtgtgtagtgatgggcacaggtgagggtaatgtggaggggattttttctttgtaatttttccaagtgattgaagtgaaagacaattattagatgctattttcctaggatttgtaagattttttttaaagatgtgatacaaatcctagaaaagtaacatctaataattggttttcacttaaatcacttagaaaaattacaaaaaatgaatcccctccacatcacgctcgcatgcgtctatcactacacaccggcctactccttcatttcctctctagctcgcgagctctacgcttctcatttctctccccttcctattttatactccctccatcccataatataaggcatggtcaaacttggcacagtctttaaaagattaaatctttgacttaaatttctcatatactataaggtttattgcaacaaaattataaccatcttaaagtaaatttaaatatcaatctaatgatattaatttcaacaaacaaaacttaatttatattgtaatagttgttggtcaaatgtttttaaagttgaatattggaatgtgtgcatgccttatattatgggatagagggagtataactaaaagaaaaataatctatattataagctccatgtctgatttttaatctaactattgctctgtttataatcaaatcaacgatataagatacatatgtctatattttgctatataacaaatacaaaatttaacacaatcttttcgggagtattgtgtacagccgtgcaacatcgtcgtagtttatatatttcaccggacaagatgcatggatgaatcttacatgcagacttattaacatgctgccacacgtatagtggcatgtcgatcgatcgggccgtcgcacacacatatatgcatgataagacatgatacgcacatagctccaaattgtaggaaggagctagctttgagatcacacaatttttatcccctttcacgcgcgcgcgctcagttgcgcacccagagcatgtcgtcctgtggcaggaagtggcacaccggcacgctcccgggcgccacgccgagcctcttgtacgcctccgccaccctgggcgccgcgtcggtgtggcacgccgcgagcgcctccgccttggtcccgtcggcgccggccagcgtcaccgtgtacgccgccgccgtggtcgtgtggcacccgaacacggcgtacgcgtaggccatgccgtggcacgccaccatgtcgccgccggacaccggcacgggcctcacggcctccaccctgtacgcctgcctcggcgtcggccctgccctgtcgacctccgtggacacggcgtgcacgtcgcgggtgccgaggctggacgcggcgaactccaccatggactcgagcgacgtcgcgcagcgcttggcctcaccggcctgcggcgcggcctcgcactcggcgagggtggacctcatggcgtcggcggccggggagccggcggggacggagagctgggagaggatctccgggagcttttcggaggcgaacgggacggagtcggcgcggccgcggggcaacagcgcggcgccggcggtggcgcgggtgaagtggagcgtcatcttggagcccgggaagaggtccttctcgaggaagaacacgttgttcaccgtgtcctccttcgaagctgaggccgctgagctcactgggttgatgaggtcgcgaatggcgccgggcatcggcaaggtcgggagcgcgatcttccagtacagctccgccggcgacgcggcatgtcggatgcctcatgcctctattattgagcagaggctgatagtgtaacaacaataatcatagtgtggcctggggttacccgactccctatcggtattctttgaatgatccaacatgcatgtctatttctagtaaatttatggattcgccaatagagcaattttagtttggctcagttctatcgatggatgagtccatgagaagttagttttttttacaagctgttcaaatagttatgaatgttttttttttcaaaaaattacagaagtatgttattaattgtatcgcatgtttattgaaaaacacgcatgatcaaattcaatatatgcatggtgtaaaaaaaacaaatcaaatagtaaaagttaccatatatagttccacaattcaatttttttctcgatatagatattgaatttgaacttgtattaaaagacatatataacaggctgccataggcaacaaattaaatgaatcacaaggaacactcgacgaatacaatccctgtcagtatttgttatggccacagataaatccgcaagcacacaaaccgatatagcatttcatctcagagtattgcaagtgtattgaatcacaggaaacgtatgtttataatccaacaaatatgatttttctaaggacaacaattaaatgataggcttaagagagataggatttgatgaggacatcccagctacacttgacgtaaacaagggtgatggtttacgtcatacatcacattaagaaaatgaagatgacataaaccaagttgatagattacgtctcagcaagaatgatcaagcttatcatgatctaattacgcacagccgtgctaggaaaatacaacaagaggtgaactcgctctttgctcaacttaacccaaattttagtgagaattttatactacctaaatgctctacctttgtattgctaaggtttacacccgaggacatcatcactacaccaaggaagatgggttacgttgaggacgacaaggattacgccgaggaggattcagcccattcccaaccagcagctttttacaccaacaagaagatggtttacgctgcaacggctcaacttccaaggcttatgcgacccagccaatcaagagacgggaagcatggaatacatgattggaaagagggacaagtatagtttcgaacgcatcaaaccccacctcaatatcattctccaatcaaaagttatggcatttttactgaaggctgcgcaggagctgtagggctgtgtgcaaacccgagaaaactctttgcattctcatttttgttagccttgaccaccagaacgtggcttcttatgttcacaccttagctaggagggatgttcctagtataaatacccctctactccatccattagacaacttttgttcaattgaaaacctcatatatgagagattcctgaagactgcataagtgtcttacccctttgttcttgtgagttcttttggacttgcgagaaggctcctctggtgccccctagttcgtgctctacggcttctagttcagctgcaccatattgtgtggattagtcccggattgtggttctgtgattgctcggtttgacgggtcggagtccagggggcttcggatcattctcaccctcaccacttggtcgcatccaaccttggtaggtataaagctagttattccggatcgtggttctatgattgctcggtgtgacggatcggagtccgggaggcttcggattgttctcaccctcaccacttcatcgcatccgaccttggtaggtataaagatagttatcctcttgctgctcgtagctagttaccctcttgtgtttcggtttacgccggcactctgtcttgaacctactgctgtgaagatcgggccacccctcgcgagtgtgttcgtatcaggattcctatatgtaaataatcttagttaagttaaggtaaaactctattagtttcttcgagcaacggttcactcctggtctaccaagggactccagcatgtatctctatgatgtacccgaacgtgaaggattaagaaagacggacatgattgtcaccacatgttggctgttgcctacgtttgcattccatggagcacacaataaatgaaggtaacttctaacctagacaacacctctacaacattgattacaactcggccaagaactttcttctttatctacaatcttagtactagagcacttagtataaatactaagcgatgaacctgtcgcaaagataaaaatatatcatacttaaataagaaaagtaaataccaaagaaaatcatgaatacttacttatataaaagacaaaatcgtcgaggtacaagataggagagagtgccgacatctccggcaatcctccagtacaccccatggagagaatgtcgacatctccagcactcctccaaaactcggagagaactccgatattttgggcacttctttcggagcttcccctcattctcttcctatattctaactctactatagagtaggctaaatataaaagtgagttgtactcaactttctggtgttttgagagtgggaacttctcctccttatgtagcctgggaatcaagcataaccgccataggggaggcctgaggaagcgacatgtggaagctgtggcagtgatcagtcacactcttggttcgaccgaaccatggttcagagggaatcactttcaccgcctttcttcctcattttcgccttagtcattgtcctatgggtcctcatgacggtgcatagtaaattggcttcaattatgttagcttcatatgattagttggcccatggatcttctgctagcgtttgagtggccggaggtggttttcttcgcatggcaggtggtttt

SEQ ID NO: 65848 - DNA, 3006 bp, Oryza sativa
tatggaggttgacagcaggccgcacctcccccctcctgccaaaaggagcaagagggcgaaatcttctccacccaagcttgacacacgcagaaaagctgctggaatggggagaggaaaaataaaggtgccattagtcccaaagaagcttgatcttggcaaggcgccagtagctcctccaaagcctccagccgaattcacattgggcatgccattggtcggagacgatgccttattcaagatgggccctgcatgcaaggagttgcacgggtactacatggagaagtccaacgcaaggaggaagaatagagagacctccatgttgggccagcacgatggtcagccgttcctcgggcctactgccttcatcgccgtagacttcaaagatctctgggatctctacagggtgcgagcgatcgacaccaacctccttaaatgctactccttgtaagtatttcttggtacgcgatatagtactgactgtccataaattacgcttaccctgactcttgtcttgctcgtaggttaacctggaagcatgtccatcgtaaagcaccccatgttgccttactcgatccagctgtcgacaacgagacaacactgaaaaacgatcgagcaaacatggtggcctatatcaaggactgcttatttgcccgtcaagacaaggacttcattatgtgcgcctacaatcaacagtaagcgtgtaccgtacttatactcaaatactaaacacgtacaactgtagtatgtaactggcaatttaataatttcgcaggcgacattggattcttctggtaataacgccgaagtggagtttggtacactaccttaactccaatatcaagccagaaatatacgattggtcggccatcgaatctgccttgaacgaggcttgggaccaatatgtggcaagaggcgggaggcataaggatgggcatcccaaactcggtcacaggaaagacttcccaatacgtcaacaagttggcgaccagtgtgggttccatgtctgccataacatgaggagcttcgcagaaaaggtgacattgctcgaccctgaggtgtgtaattcaattgtttatacacacataggaagacaaatttacaagtatgtagactaatttggcaccgaacatgcaggaatttatttcaaggattccggaaatcaacttcgaaatcattagagaggagctagcacaattcatactagatgatatcttgtcaccgaaagggatgtttagagtgaagtcctaggtagctcgtctcgtaatggcagaacattcgcaatgcatatgcgacaaacatttgatttttgtaaatattctttgtaatacaattatattctttagagtaaagtcctaggtagctcgtctctgtatatacttgcatttctagttacatataaaattgttccaatttataacttatttttgtaggttttgatgcatgtcggcggtttggagagaaaaatggatgtgaatgacatatatgtgaatgggttgtggatgtgaatgtatatgtgtttgattttgtgaattcgctgtgctgtgatggaatatgaatgtgaattggctgatgtgatgctgggaatgattctatatgaaatggctgtgatggaatatgtgaattgatgctgggaatggggttgctgggaatgggactatgtatatgcttctgtcatttttgcagcgggcatggctagcaaaggcctgaggctagccaaaaagccaaattttattttttttggttccaaactcatccctgacgggcatttagctaatgcccgaaagagataacttatccgtgacaggctatactgtcctgcccgttagagattagtcatccgtgacgggcttttagaatacacccgatagagataagtcgtccgaaccgggactagtttgactcaacacgtggggtcaaacctatcggtgatgggctctagctaaatgcctgatggagatgactactcatccatgacgggcttagtggtgtgcccgattgagattagtcatccgtgacgggctccttactacgctggtttgactggtcagactcatctgtgaagggctttgttttcggcccgattgagataacatccatccgtgacgggcttttgcccgattgagatttttcctcacatcagtgacctttgcccactgacgggggccttacccgatagtgatgatgctttcagcccgtcacagataagcgatcccgttctagtgtaagctttattttcttcctttgaatcgtgcgtagtacagacagttatatatttcttgtgtgggaggaatgtattattttttttaataatagatctaatataatggtaaaaatttaggggccaccaatttaaatgaaaatcgacggtgagattagatactgctacgtggcgatctaagagcgtttgcagtggtgccacatggcgacttaagagcatttataggaggtttaatggacttttagtatataatagatagctaatagatagatagatagatagacggtaggagccacatgtcataccggccttctcttccccacttcctctttctctctctcctctctctctccctctctctcgggcgccaccgcgcatggcgtgcacggcgaaggcggacgggccggtggcggagctggagggcggagctcgcttgggcggccgacggcggagactgggctctcccaggcggctggaggccagtggcggagcgggcggtcgaaggcagcagctgaggcggagctcgcataggcggccacggcggggcgttgtggagacagagctcacccgagcagccatggcgcggcgtccccatggtagccacggcggcgctgagacggagctttgcccgagcaatcacggtgcggcgtccccatggcagccacaatggcgttgaggagacggagcttgctcaggcgacggcggcggctgaggcaaagctcgcctgggcggctggcaacggaggcggagcatgccccggtgaccggtggctgaggcggaccaggcgg

SEQ ID NO: 65849 - DNA, 1382 bp, Oryza sativa
tctaagacagtcagaggagccgtcgacttcatagagaagatggtctccaacatggactggagcaaagaacgactccagacccgtaagtgaggaatgcacaccataaaggagaccaagatgctcgctgcaaaactggacctcctcatgaaacatttggacgaccacgagaagaagccccagggcactgttaaggcattggactcacatgtaacgtgcgaggtctgcggcagcatgggtcattgtggaaatgactatccggaaacacgtgaagaagcgatgtacatggataacaacacaacgggttccgtccacagggaggtcaggggtgaaaccaaccccacccatatttccaaggagccaacaataacggtaacctttctaaccaaccttccttgaaggatctcgtctttgcacaagccaaaacaacttacgcacttagcaaaaagctagctgctaatgacaagatactagagaatataaacgtcaagctagatggctttggttctgcatttcagaacaagcttagttttaaaagatgattgaaacccagctggcgtagcttgctgcattaattcccgctaatgaataagggagggttccggagcaaccggaaccttatgttgaaaatgctaaggcgattacaacgaggggaggtaagtccactcgcaatctgccatatcctaaccctgcagggaccggcaacaacagcaacagggaagcaccatctagtgacacaactgaagaagaggttcagtcaaagaagaccgtgctgcaggagtattgtgacacgagaccgctgccactcccccagagatacaagaagccgtcggtggacgagtagttcgctcgttttgttgaggtgatccaaaagattcacattcacgtgccgctgctagacgtcatgcaagtgcccacttatgcacgatacctcaaggatatcctcaacaaaggccactaccgacgactaaagtggtcaaactaatggaggaatgcagcaatgccatactccacaagctcccggaaaagaagaagggtccagggtatctcatgatcacctgctcgatcgagacacagaaattcaaccaggccctctacgaccttggagcaagcgtgagcatcatgcccaaggatgtcttcgacaaactcaactttacagtgttggcaccaacaccaatgcgtctgcagctgggcgattcattggtccattacccaactggcatagtggaatacgtaccggtcaagatacgggatttcttcatcccggttgacttcgtggtgttggatatggaatctgacaaggagacgccaatcatcttggggcgtccgttcgttagtaccgcagatactaacattgatgtgggaacgggaagcatccgtttttg

SEQ ID NO: 65850 - DNA, 1442 bp, Oryza sativa
cagcaaacgataaggattatacagaggcatataacttaaccatttgtagcaaggaattggaaacttataggatcaagcagaatgccattgattaaataatgtaaactactgtacgttcatgaagttctcttaactgttttgcaataggctcatgatcattaaatcaagtgcaattcaggctgaaattcaagaaatccctgcaaactaaaacttttgaaacggtgaagtgaacgaaatctaaaaagcattatactcatctaaattacagcactgccattacctaaactacagcattacacctactacaactactacatctgaacatgaaaagggggagcattacacctactacagccactacatctgaacatgaaaaggggtttttgagttgtacctcgaatgagctatagaacaagatgacagtgagcctaggaggcagctaatgcagtgtgccaagcaaataatatatatagttgtagccgaaaatatttgaatatttgaagttttgaactccacccgccaagaatccaagcccgccatcctcttctcccagattgtgaccaaataataggtcgattttgtgctttccccatgaagagagaggtctactgccctaacccgtgctcctgtcataccagccagcagtactccttggtagtatcatctatcaagtcttaagagagggagagacatgctgtgtagaccactcttctccaatcagacctgctacatttccaatcaaaggagtgtgtgtggttagagagggggattgaatgcagcgaatcagacacctgctagatttccaatcaacggagggtgtggggtaaattgttagagatgggggattgaatggagcgtgcactggaatggatgagactgatcttaccttggattcagagagtgatgtagtactccatagaggacttgtacgctcatggatcctgttgcaggcaagttctaccaatgtgacttgtgaggtccttcacagtacgacgacatggcctctggattcgattggtgcacgagtgctccgctgcgacgtggtccccacaatccgccgccgctccgagccctgcgcctccacgtcgcccttgtccgccactgctccgccccactggcagccgccgacagcaaaggaagcgacggtcggaggacgggaggaggggcggagggaacgacgtcggctcggtagggggagcgcgctgctggccccgctgtcgcccttgctcgaccgggccatcgcctccgagatctccctcatccaaatcctgcaagcccacggaagagggaggggcgtcggctgggaaacgcgtgctggccggggaaggaggaagggggcgccggccggaggaagtggaacggcggcgctggccgggggaggaggagaagaagcgctgaggcgctggcggccgggggataaggagaagatgcgctggggctgg

SEQ ID NO: 65851 - DNA, 46900 bp, Oryza sativa
  unsure (1)..(46900): unsure at all n locations
cgcgccgcggtgcgccaccgtcgccgccgccgtcgtcgctgccgccgtcgtcgccgctgctgccgccggtgagccgccctccttcccccctcgcgtccaccactgccgccgctcgggtgggagagagccgagagagagagggagaggaaaagagaggccggcagagagaaaaagagagaaagagagaaaagaaagaaaaagagaaagagagaaaagaaagaaaaagaaagaaaaagagaagagagaatggaggaaaagaaaaggaacaataaatagaaaattaggaagaaattaaggaggttaatagttcaagaaaatctaaaataattagaatttaattatagattaattatggtcatagaattgcaaaatttaatataaattataggttattcttggtaatttctaaaaaaatcaattcgcggtagtagtttagatgtaattaacgactaaacaattagatgaatttttttagactattacagattagttttggataatctctataagtaatcgattcactgtagaagttcggatttaatcactaggaattttagacgtatatttggatctttatttgaattttaaccgaattcaaatcgtttcttcgcacgtaattttagagcccgagggagttgcggatccaagcgaggaccaagaaccgcaagactttgagcaaggcaagtcatcactatcccttgaacacgttgatcccaattgcgaaattatttcgtttataaataaaattgcatgcaatgatgaacattctacttgtgtttataccatgccttgattattgtttaccccttattccttcgtaaccatatttacgtatgagtccctagtcaattatgacaattgcttagaaatgctattctagaatcatgcatactcatatttatcaaatgctaaatgcttgggcaatcacctttgggaaggtaattgagatgcggcatgtggagacatgagcaccacattgccatgaaattgatgacatgatttgggaaaggaaaataaaatgaaaacaaccgttttcgactggggcagacggaggatttgggtggtatctggaaaaggctagtaccgtccccggtcaattaaggaccgagccatgaagttaaacatgaaacgacccccgtacaaccgtacttctcgaatgggtatagacctagcggattagatagccgagcggaggcagtatccctgcatagatggttcacccctgagtgaggcaggcgcgctacggtggggcagccgttgaggtagggccgagaggcatgctctacatcggtgtcgccattggtaggactgccatgagtgtgtgagagagaacttaacttgaaccataatttaatatgtgtgtgagacttctcttttccgggagcgctagaactcctctcactgctagaaacatggacgcctagagtgcatgaggatttaagttcatggagcgggtactgccaatgcgaggttatcaaaaggctttgccatggcgcgtctcatgtgttgggacgaggctcatgtgttgggcagtcgcagagtgcgggtaaagtgtacatccactacagtgtgagtaaaccaaatctattcgaatagccgtgctcacggttattgagtaccgggacatgtattacacttggctagactataaattctttaacttgtgtgggatgggatattacatgatgatttttatgctgatggagccacttcctgagaggtgggaatgtggacgtcctcagaaaaccatgacgactcaatggcggaaagctatccttgggatcacaatggatggtggacagaaccgtcgttgtttaatgtgaacactggtattaaaacttgatcagtctatgctaggttttaggcttatgaaaagaattacaaaacttgctttgcgcaaaagaaccatagccatcctttgaattcttctgtcatgtgcattattgctgtggtggcttgctgagtacggttggtactcacccttgcaatattcaaacttaatcagaggccggagatgaagcttcggaggatccctatgcctattaccaggagggtgatgaggacgatggcgctcaataggtcttagttacggtcgttgcctgtggcaatagcgtgccgctgccttaactccgctgccttacctacttctgtttttgaaatgtattccggaccgctcggtccgatgatttaagactgtgcctgcgggcttatgatgtaataattcgtactagactctcatgtatgtgcacttgatatttcagctataagttcgtgtgtaccagactacttgatccagggaaatggtactgtttacacgattaattcctgttataaaaacgggggtctaaggaagctcaatttgagaagttttatatcccgggagatattcattaccgtattcatttcactctatattcgatccatatctttattgataatattttattacgtttttatacaagttttcaattctgattatgtttctgaaaaaaatgaaaataaacatggtagatcaaattttcatccgtttctgttccattttcataactagctaatactgaacagaataattgaatgcggcaggtaaaatcgttgcagcaatactcatacatcaacctgaaacgaccatcctaggctgtgaccaagatgatatctattgatgactttttaagaaatgctagataaaaaagtattcatgttcggtatcaatatctcgaaatttcaatattattttggaaaataccatatttatcgattacgaatagaagaaagataacaattgagcacatctggcgctccatttcacacaattattttgcgagaagacagaagattaaaattgaattacaaattattttgctagatccccagcaagcatgatccatccagattattggtgcatagggccagcctgcgacatgttaagcaccatcccacaaatcttcgacgcacttgtaaggcccattgtcacagacgaactgcattccagtcagacccctctgctgggggagtttgctgattttgtctctctcttcctcagtgagctcccagtcgaaaatatcaagattctccttcatcctattttcattgtatgtcttcactaacaaaacatcaccctgctcgtacatccacctcaaacaaatctgcaccgcaaattaaatattgaagtctcaattaacatggtatgcccatttaatctcttaccttaaattctgtgaacaactgttttctaaattatttatctgattgaagatctgattgcaccgttaatattaaatcctcttaacaaaatttcataatataatattctaataaaacatatatgtgtttgacgttttgaaatagtgtttcatacgtgagaagaaaaaagtgaatgtttcaagtggaaccaacctgagcaagcgtcttgcccttggtttgggcgatgtcgtgcaggacgccggagtccatcaccgcggcgctgccccacggcgtgcccttcgcccccagcggcgagtacccgcacagctgcaccccctctcgccggcacacctcccgcagcgtcctctgctgccacatcgggttcatctccacctggttcgccgccggccgaaccacggcgaacgacagcagctgctccagcttcttggcggagaagttactgacgccgatggcgcgcgcgaggcccagccggtggcactcctccatgccgcgccacacgccctccatgtcgaacgccggcgccatctcctccttggggaacgggaagtcgtagctgcccggcgccacggtcgccggccagtggacgaggagcaggtcgacgtagtccattccgaggttgcggagcgtctccctcgccgccggcacgacgcggccggcgtgcaggtcgctgcaccagagcttggaggtgacgaacacgtcggcgcgggaggcgacgaggccgcgccggacggcctccgcgacggcctcgctgacgcagccctccgtcgcgtacagcctcgccgtgtcgaagtggcggtagccgagctcgatggcgcggagcagcgccgccgtggtttcctcggaggaggtgaaggggaacgccgccgtgcccatgccgatgcgcggcatggtcgggagcagcgcgctcgcaggcacctccgggatggtcgccattgccattgccgtattgcagtgtagtgtagtggactagacaaggacgtgtgtggctatatataaagaaaaaatggattctgttcaacgcatgccgcaatgcagacaacacatgggacgataatgaaggagaaataatgaaagagaaattcgatcggcttgatttttcgtagctgagtagttgatcacgttgaattatcaacaataattcagtttttctgatttacattgtactattattattagtttactagtcatgcaaatcttgcaaaatgattaattacaaactgtacatgtaatgcccaaagctatgtcacgtgcaaagtgatttgtacacaaggctgtgaccaagacgagatctgttattgtcttatcaagaaatatatataaatcttttagtatcttatcaagaaatatataaataatgattcgatttccctctgacaacctagaaatttcgacaatcgcaccaaccgggatggcaacgatcaggatgctgttcgtccacgatatgcgatcctcgccatcggctagtgagatggggtctggggactccactcatacctaagatgtggatggttctaacagtcatggctatttgttttttcgaacgcgcaagctccctgtatacgaatcaattgttattctgctccaacagttgtaccgaaataatgaataccttgagtaggtagaaatagaaaaaaacaagaattttcctaaatgagaaatgttttctttctaaaggaaattaaataatattaattttgattaatatcagaatatcgaatgagtttatgcttcactaattgaatgataaataactgcaagtaaaggagataggtggtttaaaaataaacccaaaattttaaacatgtatctaaaatcacaacaaaaatagtgaaatgaaattagctcgtcgggaatgcatccaaaatcattatagacccagggaattaattaatagttcccaaccacgggtggagtgaaatccaacaaaaatagatcaagagtcgtatacatttaaactaaatctaccatcttaaatttagcatcctaaataaatttctaggtagctaattaaatttgcaatgcatcatctatggacctatatatgtataccaggggagtaaccatttttcgtgaacgtgtcgacgtgttttaaataagtggataggtatacagcaattaatatacatgtatggtccatacattaattgatcgcagaacgtgtacgggaatggtgccgtgcccatgcctgccgcacataattaagatagatccacatcatgatccatcatgattatttagatatatactccactgtatctaagtagcttgctagacgtcaccatcccacaaatcttcaactgatttgtaaggcccatggtcagagatgaattccaatccaggcaggcccctcagttggggcagctgactgatcctctccctctcttcatctgtgagctcccagttgaaaatgtccagattttccttcattctcttctcattatatgtcttcaccaataaaacatcaccttgctcgtacaaccacctcaaacaaatctgcacgacagagtaattatatagtgaaactttatttgacctgattttttgtttggtttaattaaatattttatattcatttaatttctaaactttcgtgttttgatcacttttgatatacatcctttgattccataatttttgacgttttaaacatggttgggtcaaacttttataattttaactatcgataatttttaaatatttattttaaaagcactacaacaacatatttagatttgtcttacaaaatcctataataaaaataaaaaattatttatttattttatcatagtgattttttatgtaatttgtatataagttggttgagtttgatcacgagatataaacattagacatatatattgaaatattcacttaaagttttctttttaccggttactagctttcacttacaaacaagtaaaaacataataatagtatggtatcacagtataaggataaattgatggcttacaactgatgatatgtaaatatgttatattagttatttagagttgttcttttaaacatccaaaatatgcaaaaccactctccaaaactatcttagggagtaatatagatggtattgcaaagtttagggggttagatgttcggttttaaagtttagggtgctaggtggatttgcatccaaagtttagaggggtatttggacttttttccttgttaaaaattttaagaataatggaattggagggagtagtatatatggtatgaatttttctcctacaaaatttagaaaataagtatatcaaccaacctgagcaagcgtcttgcccttggctccggcgatctcctgcaggacgccggagtccatcacggcggcgctgccccacggcgtgcccttcgcccccagcggcgagtacccgcacagctgcaccccctcccgccggcacacctcccgcagcgtcctctgctgccacatcgggttcacctccacctggttcaccgccggccgcacggcggcgagcgacagcagctgctccagcttcttggcggagaagttgctgacgccgatggcgcgcgcgaggcccaggcggtggcactcctccatgccgcgccacacgccctccatgtcgaacgacggcaggatcacctccttggggaacgggaagtcgtagttgcccggcgtgaggctcaccggccagtggacaaggagcaggtcgacgtagtccatcccgaggttgcggagcgtctccctcgccgccggcacgacgcggccggcgtgcaggtcgctgcaccagatcttggaggtgacgaacacgtcggcgcgggaggcgatgaggccacgccggacggcctccgcgactgcctcgccgacgcagccctcggtggcgtaaatcctggccgtgtcgaagtggcggtagccgagctcgatggcgcggagcatggcggcggtggtgtcctccgaggaggtgaaggggaacgccgccgtgcccatgccgacgcgcggcatggtctggataagctcgctcgccggcacctccgggatggtggccattgcaacctgcagaagtgcacagtgtagtgtagtggagaggaggacaatgaggtttttctctgtgggtagctatatataggaaaagaatggatctcctccttgaggtttcgtgctgcaagacttaaacaacacaagtgacgatgaaggtaacatttttctaggtgaagcatgggcagggatagagctagagcgaaacagaatgtggtgttactctcttaatttactttactttagattaaagtttaacctaatacaaatgtctaagtttgtattaagggggtacatatacggtgaaaatagataaggtatagtttaaaaaattttctttatcgggttcctgagcaccccctaatatatactagctccgcccctgcatgggtaagttagtaagagatcaatatgcggtacaaagttcatttgcaatataaacctgaaatatcatgggataaacaaatgagcatctgagatttgttcttgttatcatgagtaattttttttgccacaagattaaccataagtaacttttttttttggaataaactatttagtggcatggataaatcttaaacaattatttatatatgctacggtagcttacaggtttgcaaatgctgtgttagttagtaccaacacaagactaattcatttttaccttttctattttactagtccatgaaaacttgcaaaatgtatgattagttgcacctacctgtacatgtccatgacccaaagccgcctaggctgatgtgccccgttgaaagcgatcgagatagaagtctgacgaagactatgacgatctattagttaccttattcagaaatgataaaaacgcatcgaggtttaggccctgtttaggctgtgtttgcttggggaggttgggaacaaatcttcttcgcacggaaaacggagcggtccattaacgcgtgattaattagaaattagctttttttttcaaaaatgaatcaatatgattttttaaagcaatttttgtatagaaactttttacaaaaaacacaccgtttagcagtttgaaaagcgtgcacgcggaaaacgatggagaggtgttgggaacccttgggtccgaacacacccttagtcacaaaacaaaattgttcacgctgtcacatcgaatgtttggacatatatatgaagtattaaatgtaggaaaaaaacaagagttaattgcactctggtccaccttttattgccaaagtttcactttaggctatcctctagctcatatttttactttagactaggtaagattatctttggtgcactttggaccgcccaagtcattttctttagctgcatctactctataatattgtaaacaattgcctgtgtaagttggaaaatattaccgggttacgggctgctgatgtgtttaaagttggaaaagtcatttatgtattcctaaaaagtttatggggtggtccaaagtaaaataaaggtaaagtaacctagcccaaagtgaaaaaatgtgttaaatggtggtataaagtgaagctttggtaataaacggtggccctaaacgcaatttactaaaaaaaacaattacacagattgtgtgtaaattgcaagacaaatcttttaagcctaattagccatgatttaacaatgtgatgctacagtaaatatttgctaatgatggattaattagacttaataaattcacctcgcagtttcctgacggaatctgtaatttgttttgttattagactatgtttaatacttcaaatgtgtgttcatatatccaatataaaaaccaaacccaaaaaatttttccaactaaataaggccataatctgaaaacgtgtaaaatgttgtgatattaactagagaacgaaatagagtgaaatctataaccgtagttctagagtgagtactacatgttattaacaatgtaaatatattaaacgacagagtattgtaaaagtaaaatttataaatagctgaaatttgaattgtggaacgaagaatagatgtaaacacagtatgagattaattgaaattagaaatggaagataaagtaaaattagcaattgaaattcaatacgagttaccaaacttgagtccctacaatactaaattaaactttggattaaaatgaaataataaaataattccgagtcaatataaaacaatacacaatattattttaaaattcaaaacaaaaattaaaacaaaactactcctccaaaacatggaaaatggttaattcaaccagtacaatgtacggaattggacttggtgattcttcactctctagtatgtcttgttatcattgtccatgtaatctctataatgattgattatagccttttaaagaaaagatgggaataaattctatgattaaaaaatatgtctctccctaattgttttctttatccgaccctgcatccatgtatgctcttgcttttgtcaggatgtatgtcagctatatactccataactcttggtcaagtatgctatagctagagctagcttatggcggccactttggttgaccagaaacagaaaggcaagtggctgatggctgatgacattgttccgcttgaagatatatgcttttttaaaataattataaagtacaacacagacactcacaacatacgtacactcacccctataaacgcacgcacgtaaaccctactcctacgagcatctttgaagactgagctgataaatcctaaagactgacgaagttactacagacgtctcgttgtggacgggtgcatcacatgccactaaaagcacaaaaccgttaaaatctaaaaaattctctcccataaaaatcaaacccaggatttaaggtgctactaaagtttaatgaggcgcgaagatatgtgctgatgcagtaatattgttgcttctttccatgcaaattctttgcccgtcgtgtgtcaaaaagatggggccactagccaccaatttttggaattatcggagaaaacagccttcccctcacacacagcctaactgttggctgcttacctggttcgttgcatcccatggcgactagcgtaaaacacaactacgaaaagcatttttccgtgggttcaaaaagtgttttttctacagagatcttacccgtctgcatcaggtgtctgggaaaataaatatttttccatgcgggcgatcaaccacatgaaaaaatacatctttccgtgtggtcaggttaagtggaccgcacggaaaaatctgatttccacgtgcgggtgcttatatcacctgcacgtaaaataaaaatcccaaaaaaaataaaatcaaaaaatccgaacccaaaccctagaagccgttgtcgccgtcaccatcgccatcgccgaatctgccgccacccacatcccctaccaccaaatccgcggccgccgcacgtggggagggcggcgccactccctaccgcctccttgttgtcatcggtggcggcggaggcggcggatccagccatcgtggcggcggcggttgcggaggaccgtcgtggtaccgcaccgctaaaatgcgggtcccgcgtgcaccgtgctgcctagcgatttttgagactgtgcaggcactgttttcacactgtttgacacggcttcatactgtttggcactgtttgagcgacgatcccgcgttgtggttacgcagaaccgtcgtatgaacagtacaaaacagtgtacaaacagtgattgaacagtgccgacgcggtaaaaaattcgatgtcatcgtggttccgcagtttcaagctgtgggactatcgcggtcccacgctttcgtcccgcgggaccatcggttttgtgttttggatctgcgggactgtcgcgattccgcgttttcgttccgtgggacggatatatttttatatgtatgtatataaatgtaaattattaagaataagtatatttgcaatttttttcccaatccctctcacctttcaagtgccagccacgccgtgctgaacgcgatgagcagcagctggggcaatcgcggtccgacgtgtcattgagggtgggaggcgaagcgaactaccccatgccgatgaggacaaattgtgggcttaaagaagacttttaaggctctgaaatgatagtcactttttatttttaataaacctggtttcaagagaatttttaggggaaactagttttacattccttattcagttagcatgcgttttgagaatttgtagtgtattggcaaatatttgggcggcatgttttgcacagctcgctgagctgcttccaaacgatatttttacagaggagtgattgttgggctctaggctgattcggtgaagtgattttcggagctagtaaaaagaagtggcttctgctgattaacctagtgaatcactttcagtcgcagaaacgctcctttcagaaaatcagaagcaggaggaggagctttacgtaccaaactcaaactgacccaaagtgtgtactggcagcagtggcggaggcagctgcccgggctccatgccatcgcaacacacattgctccacagcataaacatcatttactcattaattgcttacataattaccttgcttcctggttccaaggaaggttaattagatgactagcgagttgtaccacatcctaatcttgctttcctgatgtatagtagccccgtactctaactccttgacaataaacaaccaacatttcattgataaattgtaacttggcaacaatcaactttaagtctagataaacggtacaattttccatatatatatatagggcatgttcactttgatgcaaaaaaaaaccttaccaaattttggcattggcacagtgtcggatcccaaaactaaatattcggaaaccgacatgtttaactgtatcaagccctggatcagtagattgatacagcttcaacaatctggattttcattgcgtacatttgaacaaggctccaaaggagatgttattacataaattaataggggaatttacaagattgtggctaactattacagcagaagctatagagtgtctcaactctaatattttgctatagacttaaaccatctaactaatctagatttgaaaactaggttgaaataatgctaacttatatgattgaactcctggcttcggcaagaacttcaatttaactctggaaaaaggggtttgaagcaagggtgagtacaacgtactcaccaagctattatattcaataatgaatgtataaaaaggtaatatttgagtaggattacgattacttgcagaaggcagagaatatagaaatagaaagcctgatgttttaaatgtagcagcatttagtaaaatcttgaattaggtttctaaccaaagtaccatatgagtcccgatactcaattccgtgagcacggctattcgaatagattcaggtttactttactgcagtaaatgtacgctttacccgcaatccatgacatgccaatattcattagcttagtcatggcaaagcttttcggttactaacatcagtggcacctgttccatgaactctcatcctcatgcgctctgaacgtaacgttatcagcagcgagaggagttctggcgttcccgaggtttttagagagagaactggttgagagacccccgtcatctcaaccaggttttcacaatacacacacacttgagctcaacaaatcatttacctgcgcctcggtaaatgttatatttgcccttcgcggcataggtttgcctcctgcgcgaggacttaaataagaaccactgtacagaggtaccacctttgctagataacctactttgcaaggtctgtccccattctagaattgcggtcgtactcgttcgtttgacataagtagttggtaataactatatcgactgagacagtactagccacccggaaatcaaccaattcgtacgtactgtcccaatctaagttcattatatttttatgcaaactaactaggcagggctaagcaaagctagcccatatactggatcttgcatatgtatcaggcttactgtatctcaaacatcatgctattgactcaatgccatagcaatagtaagcagtatatagcaatactaggagcattttatgcctacaaaggggcaggcaattaattaacttgcccttgactccaacgtcgaataatatccaaggtaggcaacctgattatctgatccttgaaataccacaagttgccatccaaaataaaataaactctactgaagaagaggaagagccaaattcaataaaatccataaaataacaagaaaacgataaacgactaaaagggctagggtttagggtataacctatctcctttataaggtataaggattactgggctaatatgtgtaggttctaaaagattggagactaaagtggataggagattaagcaacatttgtcgcttatatttcatctgtgggttttagttgcttggagagtaagggatataactggttaagtgagtatgtggctagtaatggtcgaagttgggctttggtagaagaatggctaggatttacttgttctcgagtcgatgctgaaataggatagcatatcggctcgtatttcatgtataggttatgagtagttggagggtaaatggttgggatgatattgtagctggcgtggagtctagatagcaagctgattgaggtaggataaatatcagttagggtttaggtgtttgctagtcgttgctagagttgggcagcatggcgactagacttagcatcttctctagccgatgtcaacagacagtataacggctagagggataggaggtttgtgtgggtttagtggggcggaagtgttactccgacaaccgtgagtggcggcggagcggctaggatcacacagagcccaagagctaactgtgcggcgtgctgtggaggtcgagggaatagtgaagctccgaccgctgtacgcatcaaggcgtggggtgccaggagcagcatttcgatcttgggtttgggttttgccaggctttacaaccaacggtccaacgtcggggtcgatagaccgcacgaacgtccccatgaaaggcgtaaagttccaaccggcggctttttagtggctaaaaggtattttgaaaataaacggaaatattcgaaaagcaaatataagtttaaattgtaaattcaattataagatcaaatatttatccaaatggtatttgaataaattaaggaaatttaaataaaatattaaaatagcaaatttggtaccaaaatgtagattttgaatttagatgaatttaggtccaagtttcactggaatcggatctacggtttaggagatatgggcttctaaagattgggttttgaattaaatctagaaaagacaaaaatacactgttcatgggcccacctgtcagcctttctttttctttttcttttccttcttcttcctcccgtcatctccttctctcttctcttctggccgagtaacagggaggaggggtgctggggctccggtggccggggatcgacgaagtcggcggccacgcgtgttcccgcgcaacgcgcatccgaggatggtggtggccagtagagggagttagggaggaggccggaacggcgacaacaagagctctcttcggccggcaaaggaagtggttgtggtggttgctatggggtgggggagaaggggaaaatgggaaaaatgggttcgccggaggtagggggagtcagtggtgcaaggatttggctaggggaactatagaggaggagatcgaccgatggcggcgtcggccggacttgacaggagagagagaggaagagcttcaattcaagctctgataatgtgaggaggggaggacgatctcgccggctatttaaaggcggtggatgtcggttgcttatggcggtttcagaggagaaggcgagaggagacacggctgcggcggcacagaaacaggagcacggcgtcgactctatccgctgattggccatcgaaggcggttcggctcggcggttgatgtcagcggcgtgaggtggcggctgacgtcggcggcagttgcttagcggcgaaggaaagacggcggagttggagggtaaggcacggcgacggtggcggcgcgacttggcggcgacggcaaggaagcggcgacggcgtgtgcgtgtgcgcgtctgcagaaggaggaagggcggctcggctgtggtggctgggccggcttgggctggaggagggaaagggtttcggcccagtctagaaagaaagaaagtctaattttcctagagattcaaataattgatttagaggaatttggatggctagattttaaaaaggatttgaattcggagagggattttaaaataaggatgttctaatttatttgagtgcaatcttttgagagatagaatataacggaatttatttgatgcactcgattgagagggaagggaaataaataggatgttagcctcaaattatttggcaagaatttggagaagtatttgaggctaatgggaaacttggatatttggcgataaataagaataggtctgaaatcaaaggatgggtcgacaattaattccaatgaaattggaattgctttggtttaggttcaaaggtattgttggaggatttcttggaccacaattcataaaagtaaaaaggatttttagactaaatttgaataaaggaaattttggtcaaaagaaggtttaagatgcaaaatcaaatcaaagagaatacctcgatttaacaagatcaatttttagaataaaaaccacgaaaaattttaaatactagacagggattttatgcatgttagttttaggaggtccctctaattataatttcttaagtttaggaagttattaagaatagaagaatcggcatgatacatatttagaaaatagcaaatttttagtatgttacacatagttgccaaaaatttggcaacttactaaaattttgacaggatttcttaaatagttaccaaaatttggcagcaaactaaatgtagccacttttttgaaactttaccaaaatttggtaaggttgaaaatgacaacaaagtgaacaggcccatagtttttatctcttgctaggcttgcccagcctcaagaaaatcgattttgctaaacatcacacgggtgattttttcgttgatatttgacagatttttgcccctacaattatgcgtcgagatcagtacacgattctgcgtcgatgttgtcgtgaggtggagaggagacctcgtgggttacacgtttgccgctgatcacgattcacaagaaatttacatcctagctacgtgtaaatatcctatataactaaaataaaatataaaattacagtcctatttaactaaaattacatatgtaaattcagttgatattaattacaatcctatttaactaaatctacatttgtaaattcagttgatttgacatgtaagtgcactgtaattttgataaaaataatgtgtaagtaaatatgtacttattattttctttaaaatataaaattacaatcctatataactaaaattacatttgtaaatttagttgatttgacatgtaagtgcactttaattttgataaaaataatgtgtaagtaaatatgtacttattattttctttaaaatataaaattacagtcttatataactaaaattacatatgtaaatttagttgatatgacatgtaagtgcactgtaattttgataaaaatattattaaaaatattgtgtaagtaaatttgcattagttattttatttcaaatataaaattacagtcctatataactaaaattacatatgaaaatttagttgatatgacatataagtgcactgtaattttgataaaaatgttgtgtaagtaaatttttattagttattttattttgtaatccgttggatgcaaatccaagggaagaaaaaatctgggtgattttttctcaaaaatcacccgagcgatgcataggcggtcccaaaaaaatttatggctccgccaataactggcagcaaagcggcatgaatttctcacaacgggccacaatattgttgcgggccggaccacaacccatcgtaacaaatgccttcctaactaacaagcttggcccaacctttctcgcttttcctttgtcgtcggtactaggaataagttcaccggagatccctcaacttaagagcgagattattttagtgccttaaccacaaaaccagaaatatatacccctaaacttacacaaaccgtacactcaaggtcctataacagcatacgtgggtggttttgctgacgtggcatcctagtcagaaaaaaaataaaaaaagtacgtggagcccacatgtaagattcacatatattttcttctcttttctcctcctcctcttcccttttcttcttatcctcttcacttttctcttcaccagcggagcggcggtgggcagagcatcgatgggcaagcacgacagcggagcggcgggtgtgcacggagccacggcccataggtcacgagaggttcggctgtcggcggtgccggccccgacacaagagaaggggagggcgtcggcgtcggtaggagagctaggcgcggggggagggggagagggggtgggttggggagtcagcaagccgcgggcggcggaggcggaggcgccattgccacggaggtagcatcgtcagcgactggcgtctgatgatgagttgatggcgtacatgaagtattaaatataggctaaaaaataactaattgcacagattgtgactaatttgtgagacgaatcttttaaacctaattgctcaatgatttgacaatatggcgctatattaaatatttggtaatgacggattaattagacttaataaatttgtttcgttgtttactaacggaatctgtaattagttgttttattagtgttcgaagaccccatacaataccttatataatatgctatgtaaaacgctgaaactttacccggctgtatgtaatcaccccctgaacgagaactcatgttctaatatcgagacgcggtcttgaccgtgtctccgtctacagtgtggtgcaggtgaacagttgaacagtgcctgtagtgtgtatgcacaatgatttgtcgttagcagcgcattcaattcattaaatttattactcctaccaatccgtcctacactccacagcggcggctcttttctctcgccatctaagaaacttcctcatccagagttgactgagtccacggtaagacaaggcttcattcggtacagcttattattgcccagtgtttctcgaagcacgcaaaagaacgtatatatattactacctccgtcccaaaataagtgcagctatagatattcgagtccagcgttttgatcgtctatcatatttaaaaattttatgaaaaaaattaaaaatattagtcacacataaaatactattcatctattatcatctaataacaataaaattactaatcataattatttttcaaataagacgaacggacaaacgttgagcatgaacagtgttaaaactacacttattttgagattgagggagtagcatattactccatccttccaaaaatctgagacctatttattttttatcaaaatcaagaagcaataaactcactcactatgtgacaaaaccaataagcatgcaaccaataagtattagaatgatttcttgtttttcgatcaacaatttaatttagcacatggtgactatcaataagactcagatttttggagaaacaaggaatgaaataggtctcaaatttttggaaggagagagtattaattaagtattactctctccattccaaattgatctacatatttcatagatacacaaagaccaagaaaagctaataactctctcatattatatttactctagcaacaaactcaatgcatgcaccatccccactatttcctagccaatagcaaatcaagatattgcatgtgggttataaatacatgtgtacatggatacatgcatcaatgtccatttactccaatatacaaataacgaatagatataataaatgaacacaaatatggagatcatttaggaacaacctcaaaaaaactatatgtagatcaatttggaatggatggagtaactaatactccctccacctacttttgataggcatatttccaaatctgaaaaaattatttttgataggcatatttcaatctaataacctatcatcttaatgaccttctcgcatttaatgtgtgactctccattcttccatacaagattggctacataggtatcgagaaatgcaaatattaatgaatcgcttgtttacgaggaatgactagtagcatgtttaaataactgataagtagaattacttatccttagtctatgtgtcaagatgaaatatgactattaaaagtagatggagagagtattataaattttaaaatagatttattttagctttataaagaaactcctataaaaaaagtgcttttaataaaaaaaggagatagtaggagtaccatttaacaggtagataaggttgtgttcgctggagcatgttcccaactgaaacagtgcacacggtaaacggaacggcctattagcacgtgattaattaagtattagctattattttttgaaaaatgaatcaatatgatttttaagcaacttttgtgtagaaactttttgcaaaaaaacatcgtttagcagtttgaaaagcatgtgcgcggaaaacgagaaagataagttgggaaacttgggataagaacgcagcctaaggtggtgtttagatccagggactaaattttagtccctgtcacatcgaatgtttggacattaattagaactattaaacatagactaataataaaactaattggataaatgagagctaattcgcaaaacaaatcttttaagcatgattaatctataattagcacatgtttattgtagcatcacataggctaatcatggattaattaggctcaatatattcgtctcacgaattagtccagggctatagaatgggttttgtcattagtcaacgtttaatacttctaattagtgtcaaacatccgatgtgatagggactaaaatttagtcgctggatccaaacaggcctaaggctgtgttcgcgggaggatgttcccaaccagccattagcacacggaaaacggaacggtccattagcgcgtgattaattaagtattagctatttttttcaaaaatagattaatatgatttttttaagcaactttcgtatagaaactttttaaaaaaacacaccgtttagcagtttgaaaagcgtgcgcacggaaaacgagggagatgagttgggaaacttcgggcaagagcacaccctaagagcaggtacaacagcaggctataggccagctataaacatattttaaagagataaaggaagagagagaagagcagcgggttacagatttgtagccagctgcagcacagactccaagacgtaatgtatgtatgataggtgggaccatgtattaataatatagtaagcaactattatatgaattgactattacattggctatagatgatttggagctagtagtgggttatactattaaacttgctctaaggttgtgttctttccttcaagttcccaacccttctcctcgtttttcgcgcgcacgtttctcaaactgcttaacggtgatttttttgcaaaaagtttctatacgaaagttgcttaaaaaaatcaaattaatccattttttttaaaaaaaatagctaatatttaattaatcatgcaataatgcgtgctccgttttacatgccggaggaggggttcagcttaagtatagttacggaaaacgagtatcgaccactagctgctttcgtttacattctgaaagagagtgaagactggttacgccccacgtggatgattccattccagtcgcgctcgcgccagacggtcgatgcgcgcaaagtcagggtcagctcttcaatttgagtaccaactatagataattaaatactccttatatctgaagtattattgtatcctcaaatctgaaggttcctttgctacactacagatatcgatcgaagaaaactagtccataggtagataaatattgtatcgttgaatctctcaaggtcgtttcctttgctttgctagctagctgcagaagaaaggaaaagctatagctattagagagagaggagggatcagaagaagctgctagctgctagctcgctgccggccggccggccggagaagtacctctaatatatataagtccgtcgatcgtgtcagccatcgccggcgccggcgttgatcaggaccatcaccatgcatccaccatactgaaatctctgtggaataatcctatatatcgcccaaggtatgttactactcccttaattcccttcgtgttcttttgtttcgaactaagtagcatcatatatttagaggaggagtggtatgctttagctatatggacttcaaaattaaccatagctgatgtacttgttcttctgcacaaaattaattaacctaacctcgtgaaattgcctagtaagcacaaaccaagatgatttagcaatctccattccatatgagcacacgcatgacatgagagagcaaattaagtcagcgcaaacgccgtagtgcgctgctatgctgaatagcaattaaggttccagcttgcactggttctggatcaaggccaattcttcattaggctactaactaaggggatttaatttctgggtccgaatttagcaagatttgttatattggattatccgagcagcaattgatcgagcttctttctgcgagtttgttaatactagattaatctgatgttttctttgattaccttcggggaattaatttgtgagtctatatcatggtaattaatttatttaactttttttttgaaacttaaacaactttattaacaaagacagagttaaggggatacaccctagtacatccacagatggatacaaaggtagcagaaacaccatctttaacgagatagagactaaccaatctaaggaaacaaacttccagatgcgactaaacagcagaagaggaccagatcgacggagctttgcggcactgccgcgacgactgaatccttgggcctccattggtgtgcacaccgtttgacagaccgaaaggctcctacgcctgccaccgcggtaacggcacaaatcggaggtttgatactgagccgtagattttggtgtatgcatcaccggactcagcaaagtggttccacggagtccactgttaaatctgaggagcaaaaattgctcaacccgaacggtagacccagcatggatactgctattttcgaacaaaaggaaatttgattctaaagaacagctagccaatatcacaaagttaaacagatggttgtgatggagcttctgtctttctaggtggccaaagattgctgagatagagagccactgagtcagatccgacaaaagcaaaagtaatgaacctttaatgttcaccgccggcgtcggcaacaaggcatccgccatctggaggtgttcaaggccatcggctgagagtagcaaggagggcaacagcttcgttcttgacttaattaggtcatttttttgcaaacacgcaaaagacttatgcattgatataatattagaaggaagcaaatagttacacgcgcaaaaggctttgcttcaactggtacaggtgttttcatcaaccttatctcttttttcttcatgacgtgtatgcttaacgactttaatatgtatagctctgatgctgcatttacatagaatcggttacatcaattagctcacacttctgcaacacaatattagccctccattgctaccaagtactgtgcttgcatgcttgaaatggagagtgctaaaaatatgaggttttctcatatgttttgtgcacaggaatacaaacatgtgtgcttttatatcacaaatttgctctatatacctgtgaaatttgctatattgtttctattaaaacaagtttagaagaattgatcctacaactgacaatctactccttttggtcctgcagcttctgtgttcaacatattttaattaagattggtattcttatgcttaccatgttatctttttttttaattattttggcagagacagggtggtcaacattgagggatctgtaatgttggtatacgacacagcttgcagaaaataagattatgattggaaatatcacacgatgctatgataagttgaagttcaaagtagacatcaatcagaatattaaggttttcacagaagatgagattaaacggattactagcaacttcagcattccgatcggacaaggcggctttggagaagtgtataaagggactcttgatgatgactatgatcttgttgcggtgaagagatatattagcaaagatttaaggaaagagtttatggaagaagtaagcatccatagtcaaatgagtcacagaaatgtggtggagctcataggctattgcattggagaaagtactctaatgattgttactaagtatatctccaaaggaaaccttgatgacatactccacaacagtgacatttccatccctttggatgtaaggctgggtattgctataggatgtgcggacgcattgagctacatgcattcgatgcatttatcgaatggcagtcttatttgtcatggtgatattaagcctgccaacatacttctagatagcaatctgacatcgaaattgtcagactttggagtgtcaaggcttctttcaggtggtgtcactcagtacactgtacatataaaaggaagcgtatcttacatggatcctatatactttcatgagggttgtcttactccgaggagtgatgtttatagtttcggaatggttctcttggaactaatagctcgaaaaagggtaagaaaaggtgacattaacctcattggaggtggagaaatatttgatgctgagatagcaaaccggagcaatatgaagattctaaaagaaatgaggaaattggcaattgaatgcctaacactggacattcataaacgtcctcaaatgaatgttgtggcaaaacgccttcgtacacttaaaaaagaattaaaagacatgcatggaagatactcagaacacattttggcatcacaccgctcatggcgaaaaaatgacaaccaggggccgagctataattctaggatgcaactgaagaagagtttgagcattttcaagagaaatcttagcaattcttctaagatcctattgggactcggcaatatgagaattttcacacaggaggagctaaatgaaatcacacagaattactcgtgtctactcagtggaggtacttcgggtaaggtttacaaaggaacgcttgaggacaatacggtggtagcggtgaggatattttccgaggcacttgagggtttcgaagaggcgtttatcaacggagggatgatcctatctcaaattgtccacaagaacatcatcagactcttgggttactgcttgaatgctgattgtcccgcatttgtgtacgagtatgctgctagaggaaccctctctgacattctagatggccgtgaagatttcccactgcatttacgcgtgaagatcgcagttgagacagcagaagcattagagtacctccattcctcagcagctggtatgatcagacatggctatgttgcaccatccaagacacttgttgatgacagtttcacgccaaagctgacgggattctcatgggcgcagaggctcaacaatgatgacagcgcaattcatgatcatgataagtactgtgtgtcactaaaactgaaaaccgatgtgtatcagtttggtgttcttgtcttgacgctcattagtaggaagaactttgcgttttatgcggatcacgaacaccttgtctcgcaattccttgcagcttacaaggcagataacagtggaagggcatttttcgacgatgatatcacaactcgtagcgaagatgttgctctcctcgaagagatagggaagctattgctcaagtgtatttgtttggaaatagatcaaagaccaacaatgaaacaagtggcacaacaccttcggatcattcggagatgttggaagaataattgcacagccgatggagcttcactggtaactaattaaatctcatatatatcactagagctgatcaaggaactgaacttgacagtacacttggttcactctaagtgatcgtgtacaagcattgtgtgtgaattgtaatatattatttgttaccagaacatcttgcagtatatgctgccattcggatgatgttatctgaacttgcatgcaatctgcttcttatgcggtcgatcccatgatgtttatctgaacttggttctactagtggatatagaaaattcatgttcaatgttggtagtggtgtttcccttaatacatgtttataaataatttgcgatcatgaagctatatatgtaaaccatgtactccattgttattcagttcgtgcagcttagtgaatgaacagattgtgctgcacctgtggaccatgtaaggtatcggaggtcctcctcttattctacggaggggctatatcttatagcccgcatccttcatcttccccaggttgagtggaaggaaggccacagtgcttttaggaggctccacaccgatagagtttagccagtcggttagggggaggtccccctatcttccccccaacagtagcacctcaagggctcaagttctggtggactgcaaggcatatcagagggtgacaatatttttgccaaaacaatgacacagttcataattgtttttgtatggattgaattatttatggttcagttcgaatagctagctagttactcccattggccagtggcatatccaggatttcaggctaggtggcccagctcaacaatttttaagaacactatagatttaatgtgccaacgtttttttatttgatcagattgcgtttcgtaaattctacacttgtacgttggcatattacatctatagtataataaaatgaaccaaatatctttaaatttaccattctaataggaaatccagtatcaaaatgaaattgaacctcgagggtgggaggagatgagaacatgttgcctacaggcagcggtcataatatgtctattgatgtcatagcatactaattatatatacttagaatatagtgttatatggataagcagtttaattataagttttgctgaaagtcatcggcatcgcctgacaccaatgttagcattgtagattcgtccttgctgccggtgtttgattctgcttcaaatcgccaccgccggttgccgccgtcgtttcacaaaagacgtgcgtgggaaggcagaattcaagtagacgctgtcatgcggcgaaacaacgaagcatcgatgtttttttagtagtgtatgcaggtaatgggccttggtccattctatggtggtacatgcatcacaaggatcatactgtagctctgcatccggcatcgactataagtattgttttgtcaacatggtcagaatttgttttttcatcaaattccttttacttttagcagaacatgatcaaattctactgatacttactgcaaattaacaaaacaaaatccaattccgatccaattggcctgaactactgtgattttataactattttatatgggccgtgaagttcaaccgttgttcctcaaatggaataagttcatctaagataccttaacttgtcaacgaatccgattttcatcattcaaccgaaaaaccagataaataattctctcaactattaaaaccggtacaatataggtcccatagcggttttagattacgtggccaatttgactcgatcttcatctgacgtggcattaacatggcacatgaaacaaaatttaataatttaaaaaataaaacaaaatatataggcccacatgtcagtcaaataataaaatttaaaaatagtggggccactacctcccccacatcccctctcttctctctcctccccttctccagttctccttatcccctcctcccatcgtggagtacacagcagcatgccccgcgatgtcgggggaggacggcggtgtggatgcagctgccgtgtgccgtccttgctggcagaggacgcgatgaggatgacgcagctgccaagcgtggatccgaaatccgccttccatttgagcatcacgccttcttccacgctgatctcaccggcgaggagctcgatctgcaggcggagggtacgaatgccacgaggacggaagcggtcgaagtggtcattgcgaccaccggcggcggaggaggagagccatccgtgatcttcgccggcgtcacaccgctagcgggaccccaccggattttcgaccatcaccggcgaggcggaccggatctggagaaaaggcgtggctccgtggagatgcagggacaccgccggcgaggacgggtttcctgtcctccctagcgccggtagcccctccggcctccccgtctcgtctgcgcttgccggtgtggagagatgagagagcgtcggtagagagagagaagatagaggttaggagaaagaggtggaggaagtgggacccactgacatgtggatcccactatttttttttgactgacatgagcctcaaatattgtttttaattttttggttttcaattttttattttttattttcttgggatcaaactgccacgtaagtgccacgttaatgccacgtaggacaaatgccgagtcaaacgatccacgtaagtgccacgtcagtcaaaaccggggtcaaatactgccgtggacctcgtttgtactggttttgtaagttggaggatgcgttgtatccggttctccggattgaggatgaaattcaggctgggcgataaattgagggacctaaagttaacttagtccctcctcaatttggtgtaatgggcttgaatgatccaggccttttcccaaagagataataaataacagtcatcttaaagtattttacaactattttctatgaggcaaaaaaatatatattaccaaaaaaaaacaagcactacaacccttaatgaatcgatcttagttgacactagaaaatcaaaatctcatatacttgttaggctgtcatgcactggcgatgcacccgtaatggcagtgccactccccactaactaaaccttgtagcacacacgtatgtagcaaattgattagcaaaaaagaaaaggattcaggtcctaacataatgagattatcaaacatgaaagtagctggacaagtggccaaacttgtcatatatcaagcagaaattaaaccccaattccactaattaatcggacaccactcagcagctaaatcaaaccaaacaaaagctagaaagaaaatggtgccaatttgccgaaccagaagctaacacgcgttaacgtacggtttggtatgaccacactaaagtacagtgctgaggagagccaacacccactcatcacttaatctcgcatcttctagtagaatttgctagaaaaatttggcttttttaggttaaatatcaatttgatttcctgtttttgaaaagaaaaacatatacctttatcgaatttattccgatacccttttcgcatacttgatatatgcggttgtaaaatcctttatgcgtgggaccaatgtaggggcagatccagcatgtgacatagagggtacaattataccctaaattattttgtaaacaccctttattaatttgtataatatatgtttgaggagtaaatgatttcgaattaacagacattgtattgataacctacagctagtatatacttaagagaaaatctcggtcaactgatagaaaacaagacatatttgcattactcatagtcactataaatcgataggtattatccatgtaggtgcgggtcatatatttaaataaatacaattctatatttaaattttgtctcaaaataaggacaatccaactatactacttattattgtgacattaatcacatttaattcaaatttctgttcgtcttacagtcagctaccatctcactccgtaccatttgtcatttaatagggggtattttggataattttccttctattttattttctcatctcacttctaaacttacatttacaatgagatggagcgagtaaatgttaaatctcatccaaccaatcgtttatattatgtaaggcacattgatcttatacacgaaggtacatgaaggtaagatcctgttttggatgtagggactaatttttaacccctgtcggattattgaaactaattagaagtattaaacgtagactaatgataaaactcattctataactctgtactaatgcacgatacgaatctattgagcctaattaatctatgattagtttatgtgatactacagtaaacatgtgctaattatagattaattagacttaaaaaaattatctagcaaattaactctcatttatgcaattagttttattattagtttacgtttaatacttctaattagtataaacattctatatgaaatttagtccctagatacatacaccaccaaaagtatggcagatgtttggcatgttgggcagcaaatcaccaccgacggaaaacggaacaaattttgcttgaaaagaaaaatcagtcgtttgcaggtgcagctcagcctatactccacttgagtgcggttgctattaataaacgcgtctcgtccgcctctctctctctctctccgctgctctgcctgactgcctccatcccccaccgcgattgagatggcagcaatggcggcgccgaagctcctcctcggcctggtgatgttggtcgggtgcgccgcggcggacagccaccgctacaggccgggcgacgccgtgccgctctacgccaacaaggtcggccctttccacaaccccaggtccgtccgtccctccgcctctcaatcttccttaattcggagtttctcaatctttcctgttccaatccccacaacgaatctatacgagtaccaatttaatttgtaggagcaagattagattccttctgaaatagtactgtacaagcgatattctgaaatactgcatcctattaacaaacctgcagaattgttgaaaacaagaaataatttggaataattcaggataaaagaatttaattatgcaagggatcatttgctttctttcagtagggtaataaactatgatatccattgctcccaggacagatactaccgaaatttaagacgcccacaatggctccctattttgtcttcttttttctttcctggatataataagtaatacctttaagtgcataccttgctgaataaccaaaaaattctcaacactgttcatgtgcagatgatataatggatctcattatctgacagctgctactagagactgcaaatatttctctagtagcgatgccgtcagttgcgctagatttgtcaaatgcttcaagtggatttatacataatttcttttctactagttgttgatgtatattgtagagtgaatcacagatgtacaaggttcagctttattttattctcacacattgattttgccccttgcagtgagacgtaccggtactttgacttgcccttttgtgccccaggttagattctccctaattaattaaggtgttgctagctgtaatctgccttatgtttacttagtgaactgtgtcatctcccaagtggaggccattgacttctttactataaacaagaaagattctttgcaattaagctgaattttgattcctaacaccttctagtacagaactagacttgtttttctgatgcttattcaattttacagaaagatgaagttctgacttaacctccattctcttttaatcaagttatctgtgttgtcatcaactacagagaaagtaaaggacaagattgaagcccttggtgaagtccttaatggggatcgtctggttgatgcgccctacaagcttgatttccgtgtagattttgatgccaagtctgtttgcagtagacggctctccaaggatgatgtggtcaagttccgacacgctgtttccaaggactactacttccagatgtactatgatgaccttcccttttggggatttattgggactaagccagaaaaggcagatgcaggggataagtattatctttacaggcacatcatctttgacatcctctacaataaggaccgtgtaattgagatcaatgtgcacactgaccagaacgcggtagtggacttgacagaagacaaggaacttgatgtcgaattcctttatacagccaagtggaaggagacacagataccgtttgagaagaggatggagaagtactcgagctcatctgtcatgccacatcacttggaagttcactggttctcaattgtaaactcttgtgtcacagttctcctcttgacaggattcctggcaacgatcctcatgcgtgtactgaagaatgattttgtcaagtaagttatcatttcctatcctttgtggtgattgattcgaagattgaaattttttctagtgacaatatagataggtttttatatattgggattctctagcttcattcataactaagaacaaaatatcctggacacttgtttatatagcttcattcgtagctttgatttctcaaggtttctattaatattattccctttgaaggtattcacatgatgaggaggaacctgatgaccaggaagaaacaggatggaaatatatccatggggatgtctttcggttccccactaacaaatcgttattttctgctgctcttggtacaggcactcagctatttgctctgtaagtccctattagttttacacactgaatttcctatagtgttagttttttaacggacttatctaacaattcatatgctggcctatgcagcacaacatttatattcctacttgcactggtcggagtattctatccttacaaccggggtgcgctttttactgcactcgttgtcatttatgcactcacttcaggaattgctgggtacagtgcaacctctttctactgtcagttcgaaggaaaaaactgggtatgttctattatctatattacagattagcattgcataaatgccttggaatcaggggtcgtattatcttgttattcctattttctgccaattaacatcttagtttcttctgtttgtaggtgaggaacttgctattgactggatgcctgttttgtggacctctctttctgacattctgtttcttgaacactgttgctattgcttacaattcaacggcagcattgccctttggtactatctgtgtcattgtgctcatatggacgctggtcacatttcctttgcttgttttgggaggcattgctgggaaaaacagcaaaaatgagttccaggctccttgccgcaccaccaaattcctgagagaggttccaccacttgcctggtaccggagaaccattccgcagatggcgatggccggttttcttcctttcagtgccatttacattgagctgtactacatctttgcaagcatctggggacacaggatctacacaatttacagcattctgtttatagtctttatcatcctccttattgtcacagccttcattactgttgctctgacctactttcagcttactgctgaagaccacgagtggtggtggaggtatgcattctttcaccttctactgttgtacttgctggattgcatatgatttccattctagcatcaaaacagagttgtcttcatttaaaaaaaaaacagagttgtcttcctcattagatatcacagtaattgtgtgttttctgccaattggttgtctctcaggagttcaagaagccattccctgctatgccttgcaagttctaatgcatcttatcctttcttttttttttcctctgatgcaggtcattcctttgtggtggatcaactggatttttcgtcttcgcttactgcttatactactaccgtgaacggtctgacatgtctgggttcatgcagacatcattcttctttggttacatggcctgcatctgctacgccttcttcctcatgctgggcatggttggtttccgtgccgccttgctgttcgttcgccatatatacaaatccatcaaatgtgagtagactatgcatagttggtgaaggccagagatgaaagaaaccagaggtagctgatgcaattgattagccattattcatagcaaaaggtagtgagcagtaaatctgttccattttgtacgactgatgtggtgaattttgcggctctttttttatgtgttatgtccttgtaatttgcatcattgttgaaggaatcgtgcttagcaattttacaccattccattcccttgatgttgagagacagtgctgatgaattttgtaagaattcagaggagcaacctcttgaatattatagcctgaaagcttgatccgaaacaaaccaatagaaactatgacatctgtaattgttttgttacccttgagtgaccactatagtctctgtaaacactagcaacatgtggtactccatattttaactttcggtttgatagaccagtcgttcaaaatagtttttaaagttaaaattagttatctgaaaacacttgttgcaaacaatggtatttgataaactaatcattcaaaataattttaaagttccaattctgttatgtatatcatgacctatgaactgaaagaacacacgaattaaagcaatggcaatttatggtacttgattaaagcaatgacaagcacacgaataacaggaacagctcctttcaggaatgttacatcgtccagaaacatcagcaggatgctcatagaattttccttcagactaaaacatatattagcaatgcccagaaacaactccacagctggagttgtcagagaagctacagcaatttgcgattcaatgactgaatcgacaggaaagttgcaagatgacgaacagtatagtagtaacatttagaatgcagaggaactaacagctaatataaaaactgatcataatctcccgaccttacatcattaggaacatactttactcttttcactttcaggtcagctaaaacaaaagcagcagcaaatagaagaaaatcaagaagcgacgggcttcaaagctgcagatggcagcctagaagaagtgtgcaggaacacagatggaactatccccaaattatccacagaagaattttcggagtaaaagacaacctggtttctacctcaaacgaatcggaatagctatacaacatttgacagttttttggatgaaaaactttcatatgaatttatacctcaatgccatatgaattagcacacgagcttaaaaacatgtgcaaattcaattaaatttctgtcacggcctaataccatatgattttaaaaaggacaaagttataattgaaagaaaattttatacacagtaaaatttaggagtgtgtgtactccctccgtttcacaatataagtcattctagcattttccacatttatattgatgttaacgaatctagacatatatatttatctagattcatcaacatcaatatgaatataggaaatgattgaatgacttacgttgtgaaacagaggaagtattagttagcaaccctgtagctgtatctcgtagaagagtaaacgaacgccagcaggtttacacagctgaggccgaacatgagccagaagaagcaatccagccgtcctcgattgagatcgtcgggaatccacccgccgccgccgcccttctccggcgccgtcgcccacgcgaccaccgcgacgatggccgagttgaggtagcttccggccgccacggcgacgaggctcaccgcggtgcacaggctctttatggtgtcgggcgcctggtcgtagaagaactcgagcaggccgacgctggtgaacacctccgccgcgcccagcgccatgtacgacggcgcctgccacacgatgctcgtcgccgcgcgccgccggcggctcgcctcgagcagcgccgagtacgccatggccagcgccgacagcgccagcccgacgccgagccgctgcagctgcgacaggccgcggcggtcgccggtgacgcggcgggcgagcggcatcagcgcggcgtcgtaggccgggacgcagaggaggatgctgaccacctcgaaggtggacagcgtcgccggcggcacgtcgagcgggccgacgcgggtgtccatcgccttcccctgctccacgaacgtcgacgacatctgcgccgtggcggcgaagaagaacaccaccgtcggccacacggtggacagccgcagcagcatcttgacctcctccacctgcgtcaccgtgcacagcatccacgggctcgccatcgccaccgccggcggcgacgccactacggccgccttgtccaggaacgcgaactgattggtgtgctcgatgatccggtagtcgccgtcggggagctgatgcaggagcgagctgtcgccgggaagctccacgccgcgattcctgacggcggcgacgaccacctggcagagccgcgtgagggggctccccggcggcgtgtggaacgcccggaggccgcacagggtggagcagaagaggaaggcggcgagcgcggcggtcatgaccgccgccgggatggcgaagccgagccaccagccggcgcgctcctgcacccacacaagcacggtggccgccagcagcgagccgacgttgatgcagaagtagtaccagttgaagaaggacgccctcgccgccggcgccgcgtcgtcgtcgtcgaactggtcggcgcccagcggcgaggcgcacggcttgatgccaccgacgccgagggcgacgaggtagagccccaggaacacggtggcgcggaggacgccatcggaggatgcatcaaggtgtggggttgcgaacgacgccgagactgtgagcgtgatcatcccctgtcacagattgaaattttataacgaaatttcagaaatttttcgttctttattgttttttcagtccactggtgaagaccatcaaaataatttgtgaaacaaaaattaaatcttaaattttgattgacctttaagaaattcttgattgccataagaagatgttcttttctaaagaacttgtgaaaaaaaaacataatatcttcttaatttttgcttgacatttcgcagaaattcttgattgccataagaaatttattgttctctctctttttcagtccctgtaaagcatgaagaccataaaaaaatttgcccaaaaaaaatcttcttaagctttgcttgacctttaattccgaaattctctattgtcatatttgatatgcttttgtttgttatctaaatcttgttgtaaaaacatttcattcacaaaaatgtctgaataatgaaaattgaataaaggagtatgatatattttcacattaaaaactaagaaaaatctcttcaaacattcagtttttcgcattaacaaaaaacttgtttgagcatacttttcttaataaataaaaaagtataccatggagtagatggagaggaagaggaggatggtggtgcggcgacccaagaaggagtcggcgatgaatgcgccgacgagcggcgtgaggaagcaggtgcccgtccacgccgacacgtccctggcggcggcgacattgctctcccctaccacgccggtgaggtagctcaccaggttcctcgcgatgccggcgaacgccaggcagtcgctcagctccgtccccagtatcagcacgcacgccctccacccaccgccgccgcccttgtcctcctcctccttgccgccgccgccgttcggacgaagcagcagaggcctcttctcctcgtcttctgctgctgctgccgccgccgccgccgccatggagattttgcttccactgtgtctgtgtgtcttgctaggagctactagctcatggacttatgtcatatcgtatttccgagtgaatatttaagaaattttgatgagaatttagtgggggaaatttagattggagagaggagttaggtgtatgcacaagctgcaattgccaaaattgatttttgggatttgactcaaggtagtgtacatgccaacttattaaaaaaaaggatttttgttacgattagcctgttgtgttggttaatctagcgttgctgaaatgatggagtattttaagaataaaaaaaaaattctaaccttatatagattatttttttctttcatctaattttattattggtctatgattacatgagaggagaaatggggttctatactatagagttgcactcatagaattgatagttgacgttttcttttctttcttttttttttgaaatgtgtatgtagtactaatatctattgagttatttgttagaatctggtttccttaacggagattgaactagccattattttagctaatgtatttttcctttcagcaaagaaagctactctacaaaccttattaatttcagcaatgatagaggcaacgcatttcaattatctttagaaaaaatgcgcaagctgcattcgtagaatttgattggttcatgtggaaggtggggtttggatccagggacttaactttagtccctgtctttagacactaatttagagtattaaatatagactacttataaaactaattacataaatgaaagctaattcacttgacaaattttttaagcctaattaatccataattaaagaatatttactgtagcattacataggctaatcatggattagttaggctcaatagattcgtctcgcgaattagttcaagattatggatgggttttattaatagtctatgtttaatatttataattagtatccaaacattcgatgtgatagggacttaaaagttttagtcttatctaatcagggcctgaaatctgagccacgcaaaccaccaaccgcacgacaaggttaattagggcctgttcactttgatgccatttccaaccttaccaaattttgataaagttatcaaaaaagtggctatatttagtttgctgccaaattttgataactatataagaaatcctaccaaaattttggcaactatgccaaaattttggcatagttgccaaaatttggcattgccaaaatttggtaaggttttttttggcgtcaaagtgaacaggcccttaatttccatgtctccatcacactcacagtgccagcggttatactgggcagactagtcattcctctgttcctctttccacgttcatctgtaggatttaagggcctgtttagttcacgaatttttttttaactgtcacgtggcatgtttgaccggatatttgaaggggttttcggacacgaatgaaaaaaataatttcataactcgcctggaaaccgcgagacgaatctttcgagcctaagtaagccgtcattagcacatatgggttattatagcacttatggctagtcatggactaattagactcaaaagattcgtctcgcaatttccatgcaaactgtgcaatatgttcttagacagaaaaagtaggtagtagcacacattaattctagatgaagaaaaaaaaaactatgatatctctcattaaataatatgtggtgaataaaaatattgttgggagtaagaccggacagaagttctaatgattgtagctaacatataaatttataaaaaatgttggtcaaagctaaaaagtttaataagtataactaaaacgacgatgaatttaaaaggagaaagtacacaattaatataactacacatacagatggataagtcaccccaaattaacgtggtctttgaataaacgactgtcgcctattctttttcacgaattagctcaaaccattccctggatcaacttaattattggacatgctattaatcaaccactatctatgactcggctaattggtgcatttcggcattcatggtacatctaatttaaaaatgcatgttttttatgggagaaatttttactgcactttaggaaatttgtagtacaccgaattttacatttaaaaaaatatctccactacctaaagtattaaattttatcataaaaaaatatggtacctttgaatatattctcaagatagtaaaattactctttttacttactgccgacgtggataccccaagacaggatgaatagggttttagggtacgttggtacgatgatctatacgatacaacatcaagcaaacaagaagacaaggattatactggtttagatccctcgtaaggtaatagccctagtccagtttgtatgagattgacatggaaaaccatagattccaatagaagaccgacgattccaagattaccggcgagatccttgtcgagatggtttcgacgagatctcccagcgagtaggcttcacatcctccgatttgtaggctatggtggtggtgttggcgtatgattcgataccttaggacccctagggatgtgtatttataccgtgagttaccttgatctccaagtagaactcggagataccgaactcaccacgatacagtacaatcctgaatcccgatccttttccgagtaggactatgttatacacttgcctatgaggattatttccataatcttttgtcgatttccttatcgggaaacatatcgtacatacgaaggtatgcagtatccgtatattccataagtcgtaggttagaaggttgtatcttacccgtaaccatgacacttacctcttgggaacccttcccatctacacgcaaaacagagtaatagattaacacatgattaattaagtattaactataaaatacttaaatggattaatatgatgtttaaagcaactttcttgtagacactttttacaaaacacgtatcctttagtagtttgaaaagcatgcgcgcaaaaacacagcctaagtaccttttgatcaagagcatccgaaaacatttgtttttaacttccatttgtttcttcgacaacaagtttccacactttccagtcagttgccaataatttgactatagcatatgcatccctgaaaaatcaaggggtggcccataagctcacttctatcacctctttacttattatagatgaaatattaaaatacgtctagtcaaactttcaaatcttaaatcaccaacagataaaattaatttatgaagatttgttatgtgaaaataattaatttgaagtatatgcttcaatggaaaaatacattcatatgattataattcccatatgaataatgtaaggctatgtacaacgttgtgtaataacaacctctcttcattaccatgtaagtaaaattgatgacgtggaaaagagatagaggaaaaagaaacatgggtgctacgcatcacagcggatcagagtcgacttttaatgtttattaaagagaattttgttgcagggtggagaaaaggaaagaagggtagtaaaaaaatattttggtaccttccttttccaacctccctcccttgatttccacgcgtacgcttttcaaactgctaaacggtgcgttttttttgcaaaaaatttctacacgaaagttgttaaaaaaacatattaatctatttttttaaaaaaatagcaaataattaattaatcatacaataataggtgctttgttttgcgtgccggggaggaggagggactnnnttttttttgaacacagcctaagagttcttattgtctcaactattgtagaagtatagttttctaagtgctagagtatgtatttacctttgtacatgtcttaagtgtgtcgttgtccagaacgacgataagaaaaaaggtaaaagtgtcaggaagcctagagatcgtgaggatcccagacgagcaccttacgcgcgtactgtagccgatccggcaacacaagaaagaaaggaagcagaagaattttggcgtagcgcaacagctagctgcttttctggtttacttccttatataacaaaatgggattacaatgaaatcaaaaccactaggaccgcttctcacgctggcaattcgctgcgtccatccccacagctgctcaacgtgcgtcacgctctcggtgcacgatgcgggctctatgagctaatctcgcgaccctcaactggagcacgactgccacaagtttcggcaagctcatgcaaagctgaatcaaacaaatgcagaaataactgaataactaactaactaactaaggcacacacgttgtatttgcaacaatgagtaatttggaaataatcactgccaacaaaaagcttttggttgggggcggctagttgacgcaaattgagcttgtcctatgtctggcgaattgaatcagagtcacacacgagtcgcgagtagtgaggggacaatgcgctaacacacttttttttcttccccttgatgaaattgtataataattataaataaattactaagttaaaaaaattcaaaatttgagttgaaaggttaaaagtttgtgttgaaagttcaaaatttggatagtgttttaaaaattttctgtgaatatttgaaattttgagttggattgggtaggtttaaaatattttggtaaaagttttaattttgagttgagagttccgaatttgggaggaagttttaaaatttatagttgaaagtgttaaattttgagttttgaagtgttaattgaagtcaaagatttcaaattttgagtatagtttttcaactggaccttgtgcaactaaaaaatttctatccaaatgttaaatcttttcaaaatcacttcaaaaatcaaattacttaaagaagtactcattgaatgctcattcgcacattgggagtcctctgtgcgagtcgtgtgatatgttaagagtcacctgaattaaaagaagtggtgctttagaatcagaagtagcgagcgtgcactaaataatatttccatcacctatgatgcctacactcaactacaaatacactcatcgttaattaaccaaagaacaaacggattaaggaaattcgtccattttactccttcaaactattattcagctcattttactcctaaactattaaaaatgtttcactttattcttagcatttctctttatggtttatattttatatgggttgtattttgaactgaaaattattaagccatttatgacacataaatgacatacgtatcaaagttccaaagtacttcacttttctttcatgattatttcattgaaatttaaaatttgtttgaatcagtcttaggtgttttcgacttatgcaaaaagtggccaaatttaaaaaaatattactaagaggtaagttgtaatatgcatctatcgatcgttttgaatttcaatgcaaaaatatgatttatgtgtgtcgacgtttgatgtttcgactacggtatttggacagtatggggatcgtcggtgctaggatatacgcgagactgaggtaaaagaaacggagacgaggatttttatacaggttcgggcccctgagctgtcaggtaataaccttacatcatgttggccggagccggagttgcttttattcaccataatcacaccagtacaatatgtgggcagcctatctaactgttgtcgacatgttggtctgaaggtctgactcgtagtcgacaacagggtagtcttcctcctcgaatccgtgcccggcgagatcagagatagcgctttcgtatctcctgacggtatccggagacaccgtaggggaatagccatgcctatccctgaagtcgatatccggcggtgtgtcttggcgtatgtaggcttgtatgttgtggcttctggtgggcgtgtgttgattgtcatgggtgtcttccgtggtggttctcccctctcctcctagggggtcttgtatttatacccataggtgtccccttgtccaagtagaacgagggaaaccaatatggatacaatctgagtagtcattatcgtttccatgtagaactctagttgtctttccttatccggaactccctccatatccgcaggttgtttccgtataggacatggtatgtggtgggtcctgccaagatttagtcaactactattaggtatgtggtatccataaccatgacagtagcccccgacttcgatgcaaatgaacgaattcatattctcaactgcgcacagacattggagtaactgttatcgagcttatgtgaccgttctcggtgagattagagataacgttggacttcctttgtcagcctcatgcgggcaccgaaagggtttgtctaagtcattctctgatgtcaaccaatgaagtacatagcgtacgactaagtctcccgtcttgccgtaatcgagaatttggattgaagtcaagaaattctttcttggtgggtacaccatctcttcatttcgtattccttgtcgagatccagcaaccgttctcgagcgaccgagaaggcgtagagtctgcgacggagccttgccaacattggtcgtactcgccttagtcgatcttggtgtagaaccatagagacatggagtctttgtcaatgtcgaatagaattttcctaaaatcaatactcagaaaagaatattagatagaaataacccccgagcgaatgctcaaagggtgacatgttataatatgtatggtaaactgaaaatgaatcaaatttaccgaccaatgttttgtgtaagagtgtgttctcagttaacgactttggtcagtcgtttgagttgtacactctccctagcccccagccttgtcgtcggagaatcattttcggaggagaaggctcttggacccttgacctaccttggttgaataagcactgatcctagcccccagccgtgaagttggaaaagtcaacttccgattacacggcttggttaatacgcacggcgagaactcttacacgaccagatcttacatggtctttcgtctctgaaggatccgacaaggccttatcggctctgggcatccccaacggaagatcccttaggttcctcggaggccttgtcaagacggcgtaaagggacagtaggataggtttcaacgctaggtcgtcgtggtaagggatctctgggtaaaacacttggcgatattgtgtacctgctatcaactttgttgaaatagaggtagtaggagagtcgctacactgctagtcgaggactaggcagtagtcgtaactcgaccacgtaaagtggaaatagtgggagagacgttacatcgctggtcgaggaccaggcagtagtcgtaactcgaccacttaaagtggaagtagtgggagagacgctacatcgctggtcgagaaccaagcagtagtcgtaactcgaccacttaaaatggaaagtgggagaaatgctacatcgctggtcgaggaccaggcagtagtcgtaactccaccacttaaagtggaaagtgggagaaatggtcgtggaccaggcagtagtcgtaactcgaccacttaaagtggaaagtgggagaaacgctacatcgctggtcgaggaccaggcagtagtcgtaactcgaccactagaagcaaatgtacgagagatcactacgattaactggttgagaaccggtgagtaggtgtctctcgatcattttgagtcgtggtacgaggaccactacgttattgctgtagtcgtacctcgaccatctgaagttgcggtgcgagagattgctgcgtactggtgcgagaaccagtgagtgagcagaattatctctcgaacaacgatgggagttgcggtgcgagagattggtgcgtactggtgcgagaaccagtgagcgagcagaattatctctcgaacaccgatggaaggtgcggtgcgagagattgatgcgtactggtgcgggaaccagtgagcaagcggaattatctctcgaacaccgatggaaggtgcggtgcgagagattgctgcgtactggtgcgagaaccagtgagcgagcggaattatctctcgaacaccgatggaaggtgctagagttggtttattgcaagtgtatctcatgtggccagcatgactcacgtgcctaacttacagcatatccggatgtccgttcgcaatcatgtcgggtgatcaagccgacgatgttcgcgaggaattatccattaacaaccttttctcgagtagtccagccatggccggtgctatgagataggtcgtcggtctttgttggtaggttgggtgcgataactccgcatttgtcgagaatgttctcgataatggagtgtactcgaccataacctagtcgagtgctcagttgttcctgaaaaatattttctagaagacaagatatatagcagataatatcgagtatgtattcgaaaaactgcatggatcttctagtattatcaggatataacgagcagattaaatattaggcattatgtaaaccgtaaacaagcatgatttatacagaggaaaacagagcgtgctccagcgttagaccgcagttggcctaacatcggggacgctcgcgcgatatatactgtataaagaacatgctctaggtaaacataataaattatagatctgacaatgccgtataatctgaaaataggtacggtaaattatatataaaatattgcgtacctttgtagatatatgccggatatatctacgaaattagtagattaattaggaaattaatcttactaattaccttagaatttgtactgcggctttttggctgtttagttgatctatttgcttttggcttacgtcaccagaatgagcagctcgattgccaactaggaattgaattctagtgcaatcacaggaactcctcaactccgattagactacaagccaatgaacagatcaatgcctcacgccagccgagtttggctactcgggcagccaatgccttacgccagtcgatgtcccacgcgtcgagggattggtgttggatcagtcttagatgccgctgacaccatggccctctgccgtggtgacgtgtcgaagcttggtcgatctcaccggatcgaatagatggtgacgatgattccaatctcgttgggagacgtactctggccgggttgaatcttcctggtcggaagtcgtcaagtagcttgttgttggagaatccatctcttaaacccatctcgtcgaaatcctgaagtaccaaaatccccctacctggcgcgccactgtcgacgtttgatgtttcgactacggtatttggacagtatggggatcgtcggtgctaggatatacgcgagactgaggtaaaagagacggagacggggatttttatacaggttcaggcccctgagctgtcaggtaataactctacatcctgttggccggagccggagttgcttttattcaccataatcacaccagtacaatatgtgggcagcatatctaactgttgtccacatgttgatctgaaggtctgactcgtagtcgacaacagggtagtcttcctcctcgaatccgtgcccggcgagatcagagatagcgctttcgtatctcctgacggtatccggagacaccgtaggggaatagccatgcctatccctgaagtcgatatccggcggtgtgtcttggcgtatgtaggcttgtatgttgtggcttctggtgggcgtgtgttgattgtcatgggtgtcttccgtggtggttctcccctctcctcctagggggtcttgtatttatcccataggtgtccccttgtgcaagtagaacgagggaaaccaatatggatactatctgagtagtcattatcgtttccatgtagaactctagttagcgatgcttatccggaactccctccatatccggaggttgactgcgtataggacatggtatgtggtgggtcctgccaaaatatagccaactactattaggtatgtggtatccataaccatgacagtagcccccgacttcgatgcaaatgaacgaattcatattctcaactgcgcacagacattggag

SEQ ID NO: 65852 - DNA, 94484 bp, Oryza sativa
taaaccgagcagtatatcttacagaagtcacacaggacataataagagacacccacctatcatcaaaacccaattttaacataatcttttccaagaaaacccattcaactctgtcatacgccttatgcacatccaatttaatcgcacataacccccttttcccttgtttcctcttgatagtatgaatacattcatacgcaatcagaatattatctgtaattaatctacctggaacaaaagcactgatcacttataacctcaggaaggatgctcttcatcctgcgagagagcatttttgaaataactttatacaccacattgcaaagactgatagggcggaattgagccaccatatctgggttagacacctttggtatcataataatagtggtatcattccagccctcaggaattgttgcagtatttaccgctgttaaaacttcctttatcagatcatctcctagcattgaccaaaaccgtttaaagaaaatggcgtgcaaaccgtctggcccgggagctttcagatctccaatatcaaaaagtgcctttttgacctcttcagctgtaaatggagctaaaaggctccgattcatttcaggcgtgaccttgaccttaactgaatccaaaactgattcatcaagctcctgcatttcagactgaaacagatgggaaaaataattttgcaccatagaacacatagtgtcgctattctcttgtctcaccccctgttcatcaaccaacccagtaatcatgtttcttttccttcgactagaggcaaattgttgaaaaaatttggtatttcggtcaacatgctttagccaatttgcacgggcgcgctgtaaccaaatcagttcctcctgctccattaggagttccaggcggatcaacaactccttttgggcagcgatgctatcatcagtgaggggccccttctaatctcttcaagttttttttgcagcttttttatttgattaacaggtcccttcaacacctttttatcccagacgtggagctcttcatgtacttgcttggttttttgcgagaaatttggcacatctcctctggccgcagcactaccgtctcttccttgagccaacgtgcttcgaagcatttaggacctcgccttgtattggcatcagaatctgcccgcacaacagtttcaacaatcagcggactatggtccgaattgagcataccaccattctccagtcgtgcagtagggaaaagagcattccactgcgcgtttgagacacctcgatcaagcctttctcttattctccccctttgccaagtaaaaatgtcaccactatagcccatatccgagagagcacaatcagccaaagaatcactaaaagcttgcaaaagacgttgttctctcggtctccctccctccttctcatgatggaaaagaatctcattgaaatctcctaactccatccatggcctatccatcatcccatgaagatatctcaaggcctcccatgttttgcctttgtgctcccaacgcgactcaccataaattccagtaagtctccattcccttccatcatcaacaattacatcaatgaaatattcagagacatcttgcacataacataagcagtccaccacttggcccgtcactctcgaaaatgctgagatggtcaaaatttctgccttagctgttcccaaatgtgtttcagacaggaacaacacatcgggtctctcacgcctctgtaaatccagaagcgctcgcactgcccgccgcagttccatgctagtattttcattgtgcccggtcactctcctcaaaggagagcgccgattgtgcattagagttgtttgttgcaatcacgccatcttcacttctcctcaaagggctcatattactaccgagttgggaagagtgttccagcaagttgatttgctgagcaacctgacctcattagtatctcttttcccggactcaggggccaggccaccatcttcccctaaggccaatagcagtgcgggtaacacacatgccgtaaagaaccacacttcacagtgcacaatacatgtttgtgggtcccacccatgttagtaggtcccaccatctctcttttcacattcatctctccctctctatctctatccattcttctcgcatgccactgaccaggacggcaagcggcaagggcgaggacggcgggcaagaaggcacagacgccggcgagctcggacgcggcctcaacctccggtgagcttctccgacgaggacagtggcggcggcgcggaccgaagcggcgtggcaacgagctccccggcgacaccgaggtcggcgacgcggagcggagagcgtggacgacgacgaggccctccctcactcggctccacggcggcgcacgacggcgaaccgcccgccccctcctctccttgtcgggccggacggcagtgacctcgacggtgggacggctgcgcgcatggcgaggtagcgggtcctgtggcggcggcgtcctcggggccgagtggcgccggctgtcccctcctccctccgccggcgccgactcccctaatcccgaagcggaagaagccggcgagggtggcagtggcgccgaacgatgccggggacgcggcggacgggaagccccggggcgaggacggcgggcaagaaggcatggacgccggcgtggcggcgcctctcatcgttggggccggaggccacagacgccggcgcctccctccccctaccccgctccgcagcaacgggctctcggtggggtcttcctcgcggaggtcgccgcgcgacctcgtcttcctcgcggacgacgagcggcggcacggtcgtcgtcgaccggagccacgcgaccttgtcttcctctcaaagccgggtggagcggcggcccgagcggcgacggcgacgacgctgggctgagcggccagatccggcctaggcccactggatcaaggcgacgacggcgaggtcggacgcggcatcgacctcgagctcctctccttctccgcgctttccccatcgagccggcgagcttctccgacgaggacggtggcggcggcacggatcgaagcggcgcagcgacgagctccccggcgacatcgaggtcagtgacgcggagcgggagacggcaacgaggtcgacgctggagagggcgcgaggggacgacgagttggaggcacgccctccacagcgcgagctctaggcgttccctctgcctcgcgcgagcgaggaatcgcgtttccttgcttgggagcgagcggctcaacaaggacgtggtgctacgcgacacgtcggcgaaattcctagctagcacaacaaggcaacgctctacctaggagcactgtgaagggcctaagggatggttaagggggttaaatatactttttcctaaaaaggataggagcgagacagacggcgctgggggacgaggcttgttgggccggccttagcccagactcacgacgcggttgtgcgctttctaggtggacggatggatctgctcgactgctctctgccgtcgtgagggctgaagtcagacgtcacgagctgattccgcctcccctcgcccctgccatctcaagcgccgccgttgtttgctccatccctcccacgccaaccgcagcgcagccgctgctgccgtcgattccgacgcccagccttcgccaccggcacccctccccgctgatcgcctccagaccgacgccgcccctccccaccgaccgcatcgcccccacctcaccctggatcacgacgggatctcctccccttcctctcacccggtgccagaccgccgtggcttctcgctgctctgcctcttccttgtgcctcatcaccctggtgttgaaaggaagaaggtgttagaagtagtgatagttcagagatatgcatgcatgcatatgcagggagtccggtgcatgtgatatgaatgagattgatttggttgagataaaaccggatcacaacagattttgtttcctgattgtaagccacgttggaggctatttccaactgagatcaatatattcgtgcggcctcgacaagaggtgataacgcttcctaaaaaccttttatggtatcagagcccgaaatcgccagaatcagatcgcatctgttatggcgagttcctccatcagcgccggcaatcccttctctggccatgccgtccctaagaagctaaccaggacgaatttccttttatggaaagggcaaatcctcccggtgatccgcggtgcgcgtttggaaggttacctcacaggtgcaacacaagccccgtcggctgtgattgacgccaaggaaggagaagccactgtcaagaaatccaatccggcatttgaaacctggattgcggcagatcagcaggtgttggggtttcttctctcaaccctatccaaggaaattttgactcaagtcatccacatggaaactgcggctcaagtttggaaggcaatcaacgagatgctgtcctcccagtcgcgtgcgcggtctctgaacacgcgcctggcgctagcgacgacccagaaggtcgatctcagcgtctcggactacatcaacaaaatgaagatcctcgccgacgagatgacgtccgccggcaagccaatggatgatgaggaattgatgtcctacatccttgccggtcttgatgatgattgggaaccagtggtgtcttccctcgtcgggagaccagatgcagtttccttctccgagttctactctcaacttctgagcttcgaatcaaggcagaaacttcgccatgcagcagcgcatcagtcctccgccaacagcgccaaatgtggtggtggaaggggcggctacacccccttcaaccgcggcggacacagcggcaacaatggtgggcgcggcaacagcaacaatggcgggcgtggtggtggtcgcggcaacaacaatggaggccgtggcggcaaaccgcgccctgtttgtcagctctgtggaaaaacggggcacgtcgtcgctgactgtttgtataggtatgatgagaactttgtttctgataataagatggcagctgcagcctcctatggtgtggacacaaattggtatgttgacaccggagctacggatcacataactagagagttggacaaattgacgacccgggagaagtacaatgggaaggatcaaatctacatggcaagtggtgcaggtatggacattaaacatattggccattccgttattcatacccctactcgcaatttatatcttaagaatattttacatgttcctaaggccaagaaaaatctcctttctgcacgtcgtttagcccttgataatcatgcctttgttgaagttcactctcgtttctttgccattaaggatcaggtcacgaggaatcttcttcttagagggccttgccgcaatggtctctatcccattccacagtcgtcgctatcttcatccaagcaagtttttggagccatcaaacccactatttcgaagtggcatagtcgtttgggtcatccatctttgtctatcgttcaaaaagttgtgaacaataataatctcccatgtttaggagatattaatgaattaggtgtgtgtgatgcttgtcaaaggggtaagagtcatcaactcccctatcctaagtctttcagtgtgtccaataatcctttagagcttgtgttttctgatgtttggggtcctgcccctgactctgttggtggcagaaaatattatgtcagtttcatagatgatttcagcaagtttacttggatctatttgcttaagaaaaaatctgaggttattcataagtttcatgagttccaacaacttgttgagaggatgtttaatcgcaaaattattgctatgcaatctgactgggggggagaatatgaaaaacttcattccttttttactaagataggaattactcatcatgtctcatgtccccatgctcaccaacaaaatggctccgcagaacgtaaacatagacacattgtggaagttgggctttctttacttgctcacgcttctatgcctcttaaattttgggatgaggcttttcttgcagctacatatctcatcaatcgcacacctagcaaagttatacaatactccacgcctttagagcgtctcttgcatcaaaaaccaaattactcctctttgagaacttttggatgtgcttgttggcctaatcttagaccctacaacactcgcaaacttcagtttcgctccaagcaatgtgtgtttcttggctatagcaatattcataaaggattcaagtgtctagatgttgcaactggcagagtttatatttctagagatgttgttttttatgaaaatatttttcctttctctaatctccactccaatgctggagttaggctcaaatctgaaattttactcttgccctcaacactgttgaatcctgaagttgctagtaggggtatacaagaaaatggttatatgtttaatagtcctcctgttgagtctaatatttttgatgagcaagtatctgaacagggagaagaaggagagcaaaattcatatgctgcacatgatacagaaaatcctgatgatggtggcaatgatttctctgttgcttctgatgctgaaaatagtactaaggctgtgtttagttcagcgcaaagtttggattttggttgaaattggagatgatgtgactgaaaagttatgtgtgtatgacaggttgatgtgatggaaaaagactagagtttggatccaaactttgaatctaaacacaggctaatgcaagtggttcagctgaaaatagtactaatgcaggtggttcagaacctgcagcaaatacacacggcgcagaaaatgaaaacagtgctactgctgctggaagtaccacagccgaacctgcaaatggcagtggtggtggcaagtctgcgagtcgcagtagcagcagtacagcaataggtagcagtgttactgctaatcagtcggttgatgactctgtgcaggtacaacagcagcaaactagacctaccactaggctgcagagggggatacgtaaggagaaagtctataccgatggtacagtgaggtacagttttcttgcttcctctagtgaagagccacagagtttaaatgaagctttagctgattctaattggaaacaagccatggatactgaatttacagccttgattcataataaaacttggcatttagttccaccacaacatggtaggaatgttactgattgtaagtgggtatataaaattaaaagaaaagctgatggtagcctggatagatataaagctcggctggttgcaaagggttttaaacagcggtatggtattgactatgaggatacttttagtccggtggttaaggctgctactattagagctattttgtctattgctatatctaggggttggtgccttcgacaacttgatgtgcagaatgcttttcaacatggtttgcttgaagaagaggtttacatgagataaccgcctggatatgagaataagagtaagtctagttatgtttgcaagttagacaaggctttatatggactgaaacatgcactacgggcatggtattctagactaagtagtaaatgatgtgatcttggttttaagtcatcaaaggctgacacttcattatttttctatagtaaagggagtgtgactatttttgtccttatatatgtggatgacataattgtggctagttcaactcaagatgcagctgaagcgttgctaagagatttaaaacaagattttgcccttaaagatctaggtgatctgcactattttatgggtatagaggttaacaaggtaagcgatggtattttgttaacccaagaaaagtatgcatctgatctgttaaaaagggtaggtatgtcaggatgtaaacctgttgccacacctatgtctacctcagagaagttgtcagctcataatggtactgaactaggagaacatgatgccactagatataagagtattgttggggctttgcagaacttgactttgactagaccagatatttcttttgcagtaaataaggtctgtcagtttttacatgctcctactttacaacattggatggcagttaagaggatactgagatatgttaagtcctctgttgatcttggcctaaagattaacagatcttcttctactcttgttagtgctttttctgatgcagattgggcaggatctgtagatgacagaagatctacaggaggtttttgcagtatttcttggatcaaatctagtgtcatggagtgctaggaaacaggctacagtatccaggtcaagtactgaggctgagtataaagcagtagcaaatgctacagcagaggtaatgtgggttcaaactcttaaagaaattggagttcaagttcctcctatggcaaggttatggtgtgataatttgagagctacatatttgtcagtcaattctgtgtttcatgctagaacaaaacatatagaagttgattatcattttgtaagagagagagttgctaggaagcaactagagataaagtttatagcttcaggagatcaagttgcagatggttttactaaaccaattactgtttaacagcttagagattttagacacaatcttaacttagataagttatgattgaggggggctgttagaagtagcgatagtttagagatatgcatgcatgcatatgcagggagtccggtgcatgtgatatgaatgagattgatttggttgagataaaaccggatcacaacagattttgtttcctgattgtaagccacgttggaggctatttccaactgagatcaatatattcgtgcggcctcgacaagaggtgataatgcttcctaaaaaccttttagaaggaagtagcaagcaccagcggcagcgaagtcgacggttgggagaccctaaaccctagaaccaagctccagaatcgatccccttttgcctaccggtaatgggcgacccagttctagcctacaggtacggactccttcctccctctctcccagacaatcacgacatcgatttatttatcccattgctcctgttaacttggtgcgttgtttgattcccagcacttgtttcagaatgacgtgtgaaattgcaagtacagagcccagtcagtcatctcctcatcagcacggcggtacgagaagtctgggcacagcaagcaagcaggaggctagcaaaggtttgtcagctctaatccaaaaacagcacctcattgcacatattttccctgtatgtgaaagaccatataagctgtgcagacaacaggtgagtttgatctccctgtgtgtgaaaaccatctatcgtgcagacaacatgtgttattatcctgtcgtttatatgcaaactatattgatagttcgagtgactgaataatcaaaatgagtcattgtcagtgagtagtattttcatcaggtgaagaaaaatggtagataatattactatatgtcaatgtcacgcagggtttcattcagtccctacacacagattccctatgaaaaaattcattagccaggttgtggtagtgtggtcttatctgccaccagtaatgcaaaatactaatctgagtgtaaccaaatccttgaaattttcaaatattcaaatagaattgggagaactgatgaaatttcattttagaatcctgcagtgtgtgaaggtgtgaaaatgagctttctggtatctccttttccaattatgaaattatttttctttatttatgatacatctcataggtagattgaagaaattactatgacagagtgagttctagatcccaccaaaaactcagattcaattttacctccagcatagtgacatattcaatttctatctcgaatggtgcttcaatatcaatgtggggttttttttggcccttttttttaaatcttccttcctctattctttgtgtaaaaatataagatgcagtttgaaatgtattgttttttatatggtcatcggcatattcttgtttgctaaaggaagtatgtttgataaatagtatgtttcatatcagagctttttcctccaatatcttgtcatgtatggcatttccaatagcttttcatggtgtcatctcgatggcttgcatgtataagagatagacgggaagggcttgtaactataggggtaccatgattgtgtcagattgctttgacctttacggaacattatttttcaacaaaaaggaataatactgtgtttcgatatcctcttttcttgtatttcagattctgtattatgtaactcgtcgcatttggtgcctacgtttgtactatatcttactgatttacagtaggacctaagtggtgttcaatttttcatttcattcctacccctaaagataggtactgtggcatggaagatgtatgtttctgtgcaagctaaatcgcacttatgcataaacgcatggttaattactttatctcctcagttaatctacacaacttgatttccaaaaacttgatagtatcaagtgaagtctcaagggattaatacatgattatgctttgaagggctttagaaaaaaaatgctgggcttaagtacaacatgctggatcactaattatccctcttctcaaattgatcaaatagtactgcccatctcgaactatgtatattctaatatccataactgcctactctttatgatcatatagtattgtctctaataaatttgatactgtgattttatatcatgatttcttgtatagcatttttcattgaatgctttgttgttaatgctatccctcaactatcagtaggaccagttggatctgtcgagtctcataaagaagagatgcttgtgcttgtgcttgctggttcatcaaacagctcgggaaaggccttggcctctccagtcggagctccgacaaaggccgcagcgcatgcatctaggcaacattaggacctgctttgtgctaggagctactgctctactaccatcgtcaccgctcaaaacatcgtaggtaggtagcctgatttcgtctatttctcttcaatttctgcaccctgtctgaatgtctggctttttagggttcttccgctcctgtacgcccacaatctttcaagtaattgccaccagcagacctccctgcaggacatcagcgagctgcaggttgcaacacgccagcaggtatttcttaatttggatattttaattgttataatgtgaaggaatcagtggatagatctagcttgaatatttgactatctgtcattaatttacacagaaatgagaaacacatatgtagccattaatgtatatgatgtttataggtcaagctatatgtgattagttttcttaaggaagataatagctcaaagtattttcttcctcagaggagattttacaaaaagtactgtcaccggcattgcggatccccgatctccaccgccagagctgcgtcgctagactcggtgacgcccatctccgtgccggctccgatctccacttgatctccaccgccaaataccgtcgcccgcctcggttgtctcgtcccgtcctccgtgccacccctgatctccaccacccgaacaccgtcgcccgccctgtcacccgcctccacacagccacggatctctgattcgcacaaaggtacataaatcctcctctcgtttcatcatacggttcttaatattttccagaatcaaccaaaatacaacgaccaaaacaatcattatggtatattatttgtgtccaagttctgatgaatataatgatgtttactatattaattgcaccactaaaatatgggatgtcatcagtattttattttttaagctttctgcctgaattggtttcatctgtcagcgtaaggaattgcttgagtataagactcagctgtcaagagggccgtctcgccgtcgtctcaggctagggggccgccgccaattatctattcccatagagggctgctatataccggtatcccgacgaaaaagggataattctgaaaccaacacaatatcgtgcgcgtgcgtcaacaaaaacaggaatagaaacgtatcgtaccagtgctcgctgccccgcctgaatcctcccgacgaatcctcctccagaatcgcgctcccgcgtgcgattcctcgccggcgcgagctcctccgcaacccgacgaatcgcgattcctcaccggcgcgagctcctccgcatcccgacgaatcagcctcggaatcgcgcgtcctcgccggcgcgagctcctccgcaacccaacgaatcctcctcggaatcgcgcgcgattccgagtcggcgcgaactcctccacaacccgacgaatcctcctcggaatcgcgcgcctccgtgcgtgattcctcaccggcgcaagctcctccgcatcccgaagattcattcgcggaatcgcgtgcctccatgctcgtttcctcgactgattccattggcgcacacgttgtctgccaatttcctctgcaatccggcgtcttatgtgattgctgaaatttttcacacaagtagcacatgattcttgtggttttcaaagatgatactctattaggatcatgtgatactcttgaggatcacatggtactcttgttatcttgtaggatcatgtgatacctctgtagcatcacatggttctcctcaaaaaagtatcattaagtgtgatacatttgaggtatcacatatgatcttacttaggtatcatgtcttctaacatgatccctatgggtttcacagatggtacttaatggtgtgatactttacaggtatcacacatgatcctactaaaaaaaatatcattaagtgtgatacatgtgaggtaccacacatgatcctacttagggatcttgtcttttaacataatcctacttgggtatcatgtatcctacttaggtatcatgtcttctaacatgatcccaataggtttcacaaatgctacttaatggcgtgatacttatcacacatgatcctactaaaaaaagtatcattaagtgtgatacatgtgaggtatcacacatgatcctacttaggtatcatgtcttctaacatgaacctacttaggtatcatgtcctctaacatgatcctacttaggtatcatgtcctctaacatgatccctatgggtttcacagatgatacttagtaggatggtgtgatactttacaggtatcacacatgattctacttgggtatcatctctggtaacatgatccctgtgaggtttcagatatgatactttagtaggatggtgtgatacctgtgaagtatcatacatgatcctacccaggaaaatcatctatcatgatacatgggtaggtaggatcatgtgatacatgagtttcattatgattgatacatgtgaagtatcacatgatcctatctagtatcatgtcttgtaaagtggttccctactggtttcacatatgatacttgagtaggatcatgtgaaccctgggaggtatcatgatcctcctcagtatcatttcctcaggtttcatatgatactgaactcggtttcattgtgtacaacgtactcaaactatatatagtccacagaaaaggtctacgcaatataatccacttctttaccaacatatatgtacatgaaaacagtagccacatacagagttcatgtctttgattgttgtgccccttgcaaccttccagttcaagacaaaaacagtagccacatacacaattctgaaacttgacttgttacatatgttggttgggggagagggagggagggagctacaaaaatggcctaagcacacatccgacactgcttgaaccgaatgagcatattggttctgaagcttagaaacgacgttttggatgtaagtcgttaaagcgatggtacaacaaccttttgcatagctcactacgatattctttcatgtagtcctgcatagatgacaagaatgagcagtgttagatttgtcaaagtggggtgaagctgagccgttgttcaaccttggagagcaccttgtcttctttgaaacatgcatgaaatcggattcgcttgaagcaggtggcaacgccatttcaactctgtgcacatgtgtgaacggataaagaaaatatcatttcaatggtgattcatcctcgattgaacaaaagtatctaatcattttaaaacagaaaacacccatgtagccactaagatatgcaaaacatcaacagaaaaaaaaatccaaatcatctgcatctatgactcagctgcatctgccatctctgtcgccacgcactgccctctatgacaaagaggataacaattgacaagcaaagcgtgcccggaactagaagccaacaaccgactgatgcggatttctctgattttgtttacacttcagttcacccaaaaaaaaatcctactagttgaatggagatttctctgtttcaaaacagtgtgtacttgttaacggcaaaattgcttgctccaagcaatatttgccttcccatcaatatacagctagaagcatttcaagcgatctattccaattcgaacattttgctgcaagtatcatatgattcagcacatacacacatccctcacctctgctacaaacacccccagtgaatgaacaaaaacacacagaaaaaagagagagagtattaacttactttgatttcaatttggatgtgatatgatgagccccatccacaaattagtgattcaacaaaccctagaaaatgcaaaaatgaagagatgttaaatcaaaatcaggaaatcgatgaaaaaagaggaatgagagaaaggggtatcgtgcgcaccggctctgccgcagcagcagccaccggctccgccgcagacgccaccggcttcgccgtagacgccgccgccacagccgccaccaccacgctcacgccactctccctctctggcactactgaccttgtgcgcatcggcgccgctgaagaggaggagccgcaagcaggctccgccgccggctccgcccgccgccgactccgccaccgccgccggctccgccgccgcagccatgctcgtgacgatttgggagctgtaggtgtctgtttgggagtgactcagggccgttttggattgctaccaaaacttagccttaccaatattttggtagtttaaatagtacatgtgcttgtttggattgagaccaatttattggtaatgcccatgctagatttgccatcaatctagaacaatcttcactagaagtcacatgttggctttatattggtaccaaaccaaatataatcttatcctaccaaaaaattggtaggaccaaaatttatctaagatttggcactactaaaaatttggcatggtagcaatccaaataggccctcaatgtttctcgagtgtgtgtatctgatccgtgagggtgtgtgtttgatccgtgggaaattgtcccgtccggggctgactccaaacggtataccggtgactagcatttctgattcccatatcactatgaacaggtgttttgcgctcgcaaaacctccttccctgaattgaaggtacaagcaatttcaagtttttataattttcataatgggaaacctgtttagattgtcgagttttcagattatttagaatggggtgcctgtttagattgcagcataggtaaaaaataaaaataatatactcaatgcagttctaacccctcgatgcattatttcagttgaagttcagcatctaaaaacgtatatcgcctctccaaacatgatgtgtactaaaactaatgagaaatgcttcctcttgattgagcagatattcattgtgaaacagcactataaaccatgtttcttctatcatcattaaaaggctgaatgaaaaatgccagagcgagcgttcctctgaatatttctgaatttggcgatatcatttctgggttgttcttagtgaattttgaatataatcatttttattttaatcatgattgatttgcacactaatgtcgtcatctggcaggagcacaagctacccattcaaaaatcggtgttgggcaaccagccgcttctcttcttgggaccccttgctgtttcccgtcgacgtcgggctttttctgacttgtgggttctactattttattcccctgttttccttgtgtgatcgatacgattggttaattaatgatgcagaactagccttttgtttttccgtggtaccaaaattgacctttggtagctatgaacgacatatgtcttggcatatttcttgcggtaaaaaggttaaattttattgtacataggatccgtgccctttacagttcctaaatcctactgggcagatatgttcactcgagctttgctcaatgcgatcattcacactatatgtttctctgcttattttctgaataagctggtaagtagtattatgccacctatgagaaaaaaaaagttattatctgcatgtgtgagaaaataacttattaattatctgcatatgcttccctaattcaaatagcaggcttaatcttttgtcaagccaggaaaaatgctaactgtctcagcattactgcagagtgtgtttgggctgcaactaatttttgaagtgcagtgagtctcagaccttggagataaattactgaagaactggactctaatgtgagtacctgtttaatatctgttctattaaccttcaaggatttctttgtaacaagttttaaattcagtcaacattgcttaagacttaagataattcagtatattttgttataaattatgtgccgctatggctcttttcaatgcgcattcgctgtttggaatgcgagtatgttcaaacttaagaggagcatttggatcttgctgttttaaaaccatattggtgaatatgcagatttctgaattgctctttcaacaaaaataaactataatatacacacattacttcagcaaacatgactttagcagcttagcttttctgaaacttgatgggtgtgtgtttagtatgtttgttgaagtctgatttcagagataaacttagaggtacaattgctcagctgccaagatctgttttgtagaggtacaagtacaatggcagaatttatctcaccatgattcctttttatatggtgaaagaataaaggaacaaaacaaaacaatgataacttgctcagtagcactttgagacaatcttatcctcactttagaactccatgaagtgtgtgatatgagtttctgaccatattttctgaatttggcttatgttgtattttaattttgtagtcttgggaaaccattttaagcctctgaattgttgtagggttgatcactttttctaggccttttgtttttcacctggcgatctggcatcagatcagactaattatttgtctagcccttaattgttgtatatttgaacaatttgcacaattatttgagaaaaaaaggaattacctcaggattgattagtcgcacagaaacccatcctttattttcacatggcctggaaacataaggtgcagatattatcaccttccatgaaaataaagtgtactatttagtactgtatagtgcacaacatatgctatttcacaaactgtttttagattatcataagttgtcatgattccttataagtttctaattatgaaaatgaaagtgttgtaagcatgtctgcttgttttccattgccagacagactccattttggattttattaaccaatgtggtatgtattgtcctggttatttctcaaattgctcctctaccagattggctgaatctggaaaaaaaattatgagattgtttactacatactaagatttaccggtaaattatccaattactctcttgcgtccttgattcctcaactattaattaatcttttgcaccttgtattttccaatattgttattccttcgacaaaataagtttttactcttactacgattcactggtcaaataagggcatctcataattaatgtggtgtcaatgtatatattatacaatacatgtgcgacatatttaattgcaattaggaattttacatgtcaagttgttgaaggaatcaaacagtagatgatatcttgccaaatcggactttgctctaccaattgatataaatataaagtaagcctctattgaaacctatggtgctgaagttaatctttgccaatcagtactatctatctatctattatataatatataattaaatgaatagaaaaaaggagcctccacgttcgctctcatggcctagaaattctcacattaatcggagaaaaagaagaaaaagaaaaagcagagtccatatagaaatacaatttaaaaatagaagaggagactagagtccatatagaaatacaattaggaaataactgaaattcggaattaaaatataaggaatattagaagaggagactagagtccatatagaaatacaattagaaaataactgaaattcggaattaaaatataaggaatattagaagaggagactagagtctatatagaaatacaattaggaaataactgaaattcggaattaaaaataaggaatattagaagtagagtatatagttcatatagaaatacaattaggaaatgaaagaaatttggagttaaaaataaggaatattagaaatagagtatagagtccatatagaaatacaattaagaaaaaaaatacaaattcggaattaaaaaataaggattattagaagtagagtatagagtccatataggaatttaaaactaactaaaatttggaataaacgagtccatatagaaatacaattaggaaataactgaaattcggaaataaaatataaggaatattagaagaggagactagagtccatatagaaatacaattaggaaataactgaaattcggaattaaaatataaggaatattagaagaggagactagagtctatatagaaatacaattaggaaataactgaaattcagaattaaaaataaggaatattagaagtagaatatatagttcatatagaaatacaattaggaaatgaaagaaatttggagttaaaaataaggaatattagaaatagagtatagagtccatatagaaatacaattaagaaaaaaaatagaataactaaaatttgatattaaaagaaatattaaaagacgagtctagagtccatataagaatatatataatttacaaataactaaaatttgatattaaaaataattaataactaacacgtatataaaatataatataaaaattcagaaataaaaataaataatataaaaatatataataatgctagccgcgcaatctgcgcgggccaccatgctagttttctgtatatgtactatggtttctaacaacaggtagcggctttggtgaggtgtgatctgattgctcacatacatgtttatgctttatacttccaagttgcaaaaaaaataaataaatgataccaacgtcctcttgttttatacagcacatcatcacaatttaattggaataatgtgtaattatcttctccatactattgcgttctagatgtgtcagtttgcaccgggctgataatatgactatatgttaacacttgtatttctttaaatttgtactttagcatcggcaaattttcgttgtcgttccatgtagatcttaaaagaagacgttaacgagatgaccaacaattgttatcttgttttacatggtaaaactattaatttgatatatgtatcatatcaaactgttatttgagtttatattcacgatcttatgctaacacaaaaaatattttttttgttaacatgaaattttattgagcttatattcaagtcttatgctaacacaaaaaatatttttttgttaacatgaaattttattgaggttatattcatgtcttatgctaacacaaaaaaaaaattttgccaacatgaaattttaaactttattaaagacaaatagaaatacagtgtagcgtttagcactgacatattactagtaatgactggttattcattgccaatttaaaaccaccattattttcgccgtggggaaatgcagatgggccagtccaattaggcctaatgtatgcatatatgatggttcccatcatcacaaaaatagtccgcaaagagattttaatcatatgaaaatataaaacgaccgacatatatacgagcagtgttgtggaaaacggtgttaacggccgttaatacgtccgataatacggatacggagatcagtccatcacgtcacgccgatccggtcattattagtcggtaacgaacccataaatccgatcattaccgattaaatcgtccgtctccgtctaatcagacgtataatcggcgtgatgacaaaggtcgattccacaatccagctcattagctgtgccctttggattcggatcaagtgcagtcacagtagtgactgcaactttggcagtacctaatcatccaaccatccagcacatgagggatggtccagatttaactgtgtcatgcatcattttagctatttgaacaagcacagaacagcttcagttcagattttgcctgcaatttctctccttttgatctgaattttcttgaactttcagaaaacccaaatattgttaaagaaaagtagacacagacttcatttcattatattgaacttcataatatcttgcacgcataattgacaaaatgagctagagtttaactattttcgctgaaattgggtgtcatgcatccactgagacaaaagctttcaaaatcaactagccatgctactgctagattaacccagtaacaaaagctttcatgatccaaaagtagatcatcatctgcttcccaaatcagcacgatgccttctaagttctattgacctcttcaaatgaacttttgagataagatgacatcttcaacgtcaatagaaccctagggaaaaaaaaataatatccaaattaaaataatttgttagcacatatatttatctttgaagaaactggtcagcataccagtagaagttgggcatagctgctaattgcttcacattcttgatgttcttccacatcagtttgcatgttttcctcctctgccttttcttcaggctgcataacagatttgagaagtggctcaatatatagttctcaatatatatagctgcataacagatttgagtagtcgctcaaatatatttacctttctcttttttgttttttgcagtttatcaatccaatttgttttccgttttgttacacgtttccggctctcctttttcttcagaccagagacatgtgccaagttctgagctaactgggatgttgactgatcattcgactttgcaatgccatcactgtaagtttgttttattttgtcctcaacttttttactaacggcatgaagtgcttcttccacaagcaagtaacattcttcaaagtctgcagctctggaagccaaaggaagaaattgctggtacagatatctgtacctaagagtagtactcagcttggggtcttccactatttgtctgccatgcatatcttgaatagctccacattttgcttctcgagtccaacgcttcaatacatatttttcaggcaacaatttaatgttcactaaatcaagagctttcaaggcatgtctacacagtagacctattctctcaaacaatcgacaactacacgacacggtctgatcaaaagggttggcagtcaacttgtgctcatcttcaagtatgaactgatcatcaagtgagccaattgcaattatgaaatcattacttccatttgatcctttcgtataggcagccatggatttcttttttttcgccgggccggcgaatagccggccgatgtatattaagagtaagaaagggaatgtacaaggtagcgcggtgcgtcaatgcaccaccatttcagacataaaatgaaagctaaaatctcacagaatgagttgctacagagtgacacatggggctaacaagacctgcagctatccaagtctcccattcatcccccatggcggaacagccatggatttctcatattcggcttggaagacttcaaataaagcaggtgtgtaaagcttacttgcctgtaccaaaataggtgtcatcatcataattcttggcaaattctttcttgattcatattcagattgcaattccttctctctcttttcttcaacaacacgctctacacgattaaggaacctgccgatgtcaagatctgatttctaatgacctttcaagttactattcaaactttcacttaattgtgtgcttcgcatccctattgtgaaaacatctgacatgtagcactcagcccacttttcttttaaattgtatatgctatccaaccaagtcactttacgcaccttttgtctcatggcatcaaatacttcttcaaattcttctttttcctcatactcatacatacatgcactgaaatctgctaggatacttgaaccttctgtttgttgaggactcaaatgctttactgcattttgtgatatgtgccaagtacataaaccatgccatgcaccagtgaatacttcagacacagcctttcccattgcaatgtcttggtctgtaaaaatggtttgaggttgcttttgattatgggctgataaaaatgtattgaacatccacttgaatgattcaaatgtctcatcatacatcaaagctgcaccaaaaaccactgtctctctaaaatggttgaagccaacaaacataccaaaaggtctactttctttatttgtcccgaatgtagtgtcgaaggtgatgacatcaccaaagtgagcataatcagcaatcatcctagcatctgcccaaaatatattagctatttgttcttcgcaatccaattgcactgcatagtgaaatgagggattttccacaattttatcttggaagtactttagtaaacttcctgcctcaccataaagtaagtccctttggcgcctagaacgcaaataattcttatgatcacgctgtgtgtaaccaagattagctgacccaccaacatgccgaccaagaaactcatgtgctgctttaggtgtaataccagaatcatacgccacctcaatttcgactgcttggtgtttagaaatgttcctttgtgatggcatcaaacggcttgtttgtggagtttgaagaagatggctgtgttctacagctaagtcatgaaccttgtatgtcattgtttccctgagtaaagtgatgcccatgcgaacttggcaaccagttcgagtatgagttcgattacgttttgctacagcatatttcttttcttctgctctagaaccctgatttgaacaaacaaacctactggatgttactaactgatcaagatcacttttgttagtgtaattctttcgaacatcaaagccaatacgaccaccatatttgacccaaaaatcccaagcttcttcataggaattaaatgtcataccaatttgaggcatccaacagggaggtttagtagatctgttacattacagtatagaggaataaaaagtttgatgcatgaacaaaacaggaagaaagaagacaaaaatcagaagacaaaggatcctatcgcgatctgtacctctccaggttttgctccatggccttctcaacggtcatggctgaacagagaagagaaaaagaagcgtgtgatgtgcagcagtagggggtaaagtatgcttcccatggtagaattggcgccaattctcacctccctctcagacttttccctccaaaacacatctgctggagtcagagagtaggtgaaaagttgggggaaattgagcaaccaatctagaccatcccttgtgtgctggatggttggatgatgggtactgctaaagttgcagtcacagtagtgactgcatctgatccgaatccgtgccgtttactactattgactagaagtttgctcttctgaaattctcacaaggcagcaagatgtaaaatgacaaggaactgacttcctctaaaggttttgaacatgagttccttgattttgatgagtttgctcttccggaattctcataaggcagcaagatgtaaaatgacaaggaactgatttcctctaaagtttgaacacgagttccttgattttgatgatgatcacgttattggagtttgtatttgatgaagctcttcgaggtaaccgatacacatgttatttgggactttgattacggtcatttatgctatgtaacattctcttgataattcatttcatgcattatgaacaaaacccatcactacgtgagaattgagatatacagtaacagctatccattatgaatttatttaaatgtcatatatggttattctatttaaggatatatatagaaggaatatatttagttatatgcatttgtttatcaaaaagggaaaactattatcaactactacctccatcctaaaatataataacttttggctatgatagctaaaaatgtttatatttttggacggagggagaatgtacatatatttttaaaacgttatatttccgccaaattccgattaatcatttggcggtaccctttgtctgatacccgtataccgttttccacaacactgtatacgagtattgtacagtttctgtaaacatcaataatatcctcgaatttcaaaccatcaataatacaatttgttactccatctgttttatattataaattgtttgacttttttttctaatcaaagttctttaggtttgctcaaatttaagtaaaaaaaatagcaacatctataacactaaattagtttcattaaatttaacattgagtatattttaataatatgtttgttttgtattgtattgtaaatgttaccatatttttctacaaactcggtcaaacttttttcggtttgactaagaaaaaaatcaaacgacttaaaatataaaagaaatggagtattatcattccttcaatccaacaacaaacggagcatcccattacgcggctctcaaaaaagtgagatgcaacttatcaaagtcgatgcaacctcgcgtcaagtgtcaagttttgtcggtgataaataaaaacctcgggaagaatgatggcaatgcgccgagagtaattgtaattatctatgagataaattatagggaccctgctatgagataaattatagggaccctgggtatacatatttatacacacaaaccgataagagttctatttagacatgacacaaacatttgtaaagataaaagaaaaaaacattcataaatacaaaacttatctgccatgtcgtggtcttcgtaactccttttcaaactcgatctctgttgtataaatcttgtcatatttcgttaacgaaatttacttaaatattcaaaccaaattttagcattaacagttctctatgcatgccacattttgccacggccttgtttagatccaccctaaaatttttcaccctatcacatcgaacgtttgaacacctgcataaagtattaaatgtaggctacaaaaataattaattgcatagattgcgactaatttacaagatgaatcttttaaatctaattgctttatgatttgataatgttgtgctacagtaaacattgctaataatgattaattagacttaataaattgtctcgcagtttatacggcaaaaattcagtctaaagtaattcggcgggcgatgggccccacagtacaacatctcgatttgctccgatgagataactgtcccgtatggccgtatatatctgtaaattgcccaacaaaaaaaaggaagaaaagaaagaaaagcttctccccgagctccgagctcccgtgccgcccgctagagagatctcgcccgccgtccccgagatcccgccccgccgtcgagatcacgcgccaccgaggagaggagattcggcggtccgcctatcgcgtgaggacgagcgagactgcatactccagaaggtgcgtgatttcttccagatcgaagatactctttgtcaaaagaaaaaaaaaatatagaaaagaaaaattttgaatagaagaatatcaatagagacgatgatgcggcggtttgtgaatttggtggtggacaccgccggcgtcggcgccgacgcgacggcgtgcaagctgtaccgcgtcgctgcatcggccctcttttcatctccagcacgtcgtcaagcagcagccaaagaactagatccagatgacgtggacgacgccggcggcctgcctcctccggccatcaccttccacccctcctcattgtccggccctggcaacgtcgatttcttgcacctccccggcgacgacagccttctcgccctcgacgtcgacggccgcggtctgctctatagtgccgcctccgccgccgtccgctacatgcccgacccgtgcaagcccaagatggagcccatctccttcaccgccggcgatagcgtcctctacgtcatcgagagggtgcccttctccggtaaccccggctgcttcgaggctctcacctacggcctactcccccacgacttggacaggatgggctggtactggcggtctcttccgccgcctcctttcgccaaggttggctacgacggcgacttccggcgccaccgccagcgccgagagtacgacatcaccgcctccgcggtggtgaacgagacggagctgtgggtgacggcgcacggagctgggaccttttctttcgacacgcaggttggggagtggagggggcgcggcgaatggcggatgccgttcaaggggcggggcgagtatgtggaggagcacggcaaatggtttgggctctcctccacgccgctgcaggggctgcacctctgttcctgcgatctctcccatctctgctgttcctacgatgtgccggtggtcaggcgctggttggatggcctagaccgtctgccggcggcggcgccgcccaagcaatcctttctgatggaagcctacgccgtgcacctcggctccggtaggttctgcatcgccaggttcatggaagaggaggaggaggaggaagttgaggaggagaaggacaacatctcagttcatccattcttccacgtcgccggcgtcaacaacaacaagaagaagaacgacaggttcttgctgctcaccggcgttgatgtggtggcctgtgacgacgccgtcctcgtgcacaagtctatacgctacccattccaaaacggcgatttcgttcgtggttactctcgactcttttaatttcatctaatttacttattatacctctctccggtaaaactagctatattttgttttgtgacggagtgaatatatcatttttatatatatatcccttttcctttcgattgcaataatagtaataatgctgtatatgaatggtactttttgggtactccattcgtttatattaagaggctgtcctcttatagtcttattatacatgctcattcttgactctggaaaaagaaactttttttttgcaagttagaccgaaggattgaccgaccaaattttattaagagagaaaaggggttataattgtttacaagatcgacattaagctgtcaaggcaaagtgacaaccaaaccagtcatcagccgaaaagaaaaagtgaaaacagaacagaggccaactaatcacattgccaaaaaaaaaattcctgcttccttctaatgatcatatgatgaattccacttacagtactacaatttgactgcagctattttgacaattaagaaagcagagtgttgtaaaatttgggcataataagatgatatatcttccttagcagttagcacagcaacaacatcccaaaggtgaaatgtttttgaccggagtgatgcaactgcaacatatattccaaatagattctctctgcaaaattaaattattcaactagttccatctcattgcacgcctgcctgatgtgttgttcattgtatctcaaaaatcatatttgcagcagagcagaaaaaaaaaatcatttgcagcagagcagaaaaaaagcatcagtaatccatgattattattattaattgctcacatcacatccggtggctcatggacgcgagcaaatgagtaataatgcaatatatatagatggacgagatgatcatggcatgtcggcagcgtgatcgtgatcgatggcggcgacggggaggtgagtggaggaggagggcggcggctggtcgtcgtcctcgtggcagcagaggcagagcatgccgcggaggaggttgcacttgccgccaggaagccgagctgcttgcagcaggcgttgcacttgcctctaaaatccgattttatccccttgaatacgacgcgaatttggattcgttttcgagtttatctctccgccaaaccctaggttttcccggcgtgattccttgcgttccaagcccgatctctctctcccgtggctataaatagagtccccttcctctcctctttcgtttgcctcaagtcccagccatcgctgttgcctgtagcgccctacccgcggtcgccttctgtctccgccaccggcagccgttccagccgacgcccttctgcgctgccacttccctcggctccgaaaggctgatctccatcccggccgctggttaccttgcgccgaaactcgccggaagcccttcgtcactttgaatccgatctactccgcctccggccgaacaccaccgttgtttccgtcaacgccaagcttcgccgttgccttcctcggcatcacagcgccaagacgaagcccgtccacacctccgttgctcccatcgtcacctacggtcgccggccgttttccgtcatcgattctcgtcaccgtcaccaccggtgagttcgtctcgtcgtcctctccgcgttggtgctctcggatagcccggctgagcctcctaacaccggcgacctcgcggaccagtgcatggtcggctgtgatgtcatcgatgatgtcattatctatttaataaatcgtgaattctttgctgtataaggctaaaatcagtttaattaatcttgtaaaattcataactaattcatatgaagtcggaattaagtggttcaagtctctaaattcatctaaaatcatgatctacatgtttgtttactttatatgtactgtttatttggtttttattagtttttttttctcgttttgcgtgttagctcgtcgttttcatcgttgcgaaggttcgcgagtgcgtcggaagtgttcaagaagactaattgaagaccgattattgtaaggcaagtcacacaaatcccaaatgaccctttgagcatgttgaacccatttaaagctattgttttattttaaaatatgcattattttcgaatgtcattgggtggtgagtctttctcatttaattatggccgaagatgactttattttcctatggtaataaattgattagcttaaaccttatatattggtttggttcagctagatgttggacataattgcttagccatgcttagaaacattagcacatgattgggataactaatgttacactatcacttatgattatatttaatggtacccatgatggtcaatcgtgattggttaattaattacttgccaactaaaatttgattaatggtgggttgtgagcacatggttttgatggtcgtgctcatgacaattaaggaccggttcgtgagctactgttgtgagacattaaccatgccaaccataagccagcgtgggcaacggctttaccttttgtatagcatggttcatcacggggtgccagactgagaagcggcgagaagttcgtgggggtcgctggggagtccatgccttgttttataagggggtgattatgatccaggaacggtgcactgtggtgagttgtgttgtgcagaggatattgtcacagcctctattcgggtactttccagtatcgcgacgcatggtagacatgatgttgaggctttgtcttgtgggtacagtggtacacctctggccagagtaaaactattcgaatagccgtgcccgcggtcatgggcgggttgagcaatgtttcttgtgattagtctcacacctctcacaataattattggtgctataactggtaataatttgcttagctcctggtttggagttagatctgtacagccgggtatggttgtttaggatggtcgggcctgagcagcatgggtgtgctgttcagtgttgattaaaattgatgaataattactctactgttttacttctaaatgtttgctaaatgctgcttttgcaaatgagcctatattatgccatcctttggtatccttgtgcacttgcatatttgctgtgtggcttgttgagtatgtcatatgctcaccttgcaataatcaatcaacctaagttgaagaaaaatgatccagaaggagaagacgtttggcttataccccagttgagctgcctgtgggagtggagccggagcttcgctagatcgttattccgctgttgttttttttttcttttgtaagtatgtaacgttattattatgatggatttgtatattaaattatcagtttgtgtacctcggctgattcctggacgaggattttttgcacaaattagttcagaaattactagtgaatttctgggcgtgacagtgatccacatgtcaaggccaacgcgctgctgcaagctcatttttcaaggcgcactatcttggcagccgaccagcgggagatactcctttctgctcatagattgctccaggcaatggttgatgttatctccagcaatggatggcttacgcttgctcttaatgcaatggagctgagtcaaatggtgacacaaggcatatgggatcgtgattctgttcttttacagcttccacatttcaccaaggagttggcgcggagatgccaggagaatgaagggaggcccattgagagcatcttcgatctggctgagatgagcatcgatgagatgcgggatctgttgcagctatcaaaccctcagctacaggatatcattgaattcttcaagcgtttccccaatgtcgacatggcttacgaagttggcgagggtggatgatatcagggctggtgacaatgtaactgtacaggtgaccctggagcgtgacatgacgaacttgccttccgaggtggggccagttcatgcccccaggtacccaaagcccaaggaagaaggctggtggctggtaattggtgatagctctaccaatcagggttgcacttcagaagagggctcgagtgaagcttgagttcaccgctgcttcagaagctgggagaaaggagtacatgatctacctgatgtccgattattatctgggccgtgatcaggagtacgagttcaccgtcgatgtcatggatgctggaggggattgatcccaaggcaggaaagaggatgatagctttgcccagcccccaggttgtgtatgaaactgggtggttgcttgtacgctcgtagcaattcctagaagatatcaactttaaacactaactaattaatatcctatccacacttgtatttgtttgttacttgcttctatcttgttcattttctcattgtaactgatgcgcacctgtgctgctacttgtgctcagccttggggatctttattagcctatggctgcatgtgcttcttgtgatcatccttcatgttgtgtttttgtcttcctgtttcatctaatcaagtcattcatgtcctgattctatctacatcatttgatcatgcttggtcgtattatttgttgtatctcatatgttcatatagattgctccagccaatgcttgatataattattgttgcgcaactgcttgcaacgggtttggcttgttctggaaacaagaagtgatgtactaggagtaggacgtgctgtgcagtgtacagtacaccgtcaatccctaccctgttgctcacatggaccttttggattctcgactgcatgcatacatacaaaactgtcactcttaactaattgttgtttgtgtagggtatggatgtcaaactcaactattgttgtttgcgtagggtatggaggatatagtatataactggatttttaaaaataagatcgaacgtggcaattccattaacaaccaaacaaaggtgaagaggtcatgggctaactaactgtgtgaatagtcaacgtagagacttatcgaaaccaccaaagctaagccagagaataaaaaagctcaacgcgcactcttgttttgtttgctttgcgtacgtaagaaaggaaaaaaaaaaaccttgacaaaaacacatgatggataagactagatggaataatattatattattgcctcaagtataaataaaagtcattacggactttttactagtactgctattccaaaataatatccacaaggtaaagttagaatatgaggagagttagtacttagtcttggaggaaattaagctaagcaagggtaccagcagcaacgccaagccaacaatggaggagacctggctcttcctcctcttctccatctcgctcgtcgccgtcttgctcgccaccgctcgccgccgccgctctagcagcatcaaggcgcgcctccctcccgggccgtcgccgctgctcttcctcgccaagttcctccgcctccgccgctccatcttcgacctcggcccgctcctccgcgacctgcacgcgcgccacggccccgtcatctccatccgcctcttcggcaccaccctcgtcttcgtcgccgaccgccgcctcgcccaccgcgcactcgtccagggcggctccaccttcgccgaccgcccgccgctcccggagctcggccgcctcttcacctccgacacccgcgacatcaactcctccccgtacggcccctactggcgcctcgtccgccgcaacctcgcctccgaggcgctcagcccggcccgcgtcgcgctcttcgcgccggcgaggcggcgcgcgcgcgacgtgctcgtccgcggcctccgcgaccgcggcggcgacggctcccggcccgtcgagctgaggccgttgctccggcgcgccatgttcgagctgctcctgtacatgagcctcggcgccaggcttgccccggaggcgctcgaggaggtcgagcggctggagctatggatgctccgcgccttcaccagcttccccgtcttctccttcttcccggcgatcaccaagaggctcttccgcaaccagtgggccgctcacgtggccgttcgccggagggtgggcgagatatacgtcccgctgatcaacgccaggcgcgccggagacggagacggcgacgacccaccctgctacacggactccctcctccagctgcgcgtggccgaggaaggcgaccggccgctgacggacgacgagatcatcgcgctctgctccgagttcctcaacgccggcaccgacacgacggtgacgttggtggagtggatcatggccgagcttgtgaaccgccccgacatccaggccaaggtccacgacgaggtgagacgccggccggagctaaccgaggcagacctgcaggcgatgccgtacctcaaggccgtggtgctggagggcctccggctgcacccgccggcgcagttcctgctgccgcacggcgtgcagagcgacgcggaggtcggcggctacgtggtgcccaggggcgcggagctgaacgtgtgggtggcggagttggggcgggacgaggtggtgtggacggcggcgagggagttcatgccggagaggttcatggacggcggcgaggtggaggtggacgtgacggggagcagggagataacgatgatgccgttcggcgtggggcggcggatgtgccccgggtacacggtggggacgctgcacgcggagtacctggtggggagcctggtgagggagctggagtggctgccggagacgaagggggaggcggcggacatggcggaggagctggatttcaccaccgtcatgaagcacccgctccgtgctcgcgtcctcccaaggccctcctccctctactaatcgtgcttccatggatgaatcatgcatgaagaataacatgccaatcgatagttttgtgatggttgtaaaagcatgtgtagttttatgatacgtactttatgtttaaatatgtgtaatactgttgatttttgaaataatatttcatcattgtcttatttaaatatttagggtaaatataaaaaaacataaatcatgtttaaattatagggtacacataagttgtaataatatgaatgacacatgcatgttttttgttttgtaaaatgaatggtgaatcgtcatatgagtcaaccgcagcgagacgtacgcggtgatttcgtgaatctcaagatataccagttgagtctttgatggtgcttataaagaaagagtgtgcatatgtgtatccatcttatgtttgtactatcattcaaaaaaacaataaccatgaaaaactcaattcatcacccaaggggatatccccttattttcgcatgtcacttaaaaagtcatcaaaaaatatgaaaaaaaatagtaagataaatcaatatgtaatatgtcacttcacagacatacaaatacaaattcaacttatacaagtagaaacaaaaataacaaatttgtgaatttttgtttcgaattgtataagtcaaatttaaaatcgcaggttgcgaaaagatatatcatacattgatatatcatatattgatatatcctgatatgttttttataattttttttgaacgacatgtagaaaacgagaaaatattccctcgagggacaaaattccacttcctatgatatactaacaatatacgtttgaaaacggaacggtgaaataattcattgtagaggaaaatatatagatgaaataattgcctgcggaaaaatactttgggctttgatgggcccgtggtttttcctcgttcagtcggttgtgttttatcgtattttcccctgaattcttgttgtgtaaaggaaaaaaacaaacaaaaaaaaaccattgtagaagcagatgcggcggtttgtgaatttggtggtggacaacgccggcggcggcggcgcgacggcgtacaagctgtaccgtgtcgctgcatcggccctcttttcatctccaccacgtcggcaagcagccaacgtactcgatccggatgacgtggaggacgccgccggcggcctgcctcctccggccatcaccttccacccctcctcattgtccgtcggccctggcaacgtcgatttcttgcgcctctccggcgacgacagccttctcgccctcgacgtcgacggccgcggtctgctctacaacgccgcctccgccgccgtccgctacatgcccgacccgtgcaagcccaagatggagccaatctccttcaccaccgccggcgatagctgcctctacgtcatcgagagggtgcccttctccggtaaccccggctgcttcgaggctctcacctacggcctactccccgacgacgacgactcactgtcctccaggatgggctggtactggcggtctcttccgccgcctcctttcgccaaggttggctacgacggcgacatccaccgccaccgccatcgccgagagtacgacatcaccgcctccgcggtggtgaacgagacggagctgtgggtgacggcgcacggagccgggaccttctcgttcgacacgcaggctggggagtggagggcgcgcggcgaatggcggatgccgttcatggggcgcggcgagtacgtggaggagcacggcggatggttcgggctctcctccacgccggtgaaggggctgcacctctgctcctgccgtctctgttcctacgatgtgccggtggtcaggcgctggttggatggcctagaccggctgccggcggcggcgccgcccaagcgatcgtttctgatggaggcctacgccgtgcacctcggctccggtaggttctgcatcgccaggttcatggaagaggaggaggaggagaaggacaacatctcacttcatccattcttccgcgtcgccggcgaaaaaagcaagaacgacaggttcttgcttctcaccggcgttgatgtggtgggcagtgacggcgccgccgtcgtcgtgcacaaatctatacgctacaaattccaaaacggcgatttcgtttgtggttactctcgactcttttaatttacttacacctctctccggtaaaactacccagtatatttcccttttccttttcatttcgagcgagattacaataataatcttcttcgtttgtaatagagtaataatcgaaatgctgtatatgctccattcggcctttcgtttatattaccaacagacaaggaattcacagccttattaagaggctgtcctcttattatatatgctccttcattctggaaaatgaaaacttttttctttgctagttcgaccgaaggattgaccgaccaaattttattaagagagaaaaggggttataattgtttaacattaagctgtcaaggcaaagtggcaaccaaaccagtcatcacccgaaaagaaaaagggaaaacagaacaggggccaactaatcacatttcccaaaaaaaaaaatcttgcttccttctaatgatatgatgatttcctcttactgtactacaatttggctgatgctattttaatactacttccatattttaatgtatgatgctgttgactttttttcaatgtttgatcattcgtcttattaaaaaaattgtgtaaatatcatttattttattgtgacttgattcgttatcaaatgttctttaaacatgacataagtattttcatatttacccaaaaattttaaataaaacgaataatcaaacgttagtcaaaaagacaacggcgtcatacattaaaatacggagggagtaacaattaaggcaaggtgttgtaaaatttgggcataataagatgatatatcttccttagcagttagcacagcaacaacatcccaaaggtgaaatgtttttgaccggagtgatgcacctgcaacagatattccaaatagattctctctacaaaattaaatttattcaactagttccctctcattgcgcgcctgcctgatgtgttgttcattgtatctcgaaaatcatagttgcagcagagcagaaaaaaaaaatcatttgcagcatcagtaatccgtggttattattattaattgctcacatcacatccggtggctcatgatccagccaacatatatatgtactccaactataaatgggagtagatgagattggtacctgcagtgcaggtatgtgtgtgtgtatatagacgcgagcaaatgagcaatatatatagatggatgaatgatgatcatggcatgccggcggcgtgatcgtgatcgtgatcgtgatcgatggcgaggtgagtggaggaggaggaggagggcggcggctggtcgtcgtcctcgtggcagcagaggcagagcatgccgcccaggaagccgagctgcttgcagcaggcgttgcacttgcctctcttgtagcacaccccctagcacttgtagattgggtagttgcacgtctccgcctccgccgcccactgcatcatcgcaccatctgcatttccatttctaaatcccatcttatttcttttctttcttttcatttttctagctagctatagctgtttgcatttgcaataataatagtattttccatcttcttcttttattgctgcatgtatatgcattcatgctaacttgataacttaaactaatagtcaagcattgaacaggctaactgaaactaatagttaagcactgaggaggaggagggaggagctagataattagtaattaagatgactcacgcgaggcgatgaggacggtcactaggaacagcgccaccaccggcttcatcttcacagtcatcctactcgtacgcctcaatgctcactcgctatctagctgcctggcctcttatatactactcgttgcaagcctgcagctagcttttgacatggcagcccataaaattatgctccagagttaattaacatcgtccttcccattgtaattacaataataggcttaagtaattgtttttcacttttttcttcttttcttcccaaacccccttcttttctttgttttgccttttgtgtaaattttattcctcttaatacaaaagtgcgcaatccttttacgtattccaaaaaaaaaattaaatcgtcttgctgggggtagctagctgtcgtctcctcgtgcttgcttgcaagttactagtattaggagtttctgattatctagcattagcctgctttaagtaatgcgatcaatagtattgtgcgactactatcttaattgagatcgagacaagcatccagttcgttcatcattgatctcttgcaaatcgatctggtacatgtctatgtcattgctcttaatctgcctcaatgactcaatatggctagctcttaatctcagctcgattatgtcatcgaacaattcaagcacttatcttgccatatataccgagacctgatatgtgatagatggacaaattttgaatgtcttgttcgatgcacaacatttggagatgatgcgtgcgatttcgaagctgggacagaatttgtgaagaccaagaaaatgacaactcaatcacaacaaaccaaccaccgcccaggcagatcgcattcagagcatgagtaaataaatttcaagtctccctgttcttttcagaagaatacatgtccgaatgtggtataattaagcctgctaatgggttaaaatccaggccgcatccaccccaatccacctcctctgcaaccactccaccaaaccagtccgctccactttctcatctctaacatccaaattaatccaacccgcaggatgtttgaaaccaacccaacccaaaccattgtagctaagtggattgaatccatttcaaacccatggactgagaccacatgaaaccgccgccgccgccggcggaggaacattgacgcaaacccaacgaacgcatgcaacggtagtagcttgtcgtcgtgctcgatccgtggccgcgcgagcccgccatgtccagagactgcgtgatgagtgagcagctggcctgttcgacgcacacgacaatggctgcccgccgccgtgctcgtggccgcccgccgccgtgctcgcatccatggccgacgcgcacaacaacggcgggacggagctacttcacgacacggaggtgcgcggcgagcttcttctcccgccggtaaggaatagtagccgatgaacctgacctccattgtcgccaagctgagctcgaagagacagccatggtacagccggaagagcaccgcgccgctgctcttggcgaagcactcgagccggacctcctcgtccactgtcaatggcggcggcatctcctccggcgcggctgactccaccaccctcgccaggtccaccgcggcgcggcacgtccacctcgccgcgccgtcgtccttcgacaacgacgacgacagcggccgcctcgctgcgctgtcgtccttcgacgacaacgatcgatatctcgtggcgcctcgccacggccaggccgagcgtcccgtccggctacgacacgaggagcatctccacgctcggcttggcgacgcgttcgaggttcgagggatgagggagtttgatctgcgccgacggcgatgacctgtcgaggcggagcgcgggggcatagcagccgagctccgcggcgttcgagagcacagccagcagcgcagcgtcgtcgctgtctccatggatcgaacccactctagcatccatggatttaatccaagttggacccgaaattttatacccaaaaccaaaccaacccaaaccgttctcacatgcagtccaaaccgccccagcccattagtctcgtcaaaccatttccatccaaccaaagccagcccaaacttgaaaccaatccattttacccacttcaacccaacccattagcaggcttaggtataattaaggggagctccatgcttttcagtgttcttttcaaaagagtacatgtccgaatgtggtataattaaggggagctccgtgcttttcagagtttcagacgaaactgaacacctaaaactgcccaatgtgacggcaacagccaaaatattctgagatttagaggtagcgaccaccggccacatcaacgaggctctcgtctccatgggcaacttactttgttagttcttgctttggaaaaaatataaaattagcaagtggtattttgagaagaaatcgaaatgctaatggcacaggtcaagctagtacttgctgacaatagttgcaatacttctgtcgctatacatagccacgggctcacatactcgtatataacaacaggacttgatcaatttatttcatcatttttttattaccagtattgtccttggagcagcaataacagccagtgtcaacgggagaaaaatattacatcatcaaagccgagtttatgaccctacaaaagttgaattcgctttgcgctctcagtacaaactctccgaatgacatagtttcagctacactcccttggggagccccgtgaccgaatcgatcaatgctaggctttcgtcagtgacaacttttgggccagctccaagcctgctacagatgaagtagctcacatctcccttgaatttttggctcggcatcttcgtctcggcaggagctgggagggcctccacatcttctatcgatttcagtccagcatcgcttagaatcgacttgtcgccaaccatatagctgcatcattttgtttgtcaaatagattcttggatagattggtatgtcatactcatgacaatattaacgcacctgctgagatcattatcttgaggagggaaataatacaagagcttctgaaggagaatggttgcatttttgcggtttggtgcgattaggacagcattgggcccagcatcgaaggtgtaagcaacctgccatcaaaaaaagctcttgtagaatgagaagagttgatagcacaactgtctactagttccatactcgtatagaagaaaaatgcatactagaaaacataaacagtacaaataagtcctagacaaggattttcaatgaaagaacttccttatcacgaagccatattatgtacagccagattatcttgtgcattccttgggcttttgtttccatcataacaaagtaatgaattggtatatatatcatatccaatatatgtactaattaaatatgatcctccatagcattaacaccaatggactgatgacaattagaaaagggtgaaaagggtgtggaaaatgagcttagagtcaaacatttgctatttctacaaagatcattgagcaatgtgagtcatacacgttttggctagggcagtacaaattgtttgtgccaccatatgagcttatggtccattatacccttgttatgaactcagcatgtaaccaaccctatttcatggtatggacatccataaaccgcaacagtttattgagaaaaaaaaaggagaaaagaagagtatacctgtggggttccttctgactggttccacttctccacaaggctaattatcctgtgattaattcagacagcaatgtcaaagctgatgtgtcattagcaacagaagcccaaaacagagcactgataaataaaagatcacctgtgtgatgtatcgttcatatagaagatgggagggctcgtgtccaaacatacagcatgaaattggttgctatctgcacaagttaacctggcaaaggactcaaaattacgagacttgatagcctcttccattttcaacacccgttctggaactacagtctgcaatacaagaacaagcaattcaaaggacataagaaaaaagaagtaacagctaaattgacagaaaagctcaattaatattttactgcagtataaaactgcccaactctacttcctctatgaatcatgagaaatttaaacggtcaaaacagtcacctgggccctatattgcaaaaggggacttgtttcaacactgtctcgcatcccactagtgctacttgtttccttctgctttgaactgacctattttacacagggaagattcaattattttgaaggtgtcagacatgacataattagtaaatgttgttaaaaagcatgataaaatactagagttaccatccgattcaaatttactggttgtgaagccacaacaccaggagacaggagtagtaatgctacaacagattatacgcagtaagaggtatgttaaatgcacatcacataccaccgctatgataataacaagatcattccagtgtgcctcatcagcaagttgtacagctatgctgtcgcttccatcattattctgtaagtgtagtataaaacttatcattactcgctagaaaggatatgcgataaatttcaccaaggctgttcctctttcatagcatcagataactcacttttcccatacaccatttcacgaatcccccatatatactgcggcatgcacttccagacccttgcctgcatttgaatttgtcagttataccagaaggagaaaaggagcagttccatagcatattgatcagtacagatgagtacaagcaacaaaataccttgctatggaagaaagttcaccatgatcttctttcacattcattagctttccaagggtgaaaactacaaaaagcaatcaggtgataaatatgtgcttccattcaccctatttagatttttttaaaaataaaaaaatcaccaataagatgattgaaccattgtctgattttgggtggcattatcaaatttgaaaatatttgagacaaaataagtagggaaatatcattgatatcagaagtaagagactttaccaaaacaagccaagccagcagccgaagaggccaaaccagcagcagtggggaagttgttgaacgatgctatgtgtacatgtagcttcccccagtcctctttcttgatcctgatccccttcttctcatcctcgacatcttgagcacgcttccggatctccctcaggcagctctgaaacctccctcctgacaaggagatctcctgcacagttcaaaacgaaaagccagcttaagacatagtataccattaaaaaaagtaaaggatcatcccttaaggtctagcgtggtgatagatcacagacttttaagtttcacacagtgtaaatctaggatttgacagtttgtatttagataggatcagtgactgtaacagaaacaaagctagaaacacatactagatgctagtgcatatgaaatcaggaatgtgattcttttttaaaataataaaagaatggaaattagagctccactgcctgtagaatttgtagatgggaagaacactgaaacagattgccattattcagatctaagcagcagttgtcatcagtttgatgaacagagtcccattattcagaggggacaacaaagcataaacatcaatgcgaagcaacaacaaaaaaaaaaagtaggaagcagcagagcagagagatggaagagtagagaggaggaggaccttgccgttgagccacatgcggtcggaggggaaggaagggctgacggcgacggtggtggtggcggaaaggtggtcggggtcgagggtgacgctgatgctgtcgttgacggggaggatgagcgcctcgtccctcttcccccagtacttgatgacggcgatgttggtgggagatcggccggtggccatgagcacccactgcccctcctccgccgccgccatggaaggagaccgatctgctgcggcccagaagagcgagcaacgcgcgtcagggattcggactagcaacctcaactagatacagtcccaggcagcttaccggaacggaagcaacgacggggagcgggagcagtcgccggcggcggcggaggcgggagggcgggagatcggagacggcggggcggagacaccgaggaagacgagagtgagaccgaatcttgatgctaaatccaacggctgcgatttatctatcccctccttagtatatgttttttcacaaaaacccctcactcgggtcgctatcgcagccagcatcttttgtttttctttcctttttgcacaaagacccctctgaataataataaataataatatgacggctcggttacttcctcctccaagttcaagtccaagctagcgatcgccggcgatcaagccggcgaccatgcttccccggccaccgcgccgcgccgccacccccgtctatcatgatcatatcttctgtgaatggcttttcataagctgttgatccttcctgcagcatctaccaagtgaaatctgcatacacaatttgagatcaacatcgataagatgagatgagatgagatgcacaagtgaaatctgaatgcacaagttgagatcaacatcgataagatgagatgagatgagatacacaagtgagatctgcatgcacaagttgagatgcaggattcctattggattttgaagagagacagataatttacagggggtggattgactgattctcctcatacttcctggcttgaaaacgggaaagcttggagctttcggctctgatttgatccggtcagttctactgcttgacaaactgtggagaatctattccttccagccatatacatccaatttcttgacaatctggaccggacgatccatcagaaaaaattaattcagaatgcaatttggagtgcagcagcttttttggctggcacatcggtgtagtgcatctatatgtgaccttgcaactgtgcaagggtcaaacagcacggccacaagtacttttgttgatgaatcagttattaccacatgacttcgtcaatgctagcccagcaagtgatggaaggaaagatggatgaatgataaggctccagggctcataaatacctgagactgaacattgctcattacagtcttcagatgtaaagcagtgttgttcttcttctctattctgctcaaggcagctgcatccagatcactctactgatgaggaccacgaggatcatctgctggaagaaaacaaagatttgcacattgactatgcactgctgtaattgtatcaatatcgaattctaaatgctgaatgaacagttgctgatatgatcctgtcaggaagcaaaaacaagatactaattgccctcagagacatatatagtggacgtgcactagtgttttcataccacaaatcctttggccactggagtcaacttttgatcatctggataacataagtaaagaagattctatttcctacaagagcagcagcagctaagcacacacatccttttttcctttccagaaaggatataatgatggattagaatattcagacagtagtacagcttcaggattgctgcaagattagtcataaaataatactagtagtagtatcatcttactaccatccatggggttcaggacaaattagttgaactaggagtacatacagctgatacagttgtgcagtgaagcggtgacaattgtcaattgacaaagtgccaaggtctcacagctaatccccagctcagctgcctgctgcccccttgatggtctgcacatctctgcccattgaaatctttggtcagcaccatcctctggctgtcaagagttaggtgcagcccgatttgagtcaaccctttgattgcatcaagcaaaggtatactagtatcaatgcccctttatccaattctgcaaagtttcttccccaacttgctgtgtcctgaacaactggatttcattcggtcatcagcttacacggctggttgaatggttggtcaattgcaagctgttcatctgagagactgaaacaaaaccatttggatttgcggttgcagtcttgcagagatcacagaatgttgatctttcaggattagaaacaaaatgcagcacaaatatgatatgagtatatattctgatgaccagaatcagcacacacggttggttgaatgattggtcaattgcaagctgatcatctgggagactgaaacaaactgtttagattgcagttgcagtcctgcagaaatcaaagcaagtgcagcacagtatcaggcttcatatgacatgaatatatgatgacgatcagagattcagaatcgaaatcctcgtctgaaatttacaatttctgcattccttcactagtttcaacaacatttttttttgcttgctcttcagcacaaagattgaacagcaatacacactaacccaacaaaaagttagtttttacaagcaaatgtacacttcacaggatcacaaaggcagcagcagcagcacataaaaatcaaagaatggtagagtacagaaaggggaaaaagagagatttttttttatcatcctcctaattaaatcaaatcaacagccaactaccatcgtgggtttccctccacggaaggaaacctcagaaggaatggtggtgaggcggcgcgccggagccggacgccgccgccgccgcggcgctggcggtggcgctgctgttgctgcgcgtgctgtgctccatgatgcgcaccacctcgccgcggctggccaccacgcggtggaacacggcgcgcacctgccgctccagcggcgcgaggccctcctccagagcccggcacgcggcggcgagcgcctcggcgcgctcgaccacgtcacgcgcgcgctcatcggtcgcgcccatcaccagctgctcttcctcctcctcctccgcgacttcctcgaggagactgctcagctcccgcgcggcgcgctccacagcctgcatctcggcgaggagccccgtcgccgccgccgaccccgacgacgaccccttcttgtcctttttcctccactcgtcggcgatccgctcctggagagcacacatcggggccgcccactgcacctgcttcggcggcgccaccggggggttggtggccgcggacgaccggtcctggcacggcaccgccgcgaccagcgcccacatggagaagacgagcaccgagctcatggtgtagagcgccagccccagcccgcaacccgcgccgggggaggcggacgtgggcgactgcggcggcggcgcgaggtgcgccgccatggcgtggacgtggcggccggaggaccagttcctggagacgctgaaggacagcgcgcgcgcggggccggccctgcacgagggggacggcgcggcggcgagcttggcggcgtcggggaacagcctggagatggcccggcgcgcgcggccgaagtgggcgcggtgcagcggcggggcgaggaggcacgaggcggcggtgagcgcggcgcggtgcgagccccggagcgaggcgagcgtgagggagacggcgttgagtatgtcgagcgtcttgacggtgcggtcgaggaggtcagcggcgaggcggtcggcgggcggcctggagagcgcggcggcgacggggccgatgccgagaacctcgcggaaggcgtcgtcggaggagagcaccgcgtcgagcagcttggagaggaaggcgagggagaggagcggcgggtgatgggagagggcggcgaggcggtcggcgacgtgggcctggagggcgtggaggacctgcagctcgtcgtcctgcgcggggtcaaaggaggcgacggcggtggcgctgcggcggaagctgaggaggccgaggaagcccatcccggtgggcggcggcggcgggtcggcggcggccatcgtcgtcggggggcttcagcttcggggctgtgcgtgtgcgtgggcttgggcttgggctttgggcctgggccttggtggtggtcgtcgagggaagcaatggtggtgggtggagcgggcggtggtggcgcgcgccctcatatacgcacgcgcgccggctccgaccacgtctcgcgcgcaagagctacctttgactgcaaggtggggccatgggtgtatagggcccatgtgtcagtgggggtggagaggaagaggaggtggtgcgctgcgcggagaggaatgggaaaggtggactggttcttggagctgacttggttgcctcccactaactgtgtggacctggtgtacagcacccagtaatccctttttttttttcattcgctcccattttctaaatactattttgttgcgtattagttattttcacgtatattctgtgtgagtttttttccctggctagctgcctgagattaaggtgttttttttcagagatgttttcgcttcttatcagcgcagtactacctccgtcacaaaatacttatcgtttagagtttttttgtaacgtttaattatttatcttattcaaaagattatggaattattatttattttgtttgtgacttgctttattaacagaagtacgacttatttttttatatttacgcaacttttgaaataagataaataatcaaacgtttgcaactgtattaatagaaatgtgtaatgtgtagtactagtagtatttgttgtttttatttagttgcagctggcagcttaggacaaattgtaccttgaaggcttgatggctggcagggaatgaaaagtcatgaggtcttaagtccctatcatatcggatgtttgaaaattaattataaatattaaatgtagactattaataaaacccatccataatcttggactaatttgcgagacgaatctaatgagcctaattaatccatgattagcctatgtgatgctaccgtaaacattctctaattatagattaattaggcttaaaaaatttgtctcgtgaattagcttttatttatgtaattagttttgtaagtagtctatatttaatactctaaattagtgtctaaagacatggactaaagttaagtccctggatctaaacaccacctaaaggcttaaagcatgacagggcagggcaggccagatggagttaaattaaagccaaaacagatacggttgtgatagaatcatactagtagaaattagaagaggacgcatgcaaagcttgtatcatgtgacagtgagaagccaaacgcataggacacacaccaccaacatagcacaggtatgtaaacacaacgacaaatgctccattttagtaaggcgagcaggatcttaattcatcttacaaagaaaaaaaaaggaataagacagtgtcatgccactacaaaacactagtactaaaataaaacattagcaccaatcatcttctctctcttttgatctcttctctgaagtagtactagtagtacttcctccgtcctaaaatgaagctatttttgaggttggcacggatattaagaaagtatgtgagaatgattggaggaagtgtgtgattggttgaaaagagaaagtaggtgaagaagaatagttgtgattggttgagaggaggaggtaggtgaagaaatagctttattttgggacaagacactgtgctagaaatagctacattttggaacggagggagtagtaaataactagtgtagtttgaccatgtctattttgacgcgagaacacatctccaccgtcgatctctctgcccacgtgtcgtcccaggatgatctgcgccgctgaatagtaagtactacgtcaggacagtgaccctgcacttataattcactaaacgaaaaggaaaatgaaaaccaataatgattactggaggactacttagtttagaagatacgagaaatactcaagctaattaaccttggactgttctcaaaaaaaaaaattaagcttggaccacgtcagatgagagccggccgagcgtcgcgttatgtgctgcatgcttgcatagaccaagtctcctagctagctaattcttcatttaacttaaatttgatgtaattttcacaatacatatgcaaactaactatctactactaataattaaaacgagcttgattgttactagtatatattcaatttatagtacatagtaattagctcgcggttgcactttctgtaattaaattaacactgggcgatcggcttcagctagctagctagaccaagtcacctgcaagctattagctcgagtactttccagtttcaattcaagtcatggatataattaacaacacatgtaacacggattagaaatcaagcaagctatctactccagggaaggcaggctgactcagatcataccaggtcagccaatcaacggccatgcatacatacatcagaataaatattcatgtgatcgcctagcttatggtttcaaatgacacaaagaatttaactcacgtgttcatcaagagaatgcagtttatacattccaacaaaattcatctttcacttcactcgacgagccggccggctgctgctatttagatagtgatgtttcgaaacagagcaacctctcatgactcatcagattcatgatattttctttttcaataatacaagaagaagtaattaagctgatgataaaaaaagatgagcacttacacgtgtctatgcaggtatgaactcaggtgactgtcaatcgacctccttgattccatcttataccatacatacattagctatgattgaacatatgatgatgagttccatgaatcaatggatcaatatatatcgatcgctaacgcgaaaacaacaagctaatgaccaggagaaaattaaattaaataagcaagtgaataattaatcgtgatatccctaagtagctaggtagtaattaattgtaatctttgtcaattgagacagatgctgctgcagtaatagacacgtcttttaccaagaacagccttgcgtgcatacacatcacaatacatcaccatctcctgggatgatcgatgtatacgtacgcactcaccaccactaagggccccttttatttgtagaaaaaatatatgaattttagaggatttcaatcctatggaaaaaaaaatcctatgaaagcctttgaaaggattgaattatatccaatcctttaaaatttctaagaaatgggtaatcctatgcacattttggagaaaagttagccagaggtctaaccacttggaacatttcctctgagcctatctctctcatctgattcttgcgtttttcctgtggtccaatcaaacggccattcatgtgtttttcctatgttttacaatcttctgttttaaaattgtattcctatcctgtgttttttctattactctgttttttcattcctacgattcaaatggacctaatttcagataggtaaagatggagtagtacttcctatatatttattactcactcggtttcatatataagatgctttaattttctctaagttaatttttctaagtttaatgagtttataaaaatataataattcttacaacaccaaattatatctattaaatataacacttaatatatttgatagtatctttgtttggtataaaaatattattatgtttttatataaatttaattgaatataaagaattttgacttaaaaaagatcaaatcaaagtgtagtacaacaaagagagagatagagtagtatgatcttattatggttgattcgcgtgtatggacggtcaggatcgagttatatatatccggccgggtggctgcattctggccatatggacgtcacagtcacggccgtcgcctctgatccgggtcaagcagaataataagaggagaaatgcagctggtcagccccagatgcaaaactatactagctggttaattataattagtcagtctcccatgtaactggttaatcaacacgcgctctcgccgtccatagtaattaccgcagtgataacaacgggacgatggattgctacatgttagtagtacttactgtactagctagctattagagtaagtcccaaaataagtttattttacacccataccagatataccaatacaaaaccaaagaaaactataatatcttatttttatcaaatttaacattttatcttttcttaatacaactattcgtaaaaaatgagggcgaggcccgagcataggcacggcgacagagaggagactactccctccgtcccacaaaacgtgattcctagaagcccgatgtagctttagcagcagtattaaaagattagcatgtcttacaaaatacaaccactaattaacagtaaaaaaaaagacaagcaagatgggtgttttgtagagaaaatcaaccgatcgacgggacggcaacacgacgatcgagcaaggaaaggaattggaggaagggtccggccgcagtcaagtcggcgcgcgggataagatggagacattatctggacgctggctaatttgggatatcttatccggactctcactgaggctcagaattaaggttcatctatctatcaatccctaattatattatgttatatgcctaagtattatcgttgttaatcccttcgattgtccatgggcattttacaagaggcacacggagcaagcggcaatctaaggcatcaagcaggaaatagtcccggaacatcacgatggtttcaagcttttattcctgggcttccaccaagtaatatacgcatgtaatcatcagatgagatgataaaatatatcattgtagtacattgcattatctaaaaaaatcattgtagtacattagatatttgttctctgctagacataagctttctcatcaccatgtacaaatttccgagacatacttcaacggccatctgactgactccacaatacaattgctttgagcccttaacgaccatgaaatgcccattgtacacaaggtaatacaaagttacaaactacagtagcacaaatgattgttactcgtcggctagcaagcaaaaaaaagatcaaggacgcacccccatccatctctgctatcaaatcaagggtaaactccatacaactcaatgatgaagtaacaaaatcaaccgtcctgtagttaaagctatcgtctccgtatatgatggtacagagctaaaatgataaccagctccacaaacctgctgcaaaaaaatcactagccatcaccctatcacgagaagaaccgtttctaaactacaaacatgcctccgcagaaatcatgcatattggactccagcacatggccttgtgcaggctaattttggtgattttcctctgcaggttaactaacacttggggcagacgcctcctcttccccttcatcctttgtcctggtagaatgcaagattattgtcattgcaacatccaatcacatcaagataaatatatatcattttacccaaccaaaggtttgaataatcctagcctgattaatcatggaaagagggtgtcagaaccaggaaatagtgtttcgtttacgtaaaaaatggtgaattttggagagcaaacttgtctaatatttaagcagatcctgcttttcaacagcacctagaggtacagaacttgttctttcagaagagcaatcttattttaccagaaatgttttgtgggcaaacagttttggcctgcagaatgggacgttgcattgaatttcccttgaaacagttttgatacatggaaccgcagtacacagaaatactaacacagtactaactatattcagacaaaagcagccttgcaacaaaaatcttgggtagcattgcagtaggaaagcagaatagaaaaacaccagtgcagcttgcagcgttactttatgcccttaaggaaggtgtgcaagtgggcatgtaaaagttggcaagctttggaagcttaagcagcacacataaaccgagtaaactaagagatgacagaaaaaagtatgatacttgaatacttcactcagcataatcaaactgaatcagtacccatggaaaattgttacaatcaacagaaatatgtctttttggttctctctctgtgtgtgcgtgtggtttgtggggggtgatagaaatatattctgtaacaagacctaagttgatacaatatgcagagctgtccccactaacctttcattgcaacttttgcctgtgatatcgtcaatggcttgatcaagtgcatatagagctatcttcttaacctggtgatgcatattcacagggttcaattagatatgaatgtcaaaaggggagaaactataaaacatagtgctagagctatcacagttgtcaaattattcaaatatgtgtgcagaagagtatggaactgcggataaaaggattagctaacctctagtttatcttcattcaccctatgacccttcggaagcaagcgaaattcttctgtcagcctgatgcactcttgcacattttccggagaaacaaagtcaagtgcaacctttatacatgactgtccaataaaagggaaaaaaaaagcaggttggtaaaaagaataataccacagataagattggtccattttaattcaacacatggtattaacagcaatggtaatggacagttggaaactgcttccatgtctgtcatagcataccttcaaatttctgacttggtggggacatcctgctgggataaacacagcctcaccaagtttctgttcaaatgtccaaggctcaattcctgcatatgaaatgaacaatatatatcagtaagtgagaacaaattacaaaagacatcagtattttttactgaccatgttcttccttgagctttctcttgtgctcatttgttagataaaagcattgatcgtgaataggatgagaaacctgacaacatagggcagttgtgtgagatgagaaacatgacagatggcattccatggacaagtggtagaataactaattacctgtttgactgtttcataattataatgtctaaactcttctgcatgcttcatcagataatcatgcaatttgctgacatcttcacgtcggaagatatcccacaatgcaccaccctctgtctgatttccctcaacaaatgggtgatcatctttgggctcaatagatatggtaaatttgttagtctccatgctggtttcgtttatttcccctgttgcactggaagagcaagcatcacgtcgcctactgcgtctttgacaatcagaagattcagatgatcctacaccatgagaagatttacatttatcttccctcccaaagccattgcccatctcctctcccccattaattgtgcagatagaatggtctgtttcccccttggagaaagtaatatccatattatgtgcatcactttgattgggtgattgcccattagacagactcaagtttccctcagcttcatcagctaccatatctgtatgaacacctccctggtccattacagcaacatttggtgctggctgcttaatgcttgagccattttcaagtcctcgagatcttggcacttcagttgattcactgagagctattgatgtatcatcgtcatggtctggtcgcagaacatgaagattcttgccatctttacgtaagctctctttctttttctctattgctgtaatcctttcagctttgagttctacctcatcagtatgcatgagaatattaacctgtttacgcaataggaaacatgtgattattactttattagtcaaaactgaacaaagtaaacaggtgtataacaaatggaaaggcctgaaatcaggaaaataacacgatgatacagctttttattaaaaaaaaaggaaaatcacacgatgatacagctttttattaaaaaaacacaatgatacagctggatactgtatgcatcagatacattttcataattaaaattaacgttccattggttttttcccatataattcatgacatggtcaaccaactatccagcattgtcagccaccgtagcaagaattaaactaaggagtgcagctttcagcagcaagtaacaagacaacacaagcaaatatcacataattctttttatagatgattctataaatttatgctgtgtttaataactagactagatgttagcattggtaatcaactataaagagaactgaaaaatcaaaaatctaaataagcaacttccaacatgccaacagaagaatatttgaagccaaaaacatgcaggtagaacccagtgccctgaggttgagcaagctttgtcctgcttggttcggtactagtacaaaaattgtccctttataacagggctcactcttaaactaggaaggagctaaatatagtagaataacttgcagacttgacatgactacaatctaaagttaaactaggaaatggcttctatatattcgatgctcgtactgtcactgtagttgtcttccagccactgttcaacggcacgagctaggctcatggggtgctgaaggtctgtaagattttacaactccacatcagtaggcaatgattggccgaggccagcagtgaacaagttgacttgctgttctttcagaagagatggtgaaacctggtacaagagagcaaagaatttttttggtactctgccactatcctagtatggtgtaatagagataattggttcaaggcattgctgtgcattggagagccatagtgcatgttgacaaagtcgcagttttttttccacaagaaaacgccttcatatcatttaaaactgcatatagcacttctgtgcctcgcccatcatgtggtctgacacaagccattccttccctcttcaagagatcacggtccttgaaaaattgctcgcaacgattaaaccatgggagtgggtcttctttgccatcaaatgctgagaaggtcaatttgtggtagaatagcgcaccacacgcatcttcatcctgccctagcactgatgccaagacattgctgctgcggctagtgctggttggaatgaggccatgagggccagggtatcatgctacagcccttgcatcacttgtgttcatggcatcctgcctagaaatgaggatataaatcttcttgcccaggtctgtaccccagctgtttgaagagctcttccagggctttggagttttatatggtggatggcagggatgggttggtcagagggctagggctgctggaggaggagattgctatgatacgaaataatgtagtaaagaggaggaagaaggtcaggaatagaaacacaggcaggtatgaaccagcactctcaggtcaagcagggttgtcctgctcagctagatgctcggttggcaaggatttagagttgggtgaagaccttcagctttattgactgattgctgctagtacaaaattggtcccttcatataacagggataactcttaaactacgaagaagcgagatatggacatatggtagtacaacatacaaacttgacctgaatactaggaaatagctactatatttgatatataaagactaggaatgtatatcctcccagactactgcaggaggccctgctaattttgagttcccagcagccccttcctttccatgtttacgtctccgatactttctatccataacatataatagcatccaaggatagcaatatgtacaatcaatatgaattaaaaggaaacaagattttaatccataaatctacatatacaaatgccagaaatcacaagaaattcacttatttaccgcatcagacatgtcgcaatggatcttcgtaacagaatcacctattcccaactcttgggcgacaccataagcaatgtatgtctttggaccaagatctggctttttaacatgttttggaagcttcactgccagattaaggggaccagattttggatctgtatactcacgaaatggtagtgcagacatgaactcagcaccatgccgcggcaggcgctcctcaaaggaactatgttgtggccaatctttaagcttaagtagcacaggcaaatcctccgaaccaacagctccacgggaatacccctcaaaaaacatgtgaatatttatatcaacctgcattatggttaaatgaaagcaatggtattaggaagttaccagtttgaaatataaagtagtttcaatggtgctgttgaaccccagatatgaaactggcaccaccaacacatcctggtggtacataaactaatatattgatatgtgaagttcataagttctaccactaccaggcacataagctgagctgacattaggtagatatacagttctttttcttttgttgtgtgtacattttcatggtatcagggattccactggcacatctacacacctcaagaaatcacgatgatcaatgtttcaactccacacgtttataattgtactcgtgtagattatgtgactgacaatccctagcatcagctctacaagaggcagcttattgcaattttattaacataatgttacttacctcaaaccatgtcagacaatcaagagctataactgagagccgttcatgctctttcttgtctctcttttcccgtaaggcccgccacataaccattggctcccagctcagtccagaagttagctcaagcacgtcacgaacaatgactggctgaccattcaaccaatgctgctgaaaatgatctaaagctccactttgaacttctctagcagttggacaatatatgtagttatcattggagtcctctctgcaagctgatttccgtgatgtttcattgttcacttcaccggattcagtgaagcaggaacatctagagcctcccaactcctgctctgtttccttattgaccactgaattgactttatccagtaaatcagaaataaagttctccttaaacaaacacctaagttcgagaagacaatccccgcaaccacctgcattaggtgggcatggtatgcttccgttgctttttgccctccatatcaaactaggagtgcaatcctctgaaggagctgcactacctatcaacctgtcattctgttgatcagaagccccttgacctacagcactgctatgactacttccctcttgcaaaccttccttgccttctatttcaggtacatcaacagctgtgtcacaagtgacaacagtaccagtagtaagaccttgacgcaactcctggcagcagctgaggcagagatcatagtgaccacttttacaacttctgtggaagtcaacaatggatgttctgcagttatcactgtttcaaataaaccaaaaaattagatagttcacacttgaaagaacatatagtccacatgctttacaaataaagcaataccaaccagtaaatccgctcatcattattaaactgagcttgaggaacctccaagtcagttacatcgatccctgttgcagaattaggattaggaaccaacaaaagaaacttagtgctaaaagggaaccgtgttaagctatgataatacctttaattgtggcctcaacacttttctctagcatctgctcttggtgaagttgtttcaaccaagggagcaaaaagcgtgcaatacgcagagagtatttaattttgttcttaccatcggcaaactccttgtcaccctgacaaacgcataacagaaaatatcaaacaaaatgaagcaatgaggccaggtaataaaatagaaacgggacaacaaaaaaaagaggtgtaccttatttattacatttgtccgcagacaagtcttacaattgcagttattgtgacaaactggacagcagttctcaaaatcgtcctctgttagatgcgggtacctgcttagatcatgccacagaaacaagcaacagatccatattagtagctaagatataaatgtaaatttgtgcatgaactaacataataagaactgaaagggtgacacaactaaggtgatcaacattgagtgcttttagaagggcacaaaccagcgtttgatgcacttgacacaatatctgtgcctcctgtttttttcagcaccattccggcacctcacaactcttccactgtccttcctttggcactgatggcacatggttgaagttccatccatcttttttgtgtgctgcaaatcaaggaaatcatgatataaggacttagcaatgaattactgacatacaactgcaaatacaccatagagaatatgctgtataaaagattgcaatttccaccttattctccttgtagtctaccgctggaacgttccgcctgtccctgagcttcctgggtggaagttcagtcgaagagggatcagcaacaggacccttcctgcgctttcttgcggttctcgaggcctgagtctgccctgcgccattctcctggaaccaaaaagagatccatcacacattcggaacatggtaaatgtttgcatttccagtccccggcaggaaaagaaaacactaacctcaggagaagcctgcgtttcctcctccttgtttgtcttctcaccgttttcctgcaaccgcacccaataactggtcaagcatttcgtatgcaaaactacatattaagctcttcttaaaaagaagtggagggaaaattcagcgcaattgcagaggaactcttcagtgctgcacattccgtgagcaacccaggcttagaaatccaatagattggtagatatccaatgaaatttgacaactctgtagcttagacaagcaaaatcagggaaatggtcgattatccaaataacagtacactatgattgaagaaaagggagcaaaatccattatccattgcaagcgcgaaaaggaatccaaggatattgcccacttcacatccccgaccagaataacaaatacagaaagaaaggggaacaactcaaagcggcaaaactaacacaccgaaagcaaacatgaagcagccagtgttgctcggagatactagcacgaatccatccgctagggtttaaacgtcccaacatcccctcgacgacaacggcgcgaagaagacgcagcacatcatagcaactccccgggttttccgaggcgttgcccgaaggaacgagagagaaaataaaaaaaaacgagacctaatcgaagcagcttcgcttcggttaccttggcggcggcgtcctccggggccttgcgcggcctcccgccaccgcgcttcctcttgggcggcatccccggctagaccccgcggcgaccggcggcgaggtcggcggcggagaaggaggaaatcaaatcaaattgcggcgcgggtcgggtcgggtcgggtcgatctgtgggcggaaggggattcggagtggaatggaagaggaaggatacatatgacacgacggagcccacgatgtgtgcgttagggcccactggtcagtgaccgtggagggctccggtgggccaggatggtaagcttctgggcccagtttcagcgagagctggagtaggggatgtatggcccactcatcggagaatcgtggccgcgcacgtgtgccgaggagtgtactaggaatggtttgtttatgtttttggttttcgcgggctgtggtgcgacgtgtgagtttgaatcgagcggcggttggtgaaaaggaaaattcgaggtaaaaaaaaaagggactgtctatctgtctcagtcgacagaaaatttggtgtctaatctgttgtttttttatcataagatttcgatcaaagagtctcagatttttcacagaaatactttaaaaaatatatatataatcttattcatgacccattggatacaataaaagcccaaaacaaaaagaagcccaaaattaaaacatgagccaaatccaatattacaaccacatcaaaactgacagagagaattcacgtgaccacattgcctattgaagaaaacttgagaaccaagaagatgctctgcataggcacgtgatctgatcattaaagcaaaaaaagcaactttgcttccaaagagaaaaatcagagcaatagatcgaacaaggaagaagaagatggaggtggaggagaagattgcaaaaaaacgaaggatttagaatctgcaaacaaaattcaagatctgaggaatatgaaatcaacaggtactgaatcttgttctgaacttcctaattcttgaaatcaacactcttctaattcttgttctgaatcttctgaacttccttctttgaatcttgaaaaaaataactcacaaatgactcaagttcatgggattcctgtgaagaggcaaaaaattgcattaatccatcagtcctctatactggcgtatgtaaaagaagcataaaatagcacaacactatatacacagtacttcataactcatttgacaattgatagaatcttcatatgaatctacaatagcacaacactttagactattgacaaaatcttcatatgaatctacaatagaactatcaaataatagacagaatttcatcactcatttgacaatcaaatatgttagttacaggattgcactgttggtattttaactaaattcttgtggacttaagatctctattcatattgcatatcaatttattgggaacaaattcagaaattaataggaaaagtcaatcatagcaaattttaatttaattatagttcaactaccatcaacctcctaactcaaagctttcaaacaaaggagcaaaggttcacatataaaatgactaggaaaacacaactacaaaattcaaaaaaaaaatcgcatggcccctgatacatatcagcaagcaacacacaatgactataagaaaacaatcacatggccctgatacatatcagcaagcaacattcaaggatttactgtccagactgtagacttaaaaacttaacataatcaaaaatttgaaaacttatactctgcaaaattcgaatttacttcagactattaacataatcttcatatgaatccacaacataactttcacataatatacagtacttcataactcatttgagaatcaacaggttagatacagtattgcacttttttgttttcaactaacttcttgtggacttaagatctctattcatattgcatatcaatttattggaaacaaattcagaatttcataggaaaagaaaatcagaacaaattttaattatagttcaactaccatccatccactaactcaagctctcaaataaattattcagagatacaattgtcaatatatttgtactacaataagatagactgtatttgatggccctgattcacatcaccaagcaacacacaaagactactgtatttaaggattattgtccagtttgaagacttaaaactttacataatcaaaaatttgaaaactcaaaacagaaatcattcagagaattcagaaaatagacaatttatttcatatgaactgattagaaggaatttcagaatatcatatgaaaactatatgagataaaaaattacaatacaagtcaaaatgaaatcatcaagtgtactcatcaagtgtactgataatatgttctttgttttgattgctaaatgtttgataattaagtgtactgaaatatacttatgctttgttttcacaggtttgacagatgagaatttgaaaggttttgttggaggtaagaacagacttatatgtttatataatttaatgaggttatgcatacaactgttcattaaaaaaaattactaatttttgaaaattctatgtatacagaaacagcgaaaaaacaacagttgattgacttggatttaaacaaaaaaatttcacaatcaggtgaaaaaacataaattttttatgttgtttatttcaatatgaaatcagaattataatcagaaaatctcattcaaacaggtttacaattaattgagcaaaattacaataggacaagatcatttataatagatgcaaagaaaagtagtacacgatcaagtactgcacagtcaggtaagaacggaaaaaaaacatttgtccatataaatttttatttcattgatatgtttaaattaacttagaaagaaaacatatgttgtgcaggtattttgaaggatttaagagagagagacaaaaacattgagaagaagacaatatcaaaagatgaaggtaattgaaaataaaattacataatttcttttgactaattgtattcagagtttggttttaaatttcataagaaacaaacatcagattaattcaatttttttaataaataaaggacttgggttactggagcaaaattataatacgatgagatcatatatgcttgaagatggcaaaggtgatacaaaaactggtaagaaacataaatttagaaccattaaataaattagaatttaacaataatctgtctattctattataatatgcaggaaacactcaaagagattcagaaattgacaagggaaagagaatagctgttatcgagaatgtaaaaacaatggaaaatgaaagaattcaatttgaagaagatatgttaggtatatatatttttgactacacagaatttgtttttttgtacatattttagattgttttattttttttcaggagaacaggatatgaactatgcagaagaaatacatcaaaccaatgttctatcactattggatcaagatttcattgatgtaattatacattgtcagatatcgtatatttgttttattttgatttggttttaatttaattaatatattttaagcaggataaatttacttcatacactagtctaatggaacatattatatcttcacaacctacaagatgcaatgatttggaggtaatttaacttgtactctattgaaaattagaatttcttcattttttttgaattgttttttaaaaactatttttattctttgcagaattcgatgtgagaaagcagcagcacaaatgttgacttcaattataatttggtgaatgaggtattaaaaaaatttattatttgaatatatcatttagaaaacattaagattaataaaaaagatcaaaaaatcattatgttgaattttacatgagtgcaggttgaacaaaatggaaatgattctatgcagactgtcattgatgcaaaaaaatatgtctgaggtgattccagaaattaattttgaagctcaagttgattctgtacaaccttggtctctagatttgttcaatctacaagaatctattgaggtatgaatttttcatgaatatgtatggttcatatcaattaagattgatataaagataaattttcaataatgtaaatttatggtccaatgtttaattacagcaacagagttcaattcagtctagtgataaaggcgaaagtactactgaagttgatcctgatttgaatgaagaatttctaacagaagaagatattgaacagtttctagatgaagaacaacaggaagcatcaaaaggaaacaatgcaagcatagacagaaaatatattccagagttgaatcagaaattcaaatcaatagatgaggcacagaactacttcaatttttatgcatacatggctggattttctattgtcaatgctcacagtgctagaacattaagtaaaaaaagaaatggagaagttattagagaaacattcaaatacaacaagtatgtgaagtcggattgcaataagaaggaagaaacaattacttctgaaaggaaaacaaatgaagtcatagggactgaatgcaaatgtgttcttgtaatcagtgagaggaattcgatttgggttatatcgaggatagatttagatcacaatcatgagctcagtcctccagatgaggctagatttctaagatctcacaaatacatgtcgacagaagaaaagattctaatcaggactttgaaagaatgccatattccaacaagaaatatgattgtaatattatctgttctaagaggtggtctaacttctttgccttacactaaaaaggatataagcaatgtcagaacatcaataaacagagaaacaagcagtaatgatttgatgcaatgtttgaattttttgaagaaaaagcaggaagaagatcccaatttcttctatgagtttgatcttgatgagaatagaaaagtgaagaattttttttggactgatggaagatctagggagtggtactacaaatttggcgattgtataagttttgacacaacttttttgacaaacagatataatctgccttttgcaccatttgttagagtatctggacatgggaacacaatactatttggttgtgcttttatacatgatgaaacaactgaaacttttgagtggctcttcagagcttttttgaaagcaatgaatggaaagcaaccaaagacaataattactgatcaggatggtgctataagggcagcaatcaaaaatatattcacagaagccaaacatcgaaattgtttcttccatatagtctcaaaagctctgaagagatctggttctctattcaagaagagacaaggtctttatgacatatacaatgatatcatacacaactcattgactgaagaagaatttgagtttctttgggaggatatgattcaagtttttaatttgcaagacatcaattttctgagaaacatgtgggaaatcagaaaaagatttattccagtgtatttcaaaacaaatttctaccctttcattcaatcaacagcactaagtgagggtacacacttagtgctgttggcaattacacaaatcaaaaactgtaattacagagataaaaaactgtaactgatagtagtctatatactaatgtaattaaatatagatttgcaaagtctagtcattcatatcatacaaaacataaagtagaacatctcaatcataccatattactgcacaatattttcatctgaacagtcaggttaaaaagcacaaaaacggtataattatccttcactcaacagcacaaactgtactttactatacttatttcagtactcttcactatacaactgacaaataaaatattaaactgtttgaaaaaaacagtaacatgcagtttcaaacatatacaatataaacaatagctaattaaaatgaggagaaacaatatcaaaccaaaaaaaaagatttgaaaagaaaattggtaagcaaaaataaagacatataatcaaacctattattctgttttggcacaggaggataaatcactgagaatctgttgaaatcaatagagtgatcttgaacataaaggttccaggcaagactaaaatttgaaatctacaaaaaaaatattaatagaagttaaattttgtagatgaataaaaaagctgttatgaaatatttacaaattcataaatgtatataaaactaagtataccagtttaggtcttaattcagcatgatagaagctctcctcatcatacaatgaatccagaaaaacaaatctttcagatttcaaatcaatgacaaatacgaaccagtgacgactcttgacaattgggaaaaagagctgaatgaaaacaaaaaaatacatgaaaaagaatttaagttatataatgcaaaatttagagaaaaaaagtaagaaaataaaccaggtcacatgtgtgaacatgtcttgctagtgaagctccatcaaaacacttctttacagccgagatatttgtcatagaacggtccttaaggagatcatcctaacattaacaaaagaaaaaaaatgagactgatattatttgttaatgtcaattatttataaagatcaatatagaaaacaactacacaactacagtttctgtcatattaacttgcactacaatggtattatttcataagaaaaaaattaatactaaataaaataaattacagtcaatttctattgcaattacagaaaacaaaaactgtaattacagagataaaaaaatgtaactgatagcagtatatgtactaatgtaattaaatatggatttgcaaaagtctagtcattgagatcatacaaatcataaagtagaaaaactcaattgtaccatataacagcaaaaaaatattttcctctgaacagtcaggttaaaaatcataaaaacaatttaattatccttcactaaacagtacaaaaactgtactatactatacttattttagtactctttacaatacatctgacaaataaaatatgaaaaaaaacaagagacaagcagaccctgcataatcctagtaaaatcatacataaccagcgagcaaacaaccagtaaatcagaacaaacagcaaaacagaaaagtcatctcaccaaaaaaaaaatcataacttaaaaaagaaaaaataatcataaattcaaaaaggatgccatcagatattaaagaaacacgtcaaagctctgcaacatcatcagacaagaattttaattattctttttaattagtataattaatattcttgcctgatgacgtgctgaacttagatttgcttaatgtagaagatatttatcatcatctggcgaaaagaaaattaaaataatgaaccaaaaaaaatacaaaaattatctacactgtagtacaaaaagacattagaaaaatcaattgactatcaatcaccactaatgttgtaacaagagtgcagaaaaggggttcaaatggaagtttttcattgtgtgattagtaagtaaaagtctaaacatctaatatgataagcaataaaaattgtaattcttggttgatgaagcagaagaagaagatggagagaaacacatcatatataataaattacagtcaatttatatggaaattacataaagcaaaaaccgtaattacagtaatacatttcggtaactgggaattaactatagattaatgtataaaaatgaactgttaacaaaatttgaatattgatttgcaatgtctactaaatcagatcatacaactcaaccaatataactactaaaacaaacatagaaaataagaagttattttacttagaagggcatgtttccttgcttcaagttaagaaattctttctttttgatttccatgagaccagcagggatgtgagcagacctgaatccctcacggaaaatagtccaagtgattggctcgtcaggaggaatgagagttttgtatgtctcccaccaagcagctgctgcaccttgcaggtagtaagcagcaaaggtagccttctctacaggatcacaccggcaaaggttcagcttgatttcaatatcacgaagccaatcatctgctgcgagtggatcagccgcaaaggagaaatgaggtggatgtgttcgttgaacatctgctagcttggagggtgcttgattggcctgctgtgccatggcagcccccatgttttcagagttcgctaccatcctttcaaaaagtcggttttgattagccaggagttgagcaagagatggttcatcatcatgctgttctgcagtggcagcacggcgactacccccggcacgtccagaagaatgtaggccagtgcgaggctgactcgctccctcaccattggcatcatcagtaagagcagccatagagcgagtatgtgtcatcctgcactcaaagtacaaaagtacatgagctgcttgagcatagaattggcatatacattaccctaaataggtagcatacaggaatgatttcttatagccgaatttacaagtcatccatcatatatttgcatgaaacaaatttctggacagcaagcaatccattccaaaaggagcataagttcattccagtacattagttttaaaggatctaagtgatcacagatacataggagtggataatggtcataagaaaccaagttcatgccttggtgttacaaaattttgaccgttaaaaagattacatattagggtgtcatctcatacatcttaaagaaaagaaatgaaagttacaccccatacatattctttttccagtacaccattctatggaacttcggagaatccgatgggaggttgaggcactgtggttgacggagtggccatagtcaaacggtattgtctcccattccgctcgaactcatagaatggccccagcagcaccggatattatcaattaataatcaaatagacaaatattagattaaaaaaagaaactacactatttttagatacttactcttgaaaattactcttgctgatcttgcaaacaacattataaacttgtctatcatattgtgtcactggaaaagaatgtctctcagggctgtatggatctgtatagtatctagctggttgtaaaattcttctgagatcatgttttggtttttgacttgtgctgcactgtccaacagatttatcaacattgcacaacagaatcctctcaggactgcctgtagacatcttcaacttcttgtctagtttaactacaaatgtgttgatcttattgtacaaaacattagtcttcgaagttatgtcaaaacaattgtctggacattgtttttctccaagaaatatgacatcaggtgaatcctaaataaaaatagaagaaaaaatgagaaaaaaatgtatttattaattttaaacattgttcttgaaccaaaacataatccactacatttcatttcaaggtaaaaacagaattacatagcttcaaatggcagaaacaaaattttcaggaaagcacttttgacagcacaaatcaaacagaaaaaaaatttcaggaacacacttttgacaggcacaaatcaagcaaaaaaacaatcttcaagagcgcacatttgacaggcacaaatcaagcagaaacataatcttcaagaatgcacatttgacaaaaaaagataaattcataatatattagtaaaacaaaaaaaaataaaaataagaaaacatacctttttctgtagttgttcaatgttcaagttttcctcttcattatgttgagtcaagatttcagtatcggtatcctccaaagttatcattactaacttgtcctgtgaaatattaaaaaataaattttaaaaaagtattataaatgtaaagctttgtacaatttagaaagttacctcattagttgaatcgttcaattggctttgtgaatcatcatcgaaatcttgtgacaggtcctttggaatgatctggattaacataaaaaaaattttgagatgaaaaaaacagataaaaaaacatataaaaacatacaaacaggacaaaaaagaataaggaaccattacatttgaattgtcttgatgtttgggtgttacttgagtcctgaaatgtttttcttcatttggaaaatcatcatctgaatcccagattttaaagctaggcttctcatgacccaagaatattgattttctttcattgaaaccaacaatgcttgatattgctttctttggagaagtattactgagtcctgtttccaaatttagaagtaatataactgagattgataatttgggaaaaaaataatcatcaagaaatttaaatttaaaaacaaaatatataaaatagaaaattgaagagaaactaaaatttacctggcttggaaagctttttcataattccatcaacaacagctattttatcctaaaaaaacaaaaaataaggcatatttaatcaatatgctgacataaagaaaatctaaggcagcaacgtattgaagtttatattatgttttgcttttcacaaaaatttaaataaagattataactaaattggaatgttcatatcaactaattaggggcaaagctagaagttcataggaaaaattaaattatatattcttaaagaattacaatctaaaatatgtactaaaagcatttttaaaagaatctacaaaatttcaaaaatcatattacttcaacgagactaaactagcaaacccatcaaaagtagatattgtacggttagaattcagaaatattgaaagcaaaatattatacagttagaattacctttggagaagatgatattttcataggagtttgctcatttccaattgcattatcattacaggtattctggtcttttaccattgaactatcatcattgaatttactcttgtcatcttcattcagattaacatctacataatttaaaagacaaatgtatatatttatgagttgtaagttagacaaaattgaaactaaaagttctgttgttgctggtactaaaagtaaaaatgcagcgattaagaagaaagaatatataatgataaataaatattgaacagtaaacaaaatcatattcaaaatttaaaaacttactagtgttttcaggaacaattggcttgctattagataaaagaacaaagacatctacaagaagattctttgctctttcatcaatgcagttctcatcaggaccaaaatgttgaataagcaattcattgatcttgtttttcatatcttgagttaaatcagcaccaactgaagaatcaagcatatctagaaagcttctctcaataggtttaacaggaacattttcttttacatcatcacttccaatctaaaaaaaagagagataacataaaatttaaaacatgaaacaattatattttttaaaaaataagaaatagatttataagtttaccattttgtaacagcactcagaaaaatctttaactggtcttttgccatagacacctttgctgattttatcaaactttgaaatttttttgatcattgaccctttccatacttttattcttggaacatgtttcagtactaatcgcataccaaaattcagaaaatccaaataattcacctattacaataaaaattaaaatgaataagtaactggcagaaaaaatagttttaacaaataattgaaaaaagagagagaaataatactaaccaccagacaatagaagcaacctccaaaagtttttgacttgtcaagcttgctcagatgtttcattaaccaatcaaagacaagactgctccaatccaaattgtcaatacaactaagatcttcaaaaacactcagatatttcgtgctaggttgaagagaagaatttgggcacaggaagcaattcaaggatacaatcatgaaacacattaagatttgttcatcagacattgtttcatttttgataagcttctctccaaaatatttgacagagggcaaagaagagaggccgaaagagtcaagaaggatctgtttgccaacttcaaaatctgaactaatcggtaaacctccaacatgcaaacccaaaacaatatgaactgattctttggaaagtggaatgactttatctctaacgatgatatcacaagaggtgacatcaactctttgtgccacccataaagcaaatttatatggcacgggacatttttcaaagagtaagagagttttgaaacaggttttggaaataatctctctctaatgttcagacaatgaagctagcacatgagaaaagtatttcacagaaaaccttgtcagtttagtatctaaagttgcagcactcttcattggatttttctgcaaaagaaaagatattttcattaaaaagtttttacataaattttgaaaataataaagacaactaataacatcaaactaatttaccttgcttttatgagaatagagtttccttttcattccatttagaacattatctctatatatctcaagcaaggctgaatccaacttatttttgaaatcaacatctactgtttcggtttattttctctatcaaaaataagagaatgcaaaattaattttttaaaaaaggagcaagacaataaaaggggtaataaagaagagagaaatacaaaaaaagtatgagaaatgcacaagatctaatatgattaagattctacattattggaattgttgtatagaaaatgacatgtttcaaagttcatcagcagatatcaaattcaaaaactaaaaataaaatgcttctacctttagacaagcagataatgtatcccaattaaaactctacaaaccacatttatgtggagtgccctttttacattattttctcaaaaatcaacagcaagacaagtactagaaaaactgaatgtgagcacatattgacaattaatgacataattgcagcaatgctctaagaatgtagaattgatattgcaaatttcaagtattgaaaagaataagaaaaaaagttaaaggtatagctaagggatataaaacagaaagcaaaagccaaattacagtcaattacagtgaatttatatggcaattacataaatcaaaaactgtaattacagaaaaaaaattatgtaatagagagaagtctaaaatttaatgtataaaaaagcaatgataggaaattataatagaacatataacttaaactaaacatagtgttgtaaacaaaaaatgcaataatattttgttaccttggaagtgccttcatcagtatttttcttcttactcaactttcttttcaaagagttcaaaagttcatccttagaaattccaacataactagattcggagtcctacaaagaaaattaatgaaatctaagaatattcttacaaacaatgttaaaaaattatttcataaaaacaaacctcattgtcacaaaattcatcatcatttggagaactttcatattcagaagaaatagaatcaccaaaaagatctttaatatcattaggattacccatctattaaaaaacaaaaaaattgaattaaaataagatagagaaatacacaaagcatgcatatcagaaatcatatatacagtcacaggttcacatcacagtttcacaactcaaggttaaaaaaatgtacagattttaacagtaacatgcagttgcaaatatatctaatttgcaaagtctagtcagaagcacaacataagagctaaatcaaagcctatattgcatataaactaaaaaagagggtgattcgtcaacattcgcacaaaaaatacagactacaacactacaagaccttcgcaatcttgagctcaaatcacaataatggcacctccaattcgaccacatccacttagtgaatcaccaaaaccacccccacgacaaacaccacaaaacgacagtcactagaggccaggataaatcactaatgaatcattgctgaataaatcattcaaataaataactactgaatcgcttgcaagagctcaagagggttattgagtggattagtgagttaacacaagaaacagtatccattaacagattcaagcaaaatgctgcatttgttaattcataaacaaaataacattaggaactagtagtttttggtcatgaatgcaaatgcaagtatctctggaaaatatgtatgaaaaacagataaacatgcgctgcagttcttaatgaacatcataacaaataggctaaaattctaaattaacggcagaacaaacagattctgcacaacatatgagaacacactaagaaaaaatctggatgacttgtgaatgacaggaaggaattggatactcaaacaaaaaaggggaataatgccattgacaaaatgacttgtaaatgacagtagactagatcttattttgtatgaacaattagatctacacctaacaacctaaaaatatcattaacatctaagccataagtgcaaaattagcttctgaatattggatcaaatgaaccatgtcactgatttggattaaaaagtacttctctaccttaaaacagaaataaaacaaacaacaacaattgtaactcaatgtctcataacacattcagtaactggatcaataaactacatgattcacaaaataacagatccactgaatccaaacactcaaaactcacctaagataccagcttcaaatctaagcctcagccaaaagtaacctacaatccaaaacaaaatagagattaaacctaaaaacaccacagaaaaaacaaaaacacaggggaaaaacctaaaacgttgtagagctgaccagatctgagactcgaaacaaaaataaaacgaaatcctcacgagacaatcacgagttcatcacgagttcatcacctactgcacatgctacgactacacaactcatggagttcatcacgtactgcacaagctacgcatgttccaaaccctaacccgtgttgtccgatcaaacaacaacagtgaaatcctaaaaaacaaaaataaaacgaacaaatcaaactaaatcctcacgaaacaatcacgagttcgtcacgagttcgtcacctactgcaaatgctacgactacacagctcatggagttcatcacgtactgcacaacaacagcaaaaacacgagaaggatggggaaggagacggtgaagagcaagagagaagaaaggaaaaactcacgaatcaaatagaggtcaacgagcagctctacatcagcagaaaaaggacgacgaactctccggcgaaaatcctcaacaccggctagatctacgccggcgaaatcgccgtggcggcgaaatcgtctcatcacaacggcgaccttgccgaagcctctctgtctctgtgtgtctctctctcccccagcgagtgagtgattaggggagaaatatcaggacaaaagtgggacccacaaaaatcacggagaaagaaatgcaggcgcggagatcaaaatttgaaaagtacaggtgggacccacaaagactgaaaatgttaggtgcgtctctggaaaaatcaagtgggacccacaacagcccaaaaaaaacaggcccaacaacccagtcaacccagaccacgaacgcaaaaaaaagcccatatgaagtaaagaagtccatctctcagcacgaatcttgaacagatcaatggcccaaaaaacgacagattcagcccaaagaaaactgtcgacagaggaatagcagttccgaataaaaaagggcgaaaatttacagcagccgacgacggggcctctcgaaaacaaagagaaaaatgtctcaaatttgggtggaatacggtcttgaaaaatatctcagattcactgtgctactacttactcctacaggaaattggattattattgtgatgaaaagaagcgagaaacctaattcgcgcgtacgcgttgccgccgcgcacgccggcccactaaggcccatgcacgtaagcgcttgtgcttctttctttatttctcttttttttacaccgccgtttcttcctttttctttattttttcgctgattgttattcctaccgtacagatagattagtctcctatttttactagcgattagtttactagtaatttttaaatcttaactttaaaatttttaaatttggatatgaaagttttcaaatctcgagttgaaagttttcaaatctcaagttgaaagttttcaagattttcaaatctagacttgaaagttttttaatcgagttgaaagttttcaaatcttgagttgaaaatttttaaatcttaagttgaaatttttcaaaattttcaaatctggacctgaaagttttcaaatctcgagttgaaagttttcaaatatcaagttgaaagttttcaaaactttcgaatctggacttgaaagttttcaaatccgagtgaaaagttttcaaaatttgactttaaaatttaaatcttaaaacaaaagttttcaaatctaacttaaaattttttaatctattagtaaaaaaatctccgaatttttttttgagaatcttccctaattactcgtcattaatgttaagtgtatgttaactaatactatagagtagttaggaaggtaatacagagtagttagggaggtgctcgctgctggcgcgcacgcgccagctagcagccgcagaagatgcagatttggatcgagcctgagaacatataccacatgggccgcaagattccgtggcccgtgggcctctgatgatagcctactactgtagtactgtatattgcccaatcaagacagtagtgtcggaatttttttcatttttaaatttttttcttttaatatttacagaaataatctatcggcgcaaaaaattacagaaataggccctgccgccctagtggagggcgacaagctgacgtggcagacggcggctcgacaacgccgtctgccgccgtctgcgaaaattgcatttagcctagggcggcaaggggctaaatgcatttttcgcagccctaaagagcatttggctcatacttttttgcatctgggtcccttgccgccctagatgcaaaaagtaccagccaaaaagtactaggcctaggctggcggcaagggttttcgtgcaaaaaaaaacctccctctcccgtctgtcgtcaccgcccgtcttttccccgtttgccacgtaagcttgccgccctagtggagcgcggcagggtctatttttataattttttgcgccgatggattatttctgtaaatattaaaagaaaaaaatttaaaaatgaaaaaaattcgtagtgtcgtcgtgcaaagcctgtaagatttgtcggtttggaagttgcaacaacttttgcagtgagctgccaaacaacctgtctcaaaacaacatatgcatccttcatccagttgcaccacctatctcccagttgcctatactactactgtactgtatattctactatgactctggtatctgctattctgttacacatcgctaatgctcagcacgtatctactctatcgatctgacaattataaaaaaaaaagataggcaggaaaaaaaccatcgtatcatataaacaaacaaaaaaaactcaatcatatcggtcgagaaaaggcaagaaccctaccttttcacaccgtcacacgagtactcatcccttaggcctaatcggtttagaagggattgagagaaaataattccacacctcaataggtgtggaacaaatcccatcatatccctgcctaataatatcggtctgtcaactatcattggataactggaccaaaaccggccaccgaacaacgtcgatgcgagacagatagcacagtactcctactatatacataaactcctctgaaactgatcaatggagcaataaggtcatcagacagtcatcacctcacctcacccacccacccccaccagctgatgaaagccacagcacaagcaaaatcacaaagctggtatacagcacagcagctcagacataccctgaatattcattgatcattattcactcatgtaccagaaacatttcttacacgacaagggaacatgagagagcatatgaacaccagggatcaataaatgaatgaatctagtgacaaacaaatcacatcacaggtggtaacagtagtagtattaattcatcatcaaccaccagcacaaatcaatacattatccaaatacaacactaagaaccagttaaaactgtgggggagaaaaaaaaatactcgagataatagcgagctgtaattcacaacaatggcattttagaatctcaaacggcaaacacaatcatcatcatattcttcctagtctacaacacctttacacatgtggttttttcttcttcttccctttatgttacaaaggccaccctccatcaccaggtgaggtgagggtgtgttcctcaactcctgaagccaaagttggaccacctcctcccagcatctttcttaacacgctgcgagttggtcacgaaaaggttttccagcgatttctgcttcctgttccgggaccgccctgcctccttcagaagctccgcaagccttagcttctcgtcctcgacatccgggtttgctgtgccgagcttctcttccctcaccttaagtacgtgttccagtatttcaatggcgtcctcaaccctgaaggcaaaagggaaatgcacttactcatgtatcaagttaaaatattggaaatctaaaagaacaaattctatctgttttctttttgcacagggaaaaacaagttgtggcaattcctaaatttatagatgcaacctcacaggtatataagcaatcaatacacccactcaaaaaaaaggggggaaaacagcacgcctgtaagtttggaaatcgactgagttgatgcaaatcaccgcaggttaatagcatttcaatgaatagtttatatcaggcaactttataaataattggacagttgtaatcatacactggcatgcagcaacatgtgggcaatttgatggtggtccactaaactaaatgatgccttcatttatttgttgattgattgcaatctctttgttaatgccatcgaaattatgcaaccttacataggatgataatctaattgatcaaccaatcttgcctatccatccaaataatactacacatgaactaaccgcctatccatccaaataatactacacatgaactaaccaacattcaacatttcacggattattagaggaggaaacccataagctgacaccttcagatagcaaaacaaattcaggggattacttctacagctgtgaatgataagggtagatgccaacataactcaataagcatattcaggtgcttgtcaatggcatttcttggattttccccataaccatcaagggattgctaccaagatatgatttgatcctaattctatatgaaacagctgttggttgaggaaaaaaaagtttctggtatgaacacatacctgcccatagcatcgtagattgcagccaaattactgtagacgccgagagtatctggatgagaggcaccacactcctgttctagaactgcccttgcctcttcaaacaactgtgcagcctcatcaatcttgaatagctgcacacaagctagccccatctggttcaacagaactccaaaaaatgccgacttcctctccccgctagctctcaatttggcaaccgcattttcaaatgagttccttgaatcggcatacctccctaccatgtagtacaacacacccatttgtgcctcgatgccagcaacagtgctccactgtcctggtgagtcctcaagcaactttagtgccctttgcaaaagcttcagtgcctcatcaaggtctccaagcgcctcatagatggcagcaatctccattaggcctccagcaacctcatcaggggcagcgccaggcgcgggctttgcatagacacggagtgcattctcacagtaggatttggactcgcggagcctccctgttcggtggtaaaggtctgcgaggcggacaaagacagatgcaaccgaagggtggtcatcaccacgggcagacttgagtactgtcaacgccttctggtaggagaagacagcctcgtcgaagcgggcgagggcaaggtaggtgttgcctatcgcgacatcgatcgtcgcgacctcaatgtcacgtccattggcgaccatggtcatggaggcaagcacaaggtgctccagggcaccatcatagtcacccttggcgtcaaggatgagtgccatcaggcggcggtcggaggcctcctcgagcgaagcgggagcgctgtgctcccggtggatctcgagggctttgcggcacaacttctctgcttcatcgaactgcagggcttgcacatgcgcttccgccaaatacctgctcatagtgcaaaataaatgttgtgttggtcaagtgctagctcttgcagattattgttacttctatctctactttttttttttttgcataataatgcgatggacttgatgaaatttatggcgagatcggcggaaatcacaaaatagcagagggaaattaaaaaagatgtcgcttttgaagaggtagattggagttgaaaagcaaaatggcgtttctaacttttaagagaggagatctagatcgagaaacgggcgagaaggaagggtttttgacctgcaggtctcggcgacgcggggatcacgctcgccgagcgcggccatctggatctcgaggcccttgccgtagcaggcgatggactcgtccatgcggccgagcatggcgtgggtgtcgccgagctgcatccagccggagaaggcggcgagggcccactcctcccccttctgctggtcctcgggcggctgctcctccgccgagctctcaccctcaggcggcggcggaggcggaggcggcgtgacgacggcgacggcgcgctcgaggacagggatggcgtcggcgtgcctgccgaggccgcagtggatggcggcggcgacgtggaggctcatggcgagctcgagctcggccccctcgccgcggcgctcgagcgcgcgggcggccctctcggcgaactcgagcgcgcgcgcggcgcccccgccctcccccgagaccatggcgtcgcgggcctgcttgagcaggaagggccccagatccgggttgtcgagcgccgcctcgtccgtctccggctgcgccgccaccttcctgggcttggcccgcgacgaggtggaaggcgacggcgacggcggcgcccggctcctgggcagcggcgacgacagccgcctcggcggcggggccgccaccggtggcgagttgtcggccgcggcgaggcccggcatggtcgggtgaggcgagcgcgaggtggggagtcagagagggacacagctgcttggccttggccttggccttgcttgcaatggaagagaagaagaagagcggcgcggcgcgggggtttgggtggcgtcataatgaggagagcggcacgagtaattaggcagcggttgatggccaagtttagtcattaatcaattaattaaggtcctcgaggtaggcaattaaggtggctggttcatctctctctctctgtcgcccaagtcttctcgtgtacctagttgattcgtgtactacggcctaaggctacaatgtactgtggctgtgtgcctgtgtgatgcgatggtgaatgggaatgggcttgattagggttgattgtgttgacctgtctcagaatgacaggtgggccatgcgtggttagcttgtgattaaggtgacaaattgttgggggtcttcatccatcttgatcgctgacaaatctgcctggtgttgcaggcatacagagcataactgagaaaaattattgttacagattactgctccctccgtttaatgtttggactttagagaaggcgtcatttattgagagtatatattttgacaaataaatttaaataagtggcctagataatacactaggaaaattatatttttttaagtgtggagcaaatatttcgtttaaatggttcagtaaataatctgaaaataaatgcttgacttagctactcacttgtctattgtaagtgtattttccgaaccactaaacgatgtatttataaatattttttacataaatatttctttataagtatcaaatattttgttcacgtttataataattagtatttaattgattacatgttaatgttaatgattttctcgtttcaagtatcgtcttgacaagcacagggcactactacccccagctcaaagctctgaaagttcgcttggtcggtatcgacactgatcctatgatatctgcttctacgttcgtatacattagcatgtagtttaattaattatatagtacgtacagtacagtgtatgagaaacattataattaagtagagtaggaggaaggattaaggaaggagtgcattacattacgcatgcatgcctacttgcaagttgcaaccaccatcggaagaagagatacaacgaaaatgatgaaatggatcatggaggatcatcagagctgtaatgcttccctggcatgcacaccctgtcatgaactaattagctcgatcatcacactgtatatgtttgtatgtcctaatcattgttttcggatccatccaaattatcctgacagatcttaaaacacagcccatcacaacgctggtttcgtacatggatatgttcttttcagacaccaattgctgacagtacattagtgtactccataggttcatcttgctgctgccattacttgagtgtagacaaagaaaggagaattattgctcgtgcatgcctcggttggtccgacattttcattgccattcgagcaccctatggattacagactgacagttaaattggttcgctaagtgtgatcagtgttcagtaacattttgctctgttcttatctccaagttcccaacccatctccctcgttttccgcgcgcacgcttttcaaactgctaaacggtgcgttttttgcaaaaaatttatatatgaaagttgcttaaaaaaaatcaaattaatccatttttgaaaaaaaaattagcaaatacttaattaatcatgcgctaatggagcactccgttttccgtgcggggagtttagttcccaactccccctatccgaacacagtactcctccgtgaaacctgtcggtgtaaaatccgaagagaagttgtctaacatgttggtgggccttgggcctcgtcgtgggctttagatttaggttgaggcccacttatcaacaacaaatagtacaaaggccacaacaaggggatgacgaactgccgctgctactcgccgtcgccgtcgccgtcgactcctcgtcgccggcgtccccaaaccaagcaaaatgccatctccgtctctcctcctccaccaccaccaccaccgcctctcccctcgcttcgccccctcccgctccccctccccccgaaccctatcgctgcatcctgctcctcgcctccgcctccgcctccggcttcgcgccagcgcccgcggcggcgggggcagcacacgggaccacgatgacggcgcgcggtccatcccgatagcgcggtgctacgaggcagccctcgcgcgcctcgacctctcgggaaccgcgcggcgggagcaggcggtcgcggcggcggcggcggccgatggaggcgcggctgccgaggctcacctcgccgctgtcgccgacgccatggtcatggaggccttcctccctggacccgacggcgcccggcgcagcgccatgtccacacggctggtgagcgtttcggggttccactcccacctgtccctgtatcttccctttgctgatttgctccacacaaccgattgatgatgagaccaatgtatttatttgttcccttacttgtttactgcttctgcctagtgtgatgctcgaagttgcgtcctaaattccacccggactcagcatcccatcagaattagtgtaacgcacctatatctatttactctaagctttgatgctttattttgcgctaaattcggagtattggttgctctggatttcgtcatttcatacatattacgtgaaatgtttgttggcatgtacacagcctattcaccacacggtagtacatatgatttttaagaacctgtacagggtgaaacaactaactgtacatgctaagttcaccatgtaaaattaatctcttggaactattggttggtactaggagtccaagtgcattagtgactcagtgtctcagcgcaagtggccggctgggaattttatgatacaatagaggtgcttgtacttgtagcttaacaacaaatcagtatctgtgcttttctatcatgttgtgtctaggaagagaacttattgccagttttgtatatatcgaacatggttagatgctttaatttcgatcggaatgtctgtccttgttggatcatgaggaagttctggcatttcattgtagattttgcaagcaaatgaagttacagagaaggccagtaagctaaagaaagaccttggcactgaatttttctctgaaaacgaacctgatgcagagagtgttttggcaatggcctttaagcaagttgtaatggatcagctcacaaactttcggcttgaagtgttctccccaggttcagagatagatctccaagatttgagcaaaccccgaaaggtgttcctctgtaaagtttgggacttgtatattattttgtttcgtttgtttgcttgttgctaatttgtggatgcacaccaggtgcctgcggattttagtatcagatcatcagatgaaaaacttctagctgctcttgcggaagccattttctcctgtgtcattgaggatgccagaaataattacctagggggcactggtggtttgtttcataagtggaagtcaaactgctcattggattcctctgtttgcatagacataatttctgagtcagaagtagtgaacagtgctaggaggcgcttagatagttttgatcttgtacagtcttctcatgtagcgggtaaagcaaagaatggatggtggccagctccaaagtctgaaaggttagtgaagattggtggccctgattttatgctttgggccagtgagtttgtgtacacatataaactacaaattgatgccaaagcattcaagaatacaaagcttgggggtcatcatgtgttagcaaataataagggggaagttctcttatcccacgcccaaatggtacattattattctctccttgtccttgatgtatacattacttgttgccattcttatttattgtatgctattctccatctcccaaacctgtaggtggagttagcaaatattctggacatgtattttgaagatcagttcacattacctggaaaaaccttctattccaactggaattcagaaccatcaaagattaaaaagaacaatgtatgctgctattttttatttcagagcttacttgtgttaaatattttttttttatttatgttcatcaagcattttttttggtgcagggttatttgaacaacctttttgctttgttggctggtagctctattgtttttcttgtcggcgccattgctcagttatgctggcctcagtctcttaaagataaaagattggccactgttagttcatgtgtctcatcatcacagagctattgttctgatatccactctctagatagtagtgaggtatgctttctagttcttgaaatgttgttgcttgcccagggagaatcctgtttgtttttaagtgtggaaacactttggtattttatactattttctggatttttttttacttgataacccattcacaagacattgatcgtcattgtgttgtaatttagaaataactactcaactaattggaagtgtcccaaaccttttgatagtgcaatattgttctctacgtccaaatcaaagaaaaggaaacaagctacctcgatttttagttgctctgggatattttgattgtctgcattatcctatgcaacatagcatgtaagagccgctgctttaaaaataaaggatctctaagaaatggtctgaaactctgcatgattcatgtagaagtcatttcatcaacttgttatggcttcatgatgtgtgttcccattaggaacatcatgtagcatgtctcctttttgaactattacccttttgccagcaaacctagttgctgtttaaatttaattaagggcatatctggtgacaaatctatcataactactttgttgattatctaacatatctgttgtatgcaacctatttacccctgggcagttgcaggcttactgtgtatctgttgttgagaaaattaaagactcatttggttgtactggtgatctaatggttgatgcaaatattggtgcttgggttggagaactgcctgaattcttcaagggcatcaactgtgacagtcatgatgattatgtcgatattcagagtactggtgctattagccaaggagagcaaccctcattggtgtcaagtcctattaagatgtcttctcatctggaacaaaatgatgacactcaagaaactctgcagaatattgctagttttcaggtatgctcatttcctgcataaaaaatctctttgtatcagatgaagaacttggtatttttggtaaaatgatgtgcctaccaactcaaatgtgtatttgccattaacatagttcatgaagagggttaatcaccataaaagagattgatgacgatggtttggaagtagaactgaacctaaggggtagagggttggcaggctgaggaacttggctagggaggatagactggaacatatggctgagatggacttggtgctaacttatatggtttcgcttttatagggacgacatctaacaatccattcaaacctttcctttaaatataataattctaccccatctgataagatcatatcctatctccaattaaacctaagttgctagctaagcaatgtgttgcagataaatattgtaactgccatctcacaccagccctgatgggcccgtgacctaccttatggccatatgcagttatgcacataacaatatcactgtgtgaggtttttagtctgtctattttatattgcaaatttccccaaaatattcatgctaacaggtttaccacacatctgtttatgatgcactgtcactacacattttcagtacttttaagttaccatgtcatttctttatttggttcctgtttttattgttcaatttcctttcatgcttggtagcaaaatgcacttgttttgccatctttattattctaaaacaattgattgatttaagttttgctgttctttacattaatttcctggttttcttattttcagcagcatatatccaagatctaaagtggatgttctataaactataataccctgtttggcatatattcatttgttctttggacataactcatcagtcatgactcaaaagaaagagactacactttctcttttctatttcgtttaatactatgaccacaatgaaattaatcgtttaccttgagtgttacaagatagcacaataagactgcaaaataataatgttttcgttcttttgaataagttgtttgcagcatctgttaacttttcctgcaagttgggttgcacgaatcacccaatgccattgtcttatacttttgaaactatatgatggtagaagattacacttgactttatgatggaaactattgttctattgttcatttccttgagttaaatagttcagacttacactatatcacccttttttgatacaaacttgcaggtggtcatgtcagaaagaggtaaagtagttggatttcagccaacaaaccgcctagctgtgaatcattgggcaacaaatccattaacgaagctcctgtacgaggggcgaaagatctctccaggtaccatgattgaagtatcaaaccatggaattttattgttaatacctgtgctaaagctgtattttgtctttgcttaatactatggtatggatattgtcagcctttctggagcctaggcttagaatttctcgcccagctaaggttgtcccagttgagttgctgatgtcggtgaatccagaatccttttttgctttggtgaggcctgttcaagatccatgctaatggaggtacttttcatttctcctccagttgttctccatctactaccctcaccctctcttctctctcatgtaattctataatcgccagtactttatttacccagagttctgtagttgctgtcctagttaaagctaatgtcatttgttgtcacccaatctatgcttatcttacccttaaaacaggattttacatgctttgtcattacatggtgctgtacagattcatgaactttttaaacatagtagactgggcagttttcttgttggttagtggatgcattttatagtaaaggatatggaattataaactctctaaatagtagctttactctttgtcttgcatgcgcttgcgaatcaaatagaagaactgcaagtaggtgttgcaagctatggaccatgaatcattgcagcacaggctctcacgttggggttctctatgtggttaaagcatggttgaatcgatccacatgtagaagttatcagttattacttcttaatgactccaatccagatgacacaatggagtccctttgtggaatatcagcaccatgccagattgcaatacagctattcgtgacgatatgctgtctgttctgctcatgttggagtttatcatcggttttctgtttctgaagtctcaggtaattaacctcgaaccttctgggtaaattctttttatcagtagtaacaatggtagctcttcatcatcggtatcaggatgctcattttgagttttttttttggggaagaatttgcctcaagcccattttccagtttctacagaaggctggaagcaatttcattttgcgtaatcaagatatcacctgctagacaactttgcaaactaacatacaccctgtaagagttgtcaagtgtacaattatagatcacagtgaaagtagaatgaatggtaaccacttcagttgacatcataggtcttgggcgtctatgatgtaacactctctttcgcacacagcatattttgtatgaaaaatattatataatcgatctcttctactgaactattgttctatgtgctcgtatgcaccacagtaaattaggatgctaaattgatttgtcgggctgcaaatctgaattcacaatcgtgagctaggcataaatttctccaattgagttcattatcacttcctctgtgataatttggttcattctctccgtgtggtgggcagcatcccagtatatgtacttgctgggatgtgtgcatgctcttcggcctctgcatgtttgcccaacttcaataactcctgttccacaacaacctcttgaggtttctgtcaggcctgtagttcagaagaaaatatttttttgaggttataataccaataagtgcacactttaataaggatgctctgaaatataggacaacttaccatagttattggggcttattgttgccatgccgatggttgtataagtatcaacaaatgtagccctgatatttggttgattctttagaagacgcaccacttcaactagcctctcattaaatgaggttgccagcaagttcatgttttcatggcatctggttgtacctgtgcctagcaatgttctagcaataggtaaacacccaattgggggcactccaacaaagacaaatctccttcctccaagtgctgccatcacctgagtaacatggcaatgattaggtcttgagcaaaagttgatataactcttttctgacaagtgcttacctgggtgtagttagcaacgcgtgatatcagctggttttcgtactgtgggccgctctctgctgctgactggtttgaggcaagatagtgaaaaagcagatctgttgttccagcacttacgacgaatgtagccctcctgactagttcttctgctcttcttcgtccaactaacctctgcaggttccttttgtaacgccaaaggtcctctatttggttgggaaatgacagtgcattctatcatgaaaaaggaaagaaaacctgtcatgacagttcattctaccatgaaaaagaaagaaaacctgtctagtcactacccaatgctggccctcaataatcaaattaacttggactactaagtagtcatgattcacatatcaaactaggttgatcatgcattatctgcttggttatccaattttgactactaaaaaatatttggtagtagcttctaattctgtccctggcagattgatttaatagcttttccttactttctgacggtgaaatatttgtgctttgcaggttatgcttaccgaacttctggcagtggcctcgtcatacccggaacctgctgatgcaaaactcacacccctcctgagctgtcctgacctcaaccttgggtcgcggaatcctggaatactcctcgctatacctagtttttccgctgcataaccacaaagcttatcctcaaatatccctactgaacaatggtgaacaccactactaactcaggtcaccttctaaatcaaagcacatctgctcaactctgaaatacttgtgtaaatggagatgcaaggcaatgggtgtatttgtgtctgtaccgagtatgtccgtgatgagccggccgttgctgaaccggccggtgggcctgccgccgaggaagtcggcgccgtacggcaagaagttggccttcatcgccgtctgcagccggttgttgttgccgggatccaccgtcgagtcaccgaacaccagcatggtggtacacccggtggtggtgtagttgatcaccctcgccggcggtggcggcactgaagaccagcccggctcctgcggcggcaccaccgtccgcggcggcgccggctccctccttggtggcaatggagactgccacggctgctgctgctgctggggcggcgttggtggtgctggctccggcgtgtcaggctcctgtgatggcggggaatccggcagcggcggctccggcgaatcggaataccccggcgacggtggtgacaccgggagcccaggcatgggcgggtcgtcgtattggtcgtccggtggctgtggcggtgacagctgcgccgctgccattgttatcagggagaagtgccatgcgacgaggagcagcgccgccgcagccaccgccagcctcctcatggacttgctgcgttgctttgctcagttcagttatgtgctagcttgtcaaggtccaaagacaagagtgcatgcatgtataaataaatgctcagctaagtaaaactgccgttgcctgtcaaggtggcttggtgccatgtaggtaagggagcgactaagggtgtgtttgaggattggggagattggggagattggggagattgggaagatacgcaaaacgaggtgagccattagcacatgattaattgagtattaactattttaaacttcaaaaatggattaatatgattttttaaagcaactttcctatagaaattttttgcaaaaaacgcaccgtttagtagtttgaaaagcgtgcgcgcggaaaacgagggacaatctccccaaacactcacaaacgaacggtgcctaaatttgcttaagagttcgagcttgctttgtgtgacatgactaaatttagaagacattttcagtgaaatcacccacttgttagtggccagtgggagattaatcgggagagattcttgtaaaaaaaaaaggagatcggaataaccaaagaggcacatactgcaaaattgcaaagaagagcaggtggtggttggttcagtggtttgtgtgatctttgcgtctgccatgcaaattcgctcttctagaacaatcttctttttttcttttttttccagcgaaaaaggtactgtgattttgtatttcctccttctatagtcaacaacagatgtcaaaatatgcatattcttcctccggtaaaagaaatacagcgtttcaacatttttcagttcgatcttttaaaattttgatcatcaataatttttgaaatgcttattttgaaaatataaaaatggtcaatgtagatttgttatgaaaaaaaatactttcgtaatctcataaaaatgatacatgtgtagattttataagtacctagccatgaaattgattttcttccttcacaaggtagaaccgaaggtaaatactgaaaataatagcaggagagttttcttttaataacaattctcaccatcatggcatcgtctgcttcaaaactagtactcgcaaatccatattcctctagaaacaagtaaacaaatagacatgtcacaccaatacacccaattgtttactcataagggattactcgcaaattactcgcaagaaaattccatttattatgccaaaggacatgagtgtcaaaattttgacattaattaaacaaaaaatgcaaacatttattatgccaaaggacatgagtgacaaaattttgacataaatgcaagagcctcagctagacaaaattgtcatttacaaaagagagtcctacatttattctacgacaaaattcaaaggaaaaaaaaactcttctaaatgtctatcctatcctaaccttggaaatgactgaaaaacaaaaaacccaacttcttcacgttggaatccggtctgcccacctataggcctgtagggatataaaccttcaaaaaataattgaattcttcatacctctaaattctaatatgataatttttgtatactgtatgatcttttggtatcatgtcatgcactctaaaacctaagaaagatgatctaaataaataaataaataatgaggatcaatttccctcatgcttcggctgcttattgtcattagagctggtgccctgctccaatgaggccttcacaaatctgcctctgacacgccttcgcgtgtctgctgttgccttgcgggaggcgtacattatctgcttgacaaacctgaaaaattcaaaagtgtaccagcaacttgtaattgcaatcttgtttcaaaaagctcgtactgaacaaaatattattcctaggcaactaaataatatttcagatgcacatttgagaattttaactgttctttctgaagactaatctgcaatgtaagctacaaagtgagacgaaaaatgcgtattgatacgtacctcctgttgctctttttctccttgtatctctgcacagctcgctgtctcttctccggatcagggcaagatttctcgggcagcacgatatgcgaggtctgttgatcttggccgtcaaacatgtttgagctcccacccagcagcgagcccgtgttggagctctgaaaattcacacagggaaactctgaacctgtgttgttgttgctactgtttgtgtctatcaccggtaactgatcatatgccgtttcgtcgtttatgttcagtggttgcagaagactatgatctgaagattgcggtatgagctgtgcgagttctgaagatgaagttgctgctcctatctcgttgttgatgttcgcgtccatcatcggtaactgaacataaggtgcgttgctcatgttcagaggctgcagaaagctagtatctgataacagtgcgatgtctgaacacgatgaggatgccatttgctgatgatcagggtccagataggatcccaaatcgaaataagaaggatccaaatccagataagaaggttcctgcgatcaattgaagaaaacaagtttgtgaggcggcatcaaactgtacgataattttgatgaatttgaaagggggtgaaataagcagaaccatcgtttacttgcaatgctcctggttccattagtgcgactgaatcaaacgagtttgtccaggcttgaaagtaatcttgctgatttgcattgtcaacaagtaaatcttctccacctattgtcgccatctctttactaatgtcaggattcgcatcttcaaacatctcaaatgagacatgtgtgtatatatatattagtatgcttatgttaattgaatgatggtaataagatgatatgttagtcatataatggaatgctatatattaatgggattgatcaagggatgaattaggtaaggaaaagaaatgcaactcacttttgtttaagaaggcagatcacttagagatttaagagtttaccattggcttcttttaataccagatcacttatttttaataccagatcacttagagatttaaggaaagaatgagtttaccattggcttcttttaatacctcgggataataacaataatttgtatagctcatactattgtcgtatgggacgaatgggagtgtgtcggtgatccacggctcatccgtcgccgccgccgccggcggcggcggcggtgccggcacgtcgatagagaagatgcgggccatctcggcggggccggggataccggtgtaagcggcggcggggcggtggcagtggcgcgaggcgtcgcgcgcgcacgaggcgc

SEQ ID NO: 65853 - DNA, 17992 bp, Oryza sativa
atcagctatgttactgttgtttcctaagaggactacatcatacaaaaggaacatagtacaggtgcaggatatgtgaagaagccaaagaaagaaggtagcagtgccaaacaacgagagaagaaaacaaataacaaggttggctgcactgaacgtaagcacaaggaatcaaagaattatggcatcaagtaaatttaccatcataaagttcacccaaggattcaaagagaggaaaagatttgtttttgctgaacttccttactttctcatttgactacacaagatacaaaaacagataattatggcatgaatacaaataatagtgatttgaatgaggacaaaacaattatgctcaaaatatcatactgtaattatgtttgcccaaacagcatcatcggcaacaatcatgcaccgttgattatcccaagaagctccactctgtttccttgcctccttaagcaacctataatctcgttttaactccttctccttatcttggatctgttgcttattcatggtgacatagggatgtctgtcacgaaattctttgacgaccttgttccatgcttcacttgtccacccgttttggcaccggtaatgtgggttattgtgctcatgaagtaaatcaactaaagccttttctggtcccgggttccatgaagctcttgattgttgagctattagacaaaattagattatagtaagtaaaatttgtaatcattaatatgaaaggaaaatacttcacaaaaaaacaagttagatactaccttttggagaaaccttcttcttctgtatgctacagctctttggtgatgccttcttttgtagatgcctttgttgctgctgcaataggcttgctttcggagatagtcttccaaacatcataactatattgcaatattttattgaatgagaaaatacaaactacgttgcttactattaatttgtccatatcataaatgttgattgcataaataaatacaaataatgcaaaaccaaaatattatctatactattcttgctagttacgaacataatcttcccacatcttcttagcaatcatatctctaatattattcccactgatcatttgattgctaagagatggcacatcatttcggtattcactgtcaccttctggtagatcgacaaaattagtaggttctatattatcaggttggttgtccaaccagccctcatcaccattaagcaaccggatcatgttgtggaacaccgcagcagctgctggaatccgcacttggttctttatccgatggaaagtgcctactttcaggatgggaaatcgcttctttagaacccctagagctctctctacatggtttctcagaatggcatggcgatgattgaataactccttgtagtctctaggtctacgatgaccacgtccaaactcctttagatggtaccgaacaccacgataaggagtaatgaactatggtgtgttggcataaccaccatctactagaaaaaatttaccatttgggacttgaaagccactattcattgctgatctaaggaccctagcatcggttgcagacccctcccaaccacatgagataaaagtgaaatttaggtcgaaatcacaagcaactatcacattttggctcaaagtcccttttctgttcctataaggagctgccttctctccatctatagttataggaatgtgagtgccatcaatagcccctatgcaattctgcagcaaaaagggaagaaaaggacagaatatgcatgagttatttaattggaaaaggaatagatattcatttctagtttgagtgccagattcaccttgaagtaaggaaagaagcgaggatttgttctaatcttccaatgcgtttggtcggcatgaggaagcttgagaaatctataggtgagagctgggattatcttgaaaatagacttaatatgccgatgaagtgtagacccactatgcttgaattcatattgtagatcttgaaagcttgcattgtgagcgagcatgaacataaatatcccaagtttctcctcaatcctcaagcctctactatcctttaacaacttttcctctctaagataattcgctattgtcttgaaaacatgaggctccatgcggaatgcaactttacaatccattacatgtccttcaaggatttcttgaagccgctctttaccggatagtcttgagatatgtctaggtattttctcactatttgtcataccgcacagcatatacatcgcaggaaaaacaaaaagcatcatatcatcgtcctcttctctcctccttttaatttcatccgccattctcgaactgattttatcactaaaagagatatagaattactatactttaaactatgtgtgagaacataataatatgcatatgtattacaatattattaaacatgaaattagaggcattcaaggtggctacatgcataaatacttttaatactttcagcaaataaacagtctgcaatggaaggagggggatcaataatgtgttcagattttgactagttccagaagtactttgtgtacttagttttgtttaaacctcagagatagcaactttaataaagtgaggatatccttctagggtaggatgtttacttgaaaataacagcctcctgttcactagcaaaaaaaaactgagaccatctgccacctgagcaagatcacataacattgtacctacaatctctctctctctccaacttcaaattacttctgttactctagtaaatatgcaggggcaagattaaatgcttcatatcaggcaaatgtaagtacaactgtatttagttttttctcaaataccttgagtaatatcaactccttcagctttacttttgccaaccccacacgcctgtgcctctcctgaaatttaattcagcacaacagattatatttttgtcattcaatagcaatttatatagctttgtatggtatgacctctagtaatatatctgaacacccagtttcctgaaactagttgtgaacatagtagcagttcagaatagataaatatgctaaattgattgctaagagtaaaataggtattcgaacaaaagatggacagctacatttctcaagttttaacaagggcattttgctaaacaaaaagccatggaaaaaattaccaaaactagaatgtatactacagtgtccacctgaccacctcatagcatgactttaaaaatttttgtatcttcttgctcattcaattggcatatagtattggtcgttcaatctgaagctcaaatgaccttggccaaaagcaaagtgatgcattctagacagcaacaacagagtgcactagtttttattttttaggtgtgctcccactgcatctacaataattcctggagaattaacaaaccaggtttctccctcacaaaaaaaagaaaagaaagaagagagcccatgttcagaaatataggatatgccaattcaaatatatatttccttgattacagagcaactgataggcaagatttgcgcacacacacagagatgtgcatggaattttctgtggtttcaggttctactactacaaaccacatcacccctccttctaagcagaacatgactgatacttcaatccatacagccactcaatacatcaactagcaacaaattcatccactagataagtcacaaaatcttttctgagtgggaaaagaggagatcaagaatcagacctgcttcttggtgtccgggctgttgccctcgaccttgccctctcccgcaaccggtgaatccgaagcgaggaaggagagatggcgagcgccggcgactggctgggatggagagcgggaaggagagcggtggcggcggctgaagcgggatggagaccggcggcggctgaggacgggatggagaccggtggcggctgaagctggatggagatcgtcggcgaccgagggcgggatggagagcggcagcggctggagatatgctgctcctggatctccaccctagagccgcctcccggacctcgcgtcgcctcccggacctcacgccgcctccaaaccctagcgcagcgaggagtcgaggaggccgagcgctgcggctggcttggaaaaaaaaatcgtctccgaggcgatttttctctccccgtgggattggtgtggattgggtggagaattactcccaccccggcccaggcgaacgcatacatgggccacggaagaaaattcgacccggccgggatggcacacggggatgttggcccattcccccccaaacccagcctaaaagaacaaggcctgaagattgggggccctgtgcgatcgcgttggtcgcactcccccgggacggctctgagcttgaataaaaacttctgcacatataaagattccaacgacagtaaggttgtgacgttgtccttccacgaggcatctgcatagcatctggtgcctaacggaataggcaaacagttgtgaaaagcatttgtattatctgttagagtaaaatccatcaccggtccctaaacttgtaccgctgtgtcatcctgatccctaaactcgtaaatcgatcgttcaggtcctcaaacttgtttgactgtgtcatcccggtccctaaacttacagatcactcgtttaggtcctccaacttgttcagttgtgtcaccctggtctctaaacaggacggtctaaaaactttatattaaaaaataattcataactttttcatgtgaactttaatgaagataaactttatatcaaaattgtagccctcgacgcgacctacaacattgtagttgagaagttttttaattaaaactgtttagggtcccaaaatattgttgcatgtttatagattttgaaattttaattttaaaattacattttgggaaaaaaatgacttaaaataaaaaaaaattcaactacaaagttgtagatcgcgttgagggctataagtttgatataaagtttgtcttcattagagttcacatgaaaaagttatgaatttttttaaatataaagtctttagatcgtcctatttgaattagatgatattcaaatccaagtttagggaccagggtgacacaactgaacaagttggaggacctaaacgagtgatttgcaagtttagggaccgggatgacacagtcgaacaagtttgaggacctgaacggtcgatttgcgagtttagggactgggatgatacaacggtacaagtttagagaccggtgatggactttactctatctattattacctctggttcttttgaactttgtagttgcgtcagttgggtgtaagtagatgcagcattattacatatatgggattatttggatcaggtgcagtcacaatagtgaccgtaacttgcagtagtagtacgcatcattggatataaattgaacggctcaggtcgcacatggtactgttcatattatcgtatcagcaaatactgttcatgtgggtactgtagcttttgatctgaaccggtgatcacaaaaatggatggtcgaagttgtgtgcagttgttaaatcacctaatcccaattcatatacgtggtatggctcccattcctttgatttgaaaatgtagtcatttatggctttccaaatcttcgaaagcatgatagagattttttatagcgcattttcagttttcatagtagcaagcaaataagccaaaatatcttgcattgtctgcattggtgtgagagcatctatttgaaggtgaaaatcagatacaaaccaagttagccttgaaaattgacaatgaaagaaaaggtgaaaatcatctacctgctgaccacatcttgaacaagttgaggcaatattagggaaattgtttttccaaacttctttaagaagattgattgttaaagtaggaacagagggttgatgaggatgaagatgagagtgaacttctttgtaagcacttttttgttgcactcacctgattgggtatgtttccagcaaagttggtcctccaaaacttgtggaataatttgtacctgtaagattgattcagtagctttctgatcaaacatttgtgaaattttttcagtgtcccatctcttatatatcttgataaaaaaatcagcaatatttataaaggcaataggtatggaagagtatcgaggacaaggtgaacatgaagacatgggtgcacagtgaagatggcatggacacggtcgggccttcacgctcgtgccaaaatttggtaaggctattttgttttcaatcacaggacgagtaatttcaccgtccttaagaaagtaggttaaaataactaaattttaaattaaaatttttttggtaccttgagatatttagtatctagagatatcaaatttgtcattaaaaatatatatctccagataccttctcaagaatgataaaattattcttataggactgacacacattactacacacgcaatacgttcacatactcacgaatgcatctcctaacaaacggcacattcctaatattgataaaattatttttaaaagtctacttaattacgcatgtgtaatatccgttggcacccaaacttgaatatcggttggtccctaaaattaatcttaaaccctagcattccacgaatattttaaggagaaaaacaaaagaccataatgcatttaattaatataaaagttgtatttgttgaatttgtagatgtggggtattgaagtaatgaaatttctcgttttgcgaattggtggtagccaagaaggtagaagttgatttattttgcgacaaacttcaatctttataagttggtttatttcgggacagaggggagaagtgccgtacaagatgacctggttgtccagacttattaattaacaaaataaaacacgtgtagtgtcgacgtgtagtgtgggcatgtcggatcggcgcgcacacacacgcgatgataacatgatagccagccggcaggtagatcgaaaatataggaaggagcttaattagccatggatggcgcgcaggtagctgcttcattcagttgcgcacccagagcatgtcgtcctgaggcaggaagtggcagactgccaccttcccgggcgccacgccgagcctcttgtacgcctccgccaccgccacgccgtgcccgtccacgtccccgtggcacgccgccaccgcctccgccatggtcccgtcggcgccggccagcgtcaccgtgtacgccgcgcccttgatcccgtgcaccccgaacacggcgtacgcgtagggcatcctgtggcatgccaccatgtcgcccccgggcaccggcacgggcctcacggcctccaccctgtacgcctgcctcggcgtcggcccggccctgttgaccacctccgtggacacggcgtggacgtcgcgggtgccgaggctggaggcgacgagctcgaccatggactcgagcgacgtggcgcagtagtgcttgtgcttgggcgccgtctcgctggcgatccgcgcggcctcgcacacggcgagcgtggaccgcatggcgtcggcggtcggcgagccggcggggatggagagctgggagaggatctccgggagcttttcggaggcgaacgggacggagtcggcgcggccgcgagggagcagcgcggcgccggcggtggcgcgggtgaagtggagcgtcatcttggagcccgggaagaggtccttctcgaggaagaacacggagcccaccgtatcctccttatccttcgaagctgaggccgctgagctcgccgggctgatgaggtcgcgaatggcgccgggcatcggcgaggtcgggagcgcgatcttccagtacatctccgccggcgacgcggcatggctggctcccgcggctgcgacctgaaatgcagtcagaaacaagttgaatttaaaacggttaacttcagatatatatatatatatatatatatatatatatatatatatatatatatatatatatatatatatagatatatatatatatatagatagatatatatatatatatagatagatatatatatatatatatacctgaagtcagaaactagttgaattgaaaactatcaaagccaaaagttgcaactggaataagtactaattgtattacgttctcatcagaaattcaatgaactccatatgttgatccatcaaccatcttaaggtaaacatgttgatccagttagtttaaaattttagctagggttccccgcaaaaaaaaaaggttagggtacgtaattttaacttaatcttcaatctctaaataatatatatctctctcccaacttatctctgttctaggcttctagctcaaaacaactaaaccatacaaagagcgatatatatgtgtgtctgctcaccagaaggagaaggagagcagcgagagacctagccatgctaattaacgagctgtcaaggacacaagtatatgatctaattcactgataagagtgaaactgagcacaagcagttcatagcttttgggagctatttatagatcagggaagcgggaagaagacgaacaaataatacattgcattggccccactggattatgcagaataaaaaaatatgtcatgtagcaaagatgctatatcacattcacgatcatgccggatatctctattattgagcaactaggagggtagcctgcgcattcgcgcgggcatatattgtagtgtatttcagatatatacttataagtaatagaccgattgtgttaaatgtcgtatttgttatatagcaaaatatggcatattgatattatatatattgttggtttgattataaacagagtaatagttagattagaaatcagacgtggagcttataattattgattatttctcttttagttatacaaaataggaacgagagagtaatgaaaagcgtagagctcgagctagagtgggtgtgtagtgatggacgcatgtgagggtgatgtggagtggatttttttttgtaatttttctaattgatttaagtgaaagccaattattagatgttattttccttggatttgtaagatttttttttaaagttgtaacatgtcatggattaagatttttataaaaatagatttgatagttgaaaataatattagtgatacgtggtaacttaatatggctctaaaaggttataaaagttgactttgtactttcctaatttttattatgtagaatgattaacatgacataatacttgttgtcaattttttaatatttcagtgttgtttgcttgttggcctatgttcaaattacgtattttaaattttacatagtaaaatatgagtaatataaatcaacaattcaaataaattaaaaatcggatgttattaggttgtcattgctgacggtagttatagaccaattttgactgtcaatacttttgtagataatggagaactagcaatgcttgcatgcatatttatttagaaataatctagttccacttgtacttgataaagtaagtatttgtttacaagagatcatcacataaatggaggagaaatgattgaaaataaccgtttaaccaatcagaggtcgacatgtggcagatatatggatggatgtgcccagaatctcattgaaacacctacaaatgggcccaaccactatgccactgggccgaggatctgtcaggagacgtctaggacgaaggactggcccagggaggccaaccacggttcggccaaccttgggttccgctgacccatgcctggctccgatcgcccaggcccaagccgaaggcggttacataccgatcttctaatgacggttgtactggtattggcgctccaatcatcatactcaatctataaaaggacctccccaacttcacttcaatacacaccaagaaggaaatcaagtgaagaagctctcttaggctgagttcgggaatgaggtttgggaaccctcactccctggcacggaaaacggagcagcgattagggggtaattaactaagtatttgcttgttttttcaaaaatggattagtatggattagcaaaaaatacaccatttagcagtttgaaaagcgtgcgcgtggaaaacgaggaagggaagttgggaacaggaggtaacgagcgcaaccctagtttacatattttgctctagtgctagtagagttagaattaaatattcttccttagttcttcatgtcttgcagagaagtcgggtatggttctagtagctcttcctctcttgtaagactttattcaataattaaatattgttttttatatagttttggtcctttactatacttgcataattattcgagtaccaacttcggtttatacttgactcgtatttattatgtagctagcttactggagatatgcaatggtattggcttagtgttcatttatttggtaatatttagtaatgtaagcgcggtgattagattattagatatcattaagtggtgctatatgccacgcatacgtaaagataggccgctgatgctgacaactcaatacgtgtattcgttcacgtgcgtagatagggctaagaaaggttccgggtgcgggtacttctccatatctttaaccggttggatagtcatgacggattgtcgtaagaaactcgacaatttggggtggtttctcgatataccagtaggcatagttgtacattagcaagcatatactaaaataactatatattaaaaatatagaaatgatgcttttctttattcttctctagttagcctagacttataatttagtgagagtactctaaactatcccttctatgtgtcattcctctccccttcctactttgtatgactaaaagagaaataatctataattaattataagctccacgtctgatttctaatctaactattgctctgtttataatcaaatcaacgatataagattcatatacctatattttgctatataacaaatacgacatttaacacaatcagcctattacttataagtatctcaaatacaacctatgatacatgcccgcgtgagtgcgcgggctaccttcctagttttcctaaaagctacaactacaatagctcaatcttccctacaagctgaacttctggctctacaattgacaatataagtggcgatatttcttgattttgcaggtaccatatttttaacggacaacgagacgatcgcaaatacaatgaatatgagacattttgaagctgatccagcctattcgaatcttcagcggttactgagttaaattcaagcaaatattccttttagcttattgcaggtgttgtggtcttgtggataacgagagaggtcaatcgcatggctgacaagttagcaaaaaatgcgagagatgaccaatgaaatccagcatttgttttgccacaatatcgccaacctagcttatccaagcagaaggtgatttgctaaggatatgaaagaccatttcagtacgtactctaaattgtatgaaaaccatgtaattaatatgtttgagcaatggaataaagtttgagttctaaaaaaaattgcatccttttcatgttctaatgcatatcatctagaatatgcttaatgcttgggctggaatatatatacacggaatggtcatcgtaggcgggcctggcctgagtaaggtgtaaacatatccgagcccttaaatggccttcctgtgaaaaaccaagtcctcttcataggcagccagttttacagccagcatactatagatgaaaacggagcggataattcatggatagtccggataaagatatttttttatatgaatgtgaatatggtatatcagagttttcgatgaatatgaataatagaaggatatccgatgaacaaaatgctattcagatatccactgaaggcatgagacatatctcatttctttctaactctagaccttcaacttacttctttagaattttaatagtagcccatctcatgatactagcccacactattaatattacttaaatatttaaatatttttttgtaaattttactatattttatattataatttcagttagacatgtatttatatcaactctgatgtacatgttaaacttaattagcattgttgactctatgatcaaacttattatataaaacgatatatttatatatgatagtatttgtttctattagaaattgaagtgtttttcatgttctgagaaatatttatttccctattcgtgtccgatcatattcgatctttattcatattcgagataattcatatttgttttcatatccgagctttcgtattcgttttcctatccgacagaaaatacggaaagaaatattgtataagcattatccatccatatccgctccattttcatcctaagcacatacaggacactcaggagacccgcttgcgaaaaaaaactcaggtggagtgcttaagaacctatttgtgaagatgactttttcgcgggcagcccgtatactctcgggagcctatcgtattaccggcgagccttctcatggccggaaacggatcctctgactttggatggaaagtcacggtcttgcaattcacttcatcccagccaaccactgcatccaacggcacacatccatcttcccctcatttgcctgcatatgttgggagtagctaagaaaatattttacgtagtggtgtatacaaccgtgtaacattgtcatacaagatgtatggatcgatgaatcgtacatgcagacttattaacatgctgccacaagtatagtagtggcatttcgggtcgtcgcatacacatatgataagacatgatacgcatatagctccaaaatataggaaggagctatcttgagatcacacaatttttatcccctttcacgcgcgcgcgctcagttacgcacccagagcatgtcgtcctgtggcaagaagtggcacaccggcacgctcccgggcgccacgccgagcctcttgtacgcctccgccacccccggcgccgcgtcggcgtggcacgccgcgagcgcctccgccctagtcccgtcggcgccggagagcgccaccgtgtacgccgccgccgtggtcgtgtggcacccgaacacggcgtacgcgtaggccatgccgtggcacgccaccatgtcgccgccggacaccggcacgggcctcacggcctccaccctgtacgcctgcctcggcgccggccctgccctgtcgacctccgtggacacggcgtgcacgtcgcgggtgccgaggctggacgcggcgaactccaccatggactcgagcgacgtcgcgcattgcttcgcctcgccggcgagcggcgcggcctcgcactcatggcgtcggcggccggggagccggcggggacggagagctgggagaggatctccgggagcttttcggtggccaacgggacggagtcggcgcggccgcgggggagcagcgcggcgccggcggtggcgcgggtgaagtggagcgtcagcttggagcccgggaagaggtccttctcgaggaagaacacgttgcccaccgtgtcctccttcgaagctgaccccgctgagctcgccgggttgatgaggtcgcggatggcgccgggcatcggcgaggtcgggagcgcgatcttccagtacatctccgctggcgacgcggcatggctgtctcccgcggcggcgacctgcagtgcagtcagaaacaagttgaattgaaaattattaacttgatttcaaaatatacctacttgctagctaacatgcatacatacttatgaaccaaaagttacaacgaaagataagtaaaaaaaaacttatattacgttctcatcagaattcaatgaactccatgttcatgagttcatccatcaaccgttttaactatggggcatatattgttcctgttaatttaaattctagctagagtaatttcaacttaattttcaatctctaactaatatatatatctctcaccagaaggagtaggagagcagcgagtgacctagccatgctaaataacgagctgtcaaggaaacaagtatatgttctaattcactgataagagtgaactgagcacaagcaggccataaattttgggagctatttatagaggaggagtgggaagatgacgaacacgtaatatattgcattggccccactgtggatacggaacgaaatatatacatatcagtcttattatcagatgtagcaatgctgctactcgatatatatatcgcattcatgcgaacatgtcggatgcctctattattgagcagtctgatagcttaacagcaatcattctgtggctggggttacccgtgtccttctcgatattctttgaataatccaacatgcatgtctatttctagtaatttatggattccccaatagagagattttagtttggctcagttctatccatggacgaggccatgagaactttttttttttacaagcggttcaaatagttatgaatgtttttttttcaaaaaattacaaaagtaggttattgtatcgcatgttcattgaaaaacaatcaaattcaatatatgcatggagtaaaaaaaacaaatcaaattgtaaaagtaaccatatatactttccacaatttgatttttttctcgatataggtattgaatatgaacttgtactaaaagacgtaacagtgccgtaggcaacaaatttaatgaatcatagggaacactcgacgaatacaatccctgttggtattaatttgttatggtcacacataaatctgcaagtacatagttaccgatatagcatttcacatcagagtattgtaagtgtattgaatcacaagaagcatatgtgtataatccaagaaataggatttttctaaggacaacaattaaggatttttctaaggacaacaattaaatggtaggcttaggagagataggattcctttgggtaaataatcttagttaagttaaggtaaaactctattagtttttttgagcatcggttcacccctgtttgccaagggactccgacctgtagctctatgatgtacccgaacgtggaggattaagaagaacggacatatttgtcacagctgcctataattccatggagcacacaacaaatgatggtaacctctaacctagatagcacctctacaatattgattacaactcggccaaaaacttccttctttatctagagtcttagtactagagtacttaatataaatactaagcgatgaatccacaatgattagaatatatcttacttaaataactgaagtaaatactaaagaaaatcatgaatacttacttatataaaagaagtatttgtcgaggtacaagataggagagagtgccgacatctctagcaatcctccagtacaccccatggagagaatgtcgacatgcactcctccgaaactcggagggaactccgatattttgggcacttttttcggagctttccctcactatcttcctatattctaactctactgtagagtaggctaaatataaaagtgagttgtactcaactttttggtgttttgagagtggaaacttctccttatgtagcttgggaatcaagcataatcgccattgtggaggcctgaggaagtgacacgtggaagctggcggtgattagtcacactccaggtttgactgaaccttggttcagaggaaccacattcaccgcctttcttcatcattttcgcctcagtcactatcctgtgggtcctcatgacggtgcatactaaattcgcttcaattatgttagtttcatatgattagttagcccatagattggccagaggtgtgtttctcttcgcgtggagggtggttttcatccataattacatgcatacaaatatttcttggtatttcttacgaccacagataaatccgcaagcgcacggaataccgctgtatcacttcaccttcgggtgaccccaaaaggatatcgaactcaaggaacgtgtgtaatccacctaaggataagacaatccaaggacaaggtaggctaggtaggctagagaggactttctatgtgttttaattatctaagctaagcaaaggtaatttcctatatgttgcttcgggcatcgacccctgctggtctaccagcgtggttccggctatagctctatgatgtatccgaacatggaggattactgagacaggattcagggctgtcaccacctgccgcctacctctgacaaatccgtgggatacacaacaaacaaaggtaatctctaacctagacaccacgtctaagttattaattactactctaatacttgtacaggaacttctttctttatctagagtcctagtactagagcacttagtatgaatactaaacaatgaacctgcaaagatggaaatctatcttacttagactaaataattaaataacataagaaaggaatacaaatgcttactttttagaagaagttctccgaacctggagcagagtgtaccgacaactctggtactcctccagaattcctcctaagaagctacactcgtcgaggtagaagtcggatgagcgccaaacttccgggcactcctccagagcttcccctcactctctaccttattctaatgtacaaaagatacaatagagcctgttgtaattcagctcaaagttgtgtctattggaatgtgagtgagctcctccttatataggctccaaataacggttaggggcatgggaattgtctaaaacaccctgcaaccacctctgggaagaaatccgagccgtcccggtgaaagcagatggcgggaagcgccatgattggttcggccgaacccaaaaactctcctcccagcctctccttgggccgggaggttgcttattgggcctctaaccacctgggttatgttttggcccaattctaaatggttttattgacttattgggccactaatccgtgtaaacgcgtcctgaatgcgcagagatgcattttgacatgacggatgtgttttctcctcaaattacctgcatacacatatttcaccaacactagtggaaatgattagttataatacttaccactaagttggataccattaagatgttaccttcgttgtcgcatagcgtgatggctccatgcgatgaagcatcgacgatggtatatggacccatccatttacttcgatgttttccatgtccgataagcttcacccgtgagttgaacagcagcaccttgtccccagcttttaactccttgtgcttgattcatttatcatcccatctttttgttctttccttgtagatcttggcattgtggtaggccttgtccctccattcctctagctcagagagctgcatctttctgtgctgtccggctttctttaagtccatgttccaagtccggatagcccagtgcgccctgtgttccaactgtactggaaggtgaaaagtctttccgtagacaaggtggtatggtgacatgccgatgggcgtcttataagcagtcctatatgcccatgcatcaggtagcttgttcttccatgccttcccaatctcattgacagtcttctgcagaatattcttgatttgtttgttgctcgtttctgcttgtccacttatctggggatgatacgaagtggcaatgttgtgctgagccccaagttcttgcaaaaagtttcaaaaggtcttatcgataaaatgagaccctccgtcacttatcaccatccgtggagttccaaaacgagggaaaataatctcatggaacatccggcgggcatgcttggtgtttgcggccctgcatggcattgcctctacccacttggacacatagtcaacggccaccaggatatactcgcagtcataggactttaggaaaggtcccatgaagtcgatgccccatacatcaaatagctcaacttgaaggttgtatgttagtggcatcgcatctcgagcagtgatccctccatgcttctggcaccttgtgcatctccgaacgaattcctttgtgtcatcatacatctatggccaaaagaatccactccaccagatctttgcgtgtgtcctgaatgctccatagtgacctacatatggggcagcatgacacttctcaatgatctgcatgccttcatctgccggaacgcatctccgtagtaagccatctgaacaaactctgt

SEQ ID NO: 65854 - DNA, 1084 bp, Oryza sativa
gtgtcctagcacttctatgctggcatcacgagggtccactgtttggcgcttaagatttttgaactcaggtgtagcttctgtttctgtggaagatcttaggtgtttatttggcgtcgatactggagttgataggtctagatattgttcaatgtggtccaataatggttgcattcggtggttataacagttatccatggcaataaacaaggttgagagcggttacttagccattgcactggtttatacacatacttactattgcctcgtgcgctcgggtacgcgtctcattgagcacgtatttataggggagaggaggggggtccgggtgtggttactttggcctgcttttgtcgagcacgtgggcaagagagaggagaggggaaaatggagaggagggctggcgggggcttacttcgccggcggtcggggccgaaggtggcggagatcgaggtgcagcggcgagctattccaccggtgcaagtgacgggtggcgctgccgttggcgagggcgctggagcagttgtgcctaagcgttcccgtcgaggggaaaccttcctggcaggggtggccattgttttgcgctgggtgtgctccagtatgcgatttgtcggggcaaccatcttcaccatcttagcttggatggttcgcccgctggtcttgctctggaaatggtggcgagatctgatcgatgatggccactctgattacttatgcgaggcagtttgtctcttcattgtgttggcaccgattgtttttgtttctactcttaaagcgctactggagtagataatttatgaaatggttgccaagtcttggcatgtatcccttatgtatcaacttgcataatctctactttaatgctttctacacatgtgcctgatttgtgttgcctgtgaatgtgggatttctagttttttctcaacattcttaggcgcttttaggtttggcatcctctttattcggcgggataatccattcttactcgataaatgatttaatgttagaagggcacttcggcgtaagggtgattatggacaaccatttctgaaccactaagtcatgggggcaagagattgcattactc

SEQ ID NO: 65855 - DNA, 1641 bp, Oryza sativa
tattcaatcttgaccagatttaaatatttagaattaatgcttgtttagtatatttgctttagattgatattttgtataaggttgtatcggagctatagccaatacattatcttttcttacctaaacggtcttatcggctatgatacaaatacttgtagtttgcaatttattcaatcttggatacaagcagtttataaaatctcggtttagttcaatctatcccaattgcttgaaaatcttgaattatagattacatattgttagtttctgttgctgatggaacatgtgtaaggatctttcatatttatcttttcattccatactttatagccgattcagctcagttgcatcggctcggctaggtcatgacgatacgtcattggcttattggccaattgactatcgtttactagttcaaacatattgttattcttgttggttgcaggattgaaccaactgacatgttctgaatccgaagcgatatttggacctacactggagctaagcagaacttctaggccgctatgttttcgcataaacagactaacacactaccgtgcacaatctagtcacatcctgttttcttcaaaaacaggtagtctcttctcttcctaaatatattctgcgtaccattcaaaggttgacgctaatattataaaataagttcgttgaaggactaaaatgccaaaaactacatcctacagggaggtttggatccatgatcctactctattccctccgtcctaaaaaactcaacttctagagtttaaattttgttccacacaaaaccaacttctatcatcctacttaccctcagcacgtaaaacgagaagttttatcccttcgataccctttacctacctatcacctttactactttttccaatgattaaggacattttaatcattcttcatcttcacaaatcctaccttggaatgctaggaatagtggtaggaatagtttttttttgacagagagagtagcttccatgtatatatcattgatgtgattaatgattagccagccggccacgtcgtcatgcatgcgacctccgattcacttcaattgcttagtggaattgaagtgcaccgaccgaaacgtccaattgacaagaaaataaataaaattcaataaacaacaacgatacttttttgttagaaaaataaaacatcaccaactgctaaaggatacggcaatttattgtcgaccatacaacagtgactaactgcaaccttatttgattataaactctcgtatttctatttttaatgcgacagcaggttactgtagccatcttaaaaaccacatggccgcgttcaaaataaattagatatatatatcactggactcaaattctagccgaaaatccatggctggccggtggaaatagatcaaaccggggtgctatattgttgggtcattcaacactttgtggacctaattgactaactaattgttccggaaaatagctgcaatatatcttaagtctttgttcagtattaacattgataatcatcttctttggtgtaacaacaaatgtgtttatacagagttggttctttaaaatagccgcttgcgtacacttttccctttacaatggtgaccggcgctgtttttttctccaacaaaagttggataaa

SEQ ID NO: 65856 - DNA, 2277 bp, Oryza sativa
gaactgttggaattaatgtgtatgctaaggttcatgtcaatattaatttctaagtaaattacaaggtcccatctcatggaagggaggcatgtgaatatttgttttatggcaataattgcatttagcggcgaatctgattgccattgcgtgatttaaagagttcttcaaagttggcccatacctcagatttggaccgcttgttgctagcacttgagccggacagcgcgtcgttgccattgtcaccggcaccggtatctaggtagaaggttacctttgtttgttggtgtttcacgggttgtagaagcaggcggcaggtggtgccagcctagagctatagggcagagtttccttcgcagaccaggggtacgccagtgtcgaagaaattgatagagttttaccataacttcattaagataactaacccatgggagtcctctctatcctatacctaccatttagttgttttccttggaagaatcttgttcttagattatacacacacgttccatgtgaatacgataccttggaatacccttgggtgaaggttacaacggtatctgtgcgtttgcagactattatgtggtcagaataaataccaacaacaacccatagggggccactctcggagggtaggtgacaaatgtgccctgagcatagcccttgggggttgcaccctgctgatgtgaaattcttcgtgacacacgaaggccttggaaatatgcttatctccagtgtagggcataacaattaatttgatcctgcaactagcaagatagatagatagatagatagatagatcgtataagatcaaggagtcaatcgaccaataaactgatatgatgttgcgaggccaaccaatgtcaatagggttttgaataatcggctataggtctaatgtaaattcagataatcagataagcaatgagatttgtgttatcaccagctggaactaaactatgttatcatcggctggaactaaacaaccgttctttatcaaaagcaatcttgatagatcagaccaaactgagacaatataagatagaagttgataaatatagatttaactaaagattatacaagtttgagtgtaagccgatgtaactcagaagatgcaatgagataatataatgtgaacaaatcgtctaaaactaatataatgtggtagatgtacatctgatggttaaaacatacattggctggagatctaatgtaagtaaattaaagtgtatatcggctaactaactgatacatctgatagttgaagcccaaaataatgataacatcgggtagcgctccaatgaacgctgcataaaaaccttaccggcttacaagaattagacaaaatagcaaagatctaagagattgggcctgacagagaccagtataagagctaaagataagtgaagaaaaacctacttagccgatagatctatacaaacgtgatggatataatagagatgctatctagaagtaatagtacaattagagaactaccaacttagctagaatatgcagacccaactaagaaagtcctaactaagattatacaagctctaaacagtaatgcaattgaagatagaatcaatatatcaaataggcaatgcttgcatcaacctagatagaatattagacttaatcgagaaagttctcgccaggctgatacaagcaaagttgatggaacttccttgccggagatcgaacttaaccaatgcagccatgctcgaaactaataactcgctgggataaaagggtggcgatgcgtcgaaagtaattgcatcggtctatggagatagattacgaagaccctgggtgtacatatttataatctcgggctgatatgagtcccaatcggacatgactcacaattcctaaagataatacacaagtcttaatcagacactaatcaaactttcctaaagataaaaaggaaaaatactaaaccatgtataattaatagataaattaagctaccatgtcgtggtcttgacgattctttcttgaactcggtttcttctagataagctttccatcggttgattatgttctttccctaaccaaatccaataaagaattttatcaaattttggcattaacacactgtgggcggatatgccccgagcatagccggggaaccacattcgtgagcaggcggcaggtacgcccaagtatctgatatggagaccctggttcccatttatctgacaccataaaatatgatttgagattatttggaaattttttataacacatgttagctccatgtgtcgtgtatttagc

SEQ ID NO: 65857 - DNA, 1057 bp, Oryza sativa
atatgtataggtgtttccactaatttcattgtggcctagatcacagattaattatgccctttgtgtggacttgattatatttcttttctggaaggagaacacacgtacacatgatggacctaacttcacatcatcgatctcatcttttcttctttattataaagggcactaaattgcatataaagtctcacttcgcctaaccaggtttgacgactaataactgaagtaccatcagtttaagtactcgatcgatcgcccaggtctaactttaaattttaattaaataattaatgggatgtctaggtgacggccggaattctccaattagtctcgtcatacttcttttcgatccaatatattactggaagagccaggagggagatggaaccaaacatgtctagctaaaatgtaacccaacggataaggaggttcagacctatttggaagagcatagaattgctatttggtagctagttaagaatctgaaaaactgagttttccagatcctggctgctaatttatcttatggattctgtagctacatatttcaaaaagttgggtgtgaatatggacttttgatagaagagttcaagattttagtagcgcaaatcacttatgtagtgaaatctgtaaactaccgctagatttaaaaataaacatctaatatttatccgtgctgccaagagtactcttgaataaatctcggggttcccaactccccctctcgttttccgcgcgcatgcttttggaactgctaaacagtacaatttttgtaaaaagtttctatacgaaagttgctttaaaaaatcatattaaaacatttttgaaaaaaatagctaatacttaattaatgacgcgctaatggatcgttctgttttccgtgcgggaggaattagttcccatcctcctgaaacgaacacaaccttagcctctcagacaacaacccaatttgaaattcgctcatataaagatttgaactgagaattttagggtggctgtaaccgctgctacatgtatatatacgaagaggactagcctgttcaacagccatgccacc

SEQ ID NO: 65858 - DNA, 19762 bp, Oryza sativa
ccgatctgcatccacccgccgagcagagaccagcgccgccgccgtcgccgtccgttcctcctgtatcgcgtcctggtgagcatccgcccctcgttacgcacatttttttattcgaatttttttttcaagaatgaatttctgtgcgttaaccctagatagtacgtagcttccgttgtagatctggatctggaaagcttttctcttgatttgttcgtaatgtgatactaatagcagtttctttgcttgtttgtttgtttccctaaagaaatttcttttttctgggatgtccgacgttggagacgcccctgtgcagcgccgctcttgttcgaatccggccggtggtctgtaggattgggcggctgcggcggcggcgagatggacgacgacgccagcatgagcataagatgggggggattcttcgagtcgccggcgaggaacctcggcctgcagctcatgtcgtcggtgcctgctgagcgtgacaccaagcagctgctctctggtagccccttcctgcatcatcagcatcagcagcatgtcccgcaccaccaccatcagccccatcacccgcgtgactgcggcgccaatggcaatgccaatggtggtgctatgcctcctcctcctgccacggaggctcccccttcaatgccgatgaacttcgcgcgcagtgacatgtggatgcacccgcaacagcagcagcaacatcatcatccccgcgagcacaaggctcttcacaatctcactgttggccatggttcttcgcacattgcgcatcatgacccagtgggctatgggatgatccccggtacgcataccctgcagatgatgcagcagcaaacagagcctcaactgcaacccccaccaccgcctcagcagccaaaagaggaatgcatttcctcgccattgatcgaggaaaatgtacctgttattgatgagccaccacctcccaagaagcggcagcagggccgccaacccaaggtaccaagggctaagaagcccaagaagtctgctgctcctcgtgaggatggcgcaccacccaatgcaccagcaccacggagaaggggtcccaggaagaatatagggatggtaattaatggtattgatttggacctctcaaggataccaacgcccatttgttcttgcacgggcgcaccacagcagtgctatcggtggggtgcaggtggttggcaatctgcgtgctgcacaaccaccatctcaacgtacccactgccaatgagtacgaagcgccgtggtgcacgaatcgcaggcaggaagatgagccatggtgcgttcaagaaagtacttgagaagcttgctggtgaaggttataatcttaataatccgattgacctgaagaccttctgggcgaagcatggaacaaacaagtttgttaccataaggtaaaagacaatgaaattctaaaatttgttggctttgtaggttgctctgcagctgtttggtctgagtaattgtctgtatgtactctagattacaaactgcagaatccttttaggtgtaggttttaggcatgtcctgtccctttgcagtagtttacatgcctcatctgtgacctgggtgctgacctgtatggtggctatctgcatgtatctttgtcattatctttacaagtagcagtgtaatgcgacaatctctaatttaggtggcatgaaagttaatctgttcaacgtttctcattatgcttaagtcttctgttatacaatgctccattgcaatgcctggatgttttacagaatacaatatagttgctatctcatgaagtagaaacgttatctttttcatgctgtgttctgtatgcatgcaaagtttatatagcctatatatacatgtcttttcttttattgaactgatgtttgcatgcatgatgaatgtgggcaaaggttctgtacctaatctggattacttaaccagttctaataatatctttactgtgagcaaggttcttgccaatttcatttgatgtgctcaaatctctgtcagactctattccgaagtcccttggtatcaagaatttttagagtaaatgctgaggaatgtcttttgccacttgtctaatgtaacatgcctttagttctgccttatacgtagatggaactctgggaccattgatgtcatctttgctatttagtgattaccctttaagtccatgtgttattatttgcacttctttaggaggcaattattggctagtaatctaagtcctatgtttcaaactcagcactttgtttaatcaactttgtgcaaacagtaaacagcagtcaaaatattgcaattacattctattattttttgatttgatgatcttttttgggataaagaaaattacctgtatagtttgaacatattctgctctattatgctgcaagatatcaagctatctgcataaatcttgtcatcctgaaccttcaaaaaatacagtaatatttcacatgttatgcattcaaaatgttgatcctgtctactagggcaatttaactctgtcaaggctaattgcattataaggtatgcatgttctctattttttctatttgtagattacagagaaagtggtgccatttgtaataaatgatgttatgattcagcaattttcttttttataataaagtactataataattagaatgctgatatgagaatgaacgatgatgattaatgagcatcagaattatatgaaatgttagataattaattatcacaaaagctattttctttccaacttcatatatgctgaaatgtgggttgctgctagtttcgtgttgcctaaactgcagtgttacatgagaatattgaatgtttgcacatatgttttagaggccttgagtgccacaaacgatggacagcacctttttgtaaaatgtaaatacccagtaaaattattgtgcaaaatatttggtagtctatgaagccattaggaaaataatgtaattctgagcaaatagaagctaatactgccaatactagagctattgtgatagatatagttcactgatatgatatgtgtgaaacgttataacttgagctattgcgaattgcgatagcagagtgtgctatttatcagcatcatcatcgtacatctgggaatgttgtgttaggtgatctgtacatgtactctagttccatacatgctagctactgctgtttttcttgatctgttctgttggtgtgcatgcgccagaccgatgtatgtagatctattatctgcatttgttgatcgttgtacatgtttttttattttttgaaagaaaagtatgctatgtttagcttgctgagatgcaaatgcaatgcatcatcaggctgagatgtagctgcaaatagttcactgtgatgtttctcattgcttccacagttaccatggaagcagcagtattcccatcataattgccatggaattttgtgtatatgatgtgatatggttttcactactgttcatacttgatgtgttctaaacaatgagagtgtgacactacgtatcttgaagctacaaaatgaataattacccttttattccatctatatatgattgttcttccatttggtcatttcattgtctcgtgtggtcttcacatggcttcattgttacttatgctgagatatatcgaatcctggtcatcattcatccattctgatgcattttgcactagttagcctgcctccctgagcagtttacatcgaatgcgtattgttttgttgtacaaaagattattatttattagtattgtatagaagaaataaacaaaagcagctctaatcaggtgaactatagctgcggctaaaactgggcaagtttttgcattttaacttatggaaaatcttgtttgtgcaactctccaaggaccaaagggatctgtattggccatgtttcagcacacggcaatgaggttcagacttcagaagtccaaactgatttgtgtcttcccttcccaccatgtactatactgattgctatcttgcaacttgaaactcatcattgaccaacagtttcatcgatcagagcctattaacatgcagagatataatatctaatagcatttgtgttcaagttggctcacatcttaagctatacttatatttctagagcataaacagtaataaattcataagatgaagaatggattgtatttaatacgtatcaaatatcgcattgaagtaactcgttaggctctggtcctacacatctaaagccatactactccattaaaaaaaaggaaaaaaaagataaaacattacttttagggatgaatttgaacgaatttggacttctggggacttgtcaaatttaatttatccctcgaagttgattttttttttcttttggacagagggtgtactgtagaatctaggcagcattatgcagttgcacatctggagttgcaattgtaacttttcaagatccaaattatagtactttcagtaaaacggaatgaaaaacatgcgcatataatgattttttaggctcaaatcatgactatacttaccttaatatgcatcacatcattcaaccttattagtaataatgtggtgtcatgtggatctccattctccaacttctaaaaagaagctggaactggtaacaacttccagagatggccaaactaattagcatgttggttctttattaggcactttttttttggcagaggtaatagtaagtaggatatgattatcttgcaagttaataatattaaactcttagtaagatacacagtgatatagagctcagaagacagtgaaatgagctttctctttcgttgttaattgaactgaattatcccaagttactttcatcaatttaacgaattgacaggtgattactgatcatgacatccactgatagcctgctactcatgagaacaatttactactggattttaagtttttgcttataacgtttgaccactcgtcttattcaaaattttttgaaattattaattattttatttgtgacttactttattatctacaatactttaagcacaacttttcgttttttatatttgcaaaaaaaaattgaataagacgagtggtcaaacgttacaagcaaaaactgaaaatcccttatactgtgggacggaggaagtatatatgttaggtcaaagaatgctgcttcgaggtgctgtaataaaggttaattttgttccttttgagatgccaattaagctagccaaaaagaggcgattgcaaactggtaggaacaaactatatgagaaaggttactttctaaaggaaattatgataatgttgtttgaccaaagctagcaaaggtaaagcaaatgcttccttttcgctttcggtaatagcagtaacatgtcgatcaatcaagagaccaaatattgtaattaattaacaaatggtaaacaaaagtgctcctcacaaatggcattttaccgaaactgattggattatgtattttaccgaaactgattggattaacaacttggatccatacaagtcaattgcctcacctgcagagctcaaatattcctaggtaatttgagtgatcatcttttacaattcagcttaatttttttcaggcatgcctcaaaatgagattcatgtggaaatcatgcacaaaattatggaagtttcattaaaattcatgtaaaatttctctcttccaaacttgaatgttccagagttcctagcagatgagaatatgtagtctcctacgcctatcagtctataaatcgagaaagcatggagactgagtagtagtaaaaggcaatgcgtgcacatggcaggatgaaatcaaaggtgctttgcaatcgcaaaggttataatagcagcagtaaactagtcatcaaagtaattaaagggaggcatcttagcttgtggatgtgatgcatcaagcatgcgggcagagacgccatcatgaatgtaattccctttgatctaatatttactattttttcctaaaaaattctcaacattttggtttcagtttcagattcaactctgaagatttttgttctgtgagaaacaacagattccatatatgaaggtataagatatatactggtattgcaaacaaataattaaccatattctctgcaggtaaaagattttaatttgtgtcaagaaatataaggtagtatttacccgcataatttggagatatatgcaacttcaatagcaacgcacaagttgtacatctaggattttggtacatatctccataacaattccactccagttaggaaattgtttttgcctcaacaaaaagaagaggaaattgttgcacactcctaaattatttttagttagtttctctcttttttatttctcattaaagtttttgagacttgccatcagttatgaacaacacctatcttctttttagttttttaattgaatatcacacatgcctgcatggatctcatcagaaacatagccacgtttgtagtgtactgtttagatgctccatactgatatgatgattagatatgtttcttccacaacatcaatcccgacatccaaatcgtcagaagttagcaatgttgcatttgttaattggatttgccaacactaatgcttgtgggggtaattatgattacacgtgcggcgccaaagcataaaagtgactttgagcactcaaaggggacatgaccacccttgttaatttacttgtattttaccaccattagtgggatgtatgacatgcataatatgacgtacacatgcaagttaatgttaattatttgagcaaattaagtatactatgtacataaacatcacattcaccatgtctaggtctagtatctattgatgcatcgtcggtacccaatgtgctcaatgatacatgtcacataggaccatgagatgtttaatgatgttgacctgccaagtttttgtacaattttttcccctaaatgctttccatatttctgtactgagaattctaaaattgatatatataggacgccagacctttttctctgaatagtgtgtgataatctggaaatttattttttttacggggaatctggaaatttatttaatatgcacgcgtaatggtgtgcgtgcattttctacaaaaataatagcaccttaattattagaattctagttattgagttcacaaccatgaaatcaaataattactttattgaagattaatagataaattatgcttaacaatcttaaataatagaattttgttaattggaatgccattggactacatgaatctaacctaattgacccaaagaaaaaaaaaagaagggaacacattgaagttaagaacatcattagtaaacgagattgggatgaggccgtgtgaaatgatctccataattaaaaccacttaaggatatatctttagcacggattattcatgatatccaacgtgcgaattatgtacttcatccaaccttgatctacaccctaccaattaagaattaataagaacaagaacaccaacttgatgcgggtagaatattggtgccatatgctgttatgcgcagcatcagtacactcctagagaagttaatttccagagtaaaaagaagaattaatttgataaaataccactcatttatagatgaatatatatataaggccttgcctaccatacatttcctttatatatagtttgctaattagttcatagaggattacataactctttacatatgaaactgaatatatactcgcataaatattatcatattcaattttgtttctccatcactaaaaaaacataacagacaaaaaaacatgatcttatcacatataaagtgcaataataatgaagatagaaattattaaatcacaagggccctaataggaagcagagtaaagaggggagcattatcatctctaatgccaataggaatttttttaaagaagttgatgtgatgtccctcccctggtagccctcctgtctgtgatggaccactgaattttctccccttaactttctgagtgcatgcagcacaattctgcctttcccatgcacacacatgatttcccattgatccctaagcaaagcaaccttgatatgcacacaaaaatatatatttgcaggaactttaaaaatccctttttctaacatcacatctggtgacaagtaatataatgcagatctccccactcaaccagagacacaatcactgatgttactcgttaaacattattctgcacaaatagatatgtgtctgaactctgttaaaggttttccatatcgtatcaacataaaaatgcttatgtgtcggttaaattttttttagagtatattaaatcaaatataatttttggctctgaaattgggactgtacattgatcgatgtaccgctcgcggtctgcttttggttctccaaggacgctttcaccctggttagggtgtggccgtgtgtttagttgtttgggcataaagttttcgaagtatacagacgcatatttgaagtattgaacgtagactaataataaaacaaattacatattccgtctgtaaactgcgagacgaatttattaagcctaattaatccgtcattagcaaatatttaatgtcgcatcacattgtcaaattatggtgtaattagcctcaaaagattcgtctcgcaatttatatgtaaattgtgcaattggttttttcccacatttaatgtcccatgtatatgtccaaacatttgatgtgacgtttttgaccaaatttttttatctaaacaatgccttaataaattgacattaagttcctccttactgtcccacacatgtttttttattttgtacatgagattttctcagctatttactcgatgatatgaatccagaggtttctcaaagaaaaagaaaatccgagtcagattttatgcatcctctgtgcacttgtctctgcttataggaaaaagtacgaattacccccctcccgaactatcacgatcgtccgaattatatttaataaaacaatgaatgatctctaccaaccaaacaatatctcctaggctagtatgtgtttttcgcgttaccagtggcgcacacgtggtaatctagtcagcattttatttaataaaacaaatgtggggcccacctatcatactcttcttcctctctctttctattctctctcgctcttttctctctcacgcagcgcgcacggcaaggacgggcggtgggagtgggcggttggcgaggatggcacggggataggcggtcggcaaggatggcgtagacggtagcgcggacggtgcggacgtcggcgtggaggcggagacgacggaggagcgtggcggcaaagctagctaggtggaggactccgactccagtgactcgttgatgctattggtgaggtaaggacggcggcgagtagggggcggagccagttgtgggtggcggagggggcccgaggacgatggcggctggcgacggaggcggaggctgaccgggcacgcggggacgcgcggtgggcgatgggctcgtcctcctcgtcgtgggcgcgtggggacgcgcggtgggcggcggcctcctcctcagctgtggcgcacggggacacgcggtgggacaccgccgctactgcgggctcctcctcctcgtcgtgggcatgtggttgccgatggcgcgcagggactgcggtgggcggcgggctcctcctcctcgtcgtggacatgcggtgggacaccactgccaccgcggctcctctttcgagccatcgagccgcgtctcgtcctacctccccgcgcctcgctccccgtccgtctcacgcctctcctcgtccgccggcgatgcgccggcgccggcgcagagaaccgggcccaagggcgggaggaagagcgtgccgccacgctcgcctcacctcgctctgccgccatgctcctcccccgccgccgctgccccgtgatagagagagagaggaagaatgagacacagatagagaggaaaagtgagagagaggaagagtggaagagtatgacacgtgggtcccacatttttttaataaatagaatgttgactggactagcacgtgtacgccacgtagaccaaaatcaccgcggattgagtaggggggtaattcgtccggtttgcatagttggggtgaagaatgtccggttttatggtttagggggtaattcggatgaccgcgatagttcgggccgggggagggggtaattcgtacttttcccctgcttatatgatcattgtatgaaggcaaggaaacccctgatggctactttggcgcttaggaatttcactgaaaacaattcattttccacataaactgaataaaaaaactttttttcgaggaggcgagcaggagttctgccgtttcatattaggagaaaagacttaaaaaaaaacttttgtacaggagtagcaaatacagtaaagaagaaaaaaaggcaacttcaggctaaaattttggcaaactacatttgggccagctcttcttcctttgatttgaaaagtaatccaaaggaatgtttcctggaccaaaatcccctataaaacccacctacactgatagttgtccaaggcagtatcaatccaactcacaaacacaaaagtgtaccaaagcacccttaactggtgatgttttataaacaccacttcaaaaaaaaaaagaagagaaaaagccatctttatctctcaaaagcagaggattacacaccataagccataatctttctttgtaaaccactgatcatcatcaagagtgaccaacacaacacttgctctcactcaccctctgtcactcttttcttctccatccatccatcctcattgtcccaacattgcatccacatgccaaatggacattctcatcccacttctcctctcctcgatctacgtgtcgtcgtcggcggcggcggcggaaaccgatgcggcggcgctcctccgcttcaaggcgttcgtccacaaggatcctagaggagtcctctcgtcgtgggtggatcctggtccatgtcgctggcgtggcgtgacgtgcaacggcgacggcagggtgacggagctcgacctcgccgccggcggcctcgccgggcgcgccgagcttgccgccctctctggtctcgacacgttgtgcaggttgaacctctccggcaatggcgagctgcacgttgatgccggtgacctggttaagctcccgcgcgcgctgctgcagctcgacctctccgatggcggcctcgccggccggcttcccgacggctttctggcgtgttaccccaacctcaccgatgtcagcctcgcgaggaacaacctcaccggcgagcttcccgggatgctcctggcgagcaatatccggtcgttcgacgtgtccggcaacaacatgtccggcgacatctccggcgtgtcgctccccgcgacgctggccgtcctcgacctgtccggcaaccgcttcaccggcgccatcccgccgtcgctgtccggctgcgcgggcctcacgacgctcaacctgtcgtacaacggcctcgccggcgcgataccggagggaatcggcgccatcgccgggctcgaagtgctcgacgtgtcgtggaaccacctcaccggcgccatcccgcccggcctcgggaggaacgcgtgcgcgtcgctgcgtgtcctccgcgtctcgagtaacaacatctccggctccatcccggagtcgctgtcgtcgtgccacgcgctccggctgctcgacgtcgccaacaacaacgtctccggcgggatccctgccgccgtgctcggcaacctcacggcggtcgagagcctcctcctcagcaacaacttcatctccggctctctcccggataccatcgcccactgcaagaacctccgcgtcgccgacctgagcagcaacaagatctccggcgcgctcccggccgagctctgctcgcccggcgcggcgctggaggagctccggctgccggacaacctcgtcgccggcacgatcccgccgggcttgtccaactgctcgcggctgcgggtgatcgacttcagcatcaactacctgcgcggcccgatcccgccggagctcggccggctccgcgccctggagaagctggtgatgtggttcaatggcctcgacggccggattccggcggatctcgggcaatgccggaatctccggacgctgatcctgaacaacaacttcatcggcggcgacatccccgtcgagctcttcaactgcaccggcctcgagtgggtgtcgctgacgagcaaccagatcaccggcaccatccggccggagttcgggcggctgtcccgcctcgccgtgctgcagctggcgaacaacagcctcgccggcgagatccccagggagctcggcaactgcagcagcctcatgtggttggacctcaacagcaaccgcctcaccggcgagatccctcgccgcctcggccgccagctcggctccacgccgctcagcggcatcctgtccgggaacacgctggcgttcgtccgcaacgtcggcaactcgtgcaagggagttgggggattgctggagttcgccggaatccggccggagcggctgctgcaggtgcccaccctcaagagctgcgacttcacgcggctctactccggcgccgccgtgagcgggtggacgcggtaccagacgctggagtacctcgacctctcgtacaacagcctcgacggcgagatccccgaggagttgggcgacatggtcgtgctccaggtgctcgacctggcgcggaacaacctcaccggcgagatcccggcgtcgctcggccgcctccgcaacctcggcgtgttcgacgtgtcgcgcaaccggctgcagggcggcatcccggactccttctccaacctctccttcctcgtccagatcgacatctccgacaacaacctctccggcgagatcccgcagcggggccagctcagcacgctgccggcgagccagtacgccggcaacccggggctgtgcggcatgccgctggagccctgcggcgaccgcctcccgacggcgaccatgtccgggctcgccgccgcggcgtcgacggatccgcccccacggcgcgccgtggcgacgtgggccaacggcgtgatcctcgccgtgctggtgtcggccgggctggcgtgcgcggcggcgatatgggcggtggcggcgcgggcgcggcggcgtgaggtgcgctcggcgatgatgctgagcagcctccaggacgggacgcggacggcgacgacatggaagctcgggaaggcggagaaggaggcgctgagcatcaacgtggcgacgttccagcggcagctccggaagctgaccttcacgcagctgatcgaggccaccaatggcttctccaccgccagcctgatcggctccggcgggttcggcgaggtgttcaaggcgacgctcaaggacgggtcgtgcgtggcgatcaagaagctgatccacctgagctaccagggcgaccgcgagttcatggcggagatggagacgctgggcaagatcaagcacaagaacctcgtccccctcctcggctactgcaagatcggcgaggagcggctgctggtgtacgagttcatgagccacggcagcctggaggacacgctgcacggcgacggcggcagatcggcatcaccggcgatgtcgtgggagcagcggaagaaggtggcgcgcggcgcggcgaggggcctgtgcttcctccactacaactgcatcccccacatcatccaccgcgacatgaagtccagcaacgtgctcctcgacggcgacatggaggcgcgcgtcgccgacttcggcatggcccgcctcatcagcgcgctggacacgcacctgagcgtcagcacgctcgccgggacgccgggctacgtgccgccggagtactaccagagcttccggtgcacggtgaagggggacgtctactccttcggcgtcgtcctcctcgagctgctcaccggccgccgccccaccgacaaggacgacttcggggacaccaacctcgtgggctgggtcaagatgaaggtcggggacggcgccgggaaggaggtgctcgacccggagctcgtcgtcgagggcgccgacgccgacgagatggccaggttcatggacatggcgctgcagtgcgtcgacgacttcccctcaaagcgcccaaacatgctgcaggtggtcgccatgctcagggagctcgacgcgccgccgccggcaactgccatataaattcatttctgcagagagcttgtgattaatcgaccatctctgatgatcacaaacgaacacataaaaagacgcaaatgttgcatccagacatgcatgttccttgttgttggctgtttaatcttgatgcgatttattcatttgtgagctctagaatttccaagttatgactaaattttgaataaatttaggctggaaaaattcaaactggatttgaatacgtttaggaacaaaaaactggtagatttgcatttgaaaaaaatgagagtacattctagtctttcagctgttacacaatatatataagcaagacaactcagtggtatattggaccaataacacaattcattgctcttgagcagcccattaacaggtttttagttgtggcccagtaatctcgccatcccaaaactcatcagtggttttgtatgggccagattcgtggacatagaaatcacggtttcccctgaattccgggagggcgcttatctcctggcgatcagcatcggtgagctcccaatcaaaaatttcgaggttctctctcattcttctctcattgaagctcttgacgattatgcaatcgccttgctcatgcagccacctcaggcatacctgcaatttcggtgaaacttatatacatattggaattattcctaaaaactttgccatagatagcatggtgttcaataccacagatattgatgaattttttgtcgactataaattatctttacatcactgaaaatttagtttatcataactgatccaaaattaagacgtattgtagcattatatatgtacctgggcaaccgttttgcccttctgtacggcgatatgtttgagaacagggcagtccaagacggcattgctgccccatatagtgccacttgctcctaaaggagagtaggcacagagctggatttctttctccttacaaaactcccttagtttgttctgccggcaataggggtttatctcaacctgcatatatattgtagtcatgcatgcaatcccaacgacaattaataatacaatatatgttccaaaatatgtatgatgggacaaaatataggatgataatgtattgtacagtaatacctgatttgctgcaggagggatggttgcaaatgagagcagggtgttaagcttcttgcaggtgaaattgctgacaccaatggctttggtgagacctagcctctggcactcctccatgtccttccaaactccctccatgtccatcatcacaaagtcattgtcgtacaccggcgaaggcgtttcttgttccactctcagtcttattggccagtgaatcaggtataggtcgatgtaaaccatctgcaggttcctgcagtagtacatgaagactcacgcaaaacaaacaaaataatggtaattttatcatcttcaagaaagtaccaaaaatgctatattttctattttaaaaacatgacacaattatgtactagttaccttagatgtatcaatcattttagtgtaaaattgattaattttttgagaggaacctggacgagtctacgggtcgggctcccgatcggtttggagaaaaatcggggctgaagcgtccgatttacgtgcaaaactattttaaactaatttttctcttaaattacttatccaaattatgatccgattgcactattaaattcgttgcaattaaattttcaaaacaagaccacacatggatatattccgatgaaaaaagttagcttattattgaattatttttaaatgttgcacgatgttccatcaagtatatcggaattgtttcactaagtagatcgaaaatgtttcattcatttaaatcgggtgttgtttcaccttatataaaaacaatgtttcagcaaatagcgaaagaatgttttagttcggtgcaacatttgatccatacatagtgaaacattataagtacactaggtgaaacatttttcggtggaacaaaaaaataaaacgaattacgttaatagggggtttccaaaatatgtgggttttttcattgcaatggaatatttcacttcactgcaatattaaatctatagatagtgaaacatttttagtggaacaaaaaaataaaccaaattcttttaatagagggtttccaaaatatgtgggtgatttgttgcaggtggaggcagggattgtggtgggggcccaggtggcatgcatgcgcgcggggcagggggcgggggagcgcctgatttttttctccccccaccggtcgactgatctctatcattatcggagcaacgtagctaaaatttctcactaaattaataaacatacaagtgattgtttagaggttggtttgtgaatgatgctgacgtaccggagcgtcctcctgagcgccggcaagacacggccggggtgggtgtcggagatccagagcttagaggtgatgtagaggtcgtcccgggacgcgaccatgccggcgcgcacggcctccaacacggcctcccccaggggtgcctcggtgccgtacgccgccgccgtgtcgaagtggcggtagccggcgtcgatcgctcgcaggacggcgtccctgacggtggccggcagctggggcgcgtccaacgggaacgacgcggtgcccatgccgacgagcggcatcggcttgccggacctcagcgccgcctctggtatcgtcgccgccgccgccgccgatgctcccacaccaccaccagccatgaacgatagatggctagcttagctgtcgtacctgatcgagtgaggtaaaaagatcttagagaaagagagggagtggtgcatgtgtcagtttcatcttcgtcagttcagcgaatttagtagtagcatacatgcatcgcgacaggtatatgattgggagctggccggagacaagataacacaatgtgattgcggttgcgactgcgacacaaaactgtcactacttgtattttcacacacagaaacagacgtaatgtatgcatcacggaaatttatagcatcttggacaaattttccttcttcagcagtgaaatattaggttgtaagttgcgcgctgccggccggtaatctcgatcgccatcccaaaacttgtcagcggtaaaatgttctatagttaaacatgatatacatatgcatattgatatgttgttcactactacgctctctccggttttcaatgtttggcgccatggaattttaggcagacttttgattatttgtattattcaagttttgtttttaaatatgtaaaagtataaaccctacttttcatcaaagatatattcgagaagcttgaacgaagatagctgaactattgtttcaggggcgcgcgggacacgaccagaaggctgggttgagtggcgaacgtgtcccactgccagctgtgggcaagcgttcactaccataaatgaaacatgtttatgggggaaaaccccaaccagcctgaggtcaaaaagacgctaacgctgagtcattaggagcaacaggcgtctggatatgtgtcgcgcctgcccagtgacacccgacttatccaactgagaagaaaaatagccgtggcactatcttggataggttgaggatcgccaggcccaccatatgccgcgtggtgggcaggatggaaacccacctgggccagatcaatgcccagggagcccggggcaacttaatcatatacttttggttggtttctcgggaagattagaagggaaccaactgacagcgacaagacagctgagtgacaacacgaaggaagagcagaaaaatggcactgtgagcccctcggggacgtgctatataaaaagggatgcttgttccttagtttgaaaaaggtctagtttataatttccagatccagatagtgacaaaaaaaacaggagtaggggtattacacctttaggtggcctgaacctgtataactgcttgtgttcatttgtcttgtggggagctggaccctatcttggagatcttttccacgtcgtgcacaactaaccccctggacgagttttcactcaaggaaagatctgcacttcctcgctgctggagaatcgctcctccaacacttcccctttctagcgattagaaatttgttacctacttgagttcttgctaagtattactccctccatattttaatgtatgacgccgttgacttttcgaacaacgtttgaccattcgttttattcaaattttttgtgcaaatataaaaatatttatatcatacttaaaaaacatttgatgacaaatcaagtcacaataaaataaatgataattacataattttttgaataagacgaatggtcaaacgttagacaaaaagtcaacggcgtcatacattaaaatacggaggtagtattacttataaggtggtttaattgagtgttctaacatgtagcccttatagatataccatattatcaaattatacatgtttcaagtcgacgcgacttaaataatgttagataggtacttgagttgagagaaggtttagtcataaaaaaaagggtttgttggaaccatgccaccctaattttgcgaaatttgagatatgccacccgtatctcaatgacatgtaggaaccacatgagtcaatgacatatgggtcagggtggcatatcacaaattttgcaaaatttgtgtggcatggttcaaattttccctaaaaattatatgtgctgggattcccttattgccttctattgatggtatctctaatcaacaaaatacaaatatcggctatgggctcttttagtgaagcattggatgttgggcaacctcatgcaactcagcgctagtcatacttactacaaccctatgaaccatgcaacaggtcacacaaccacacctgacatctcaaatgattttctattagacaacgcttggatggatgtttttttattaaactaggtgaaaccccgcgcgttgctgcgggagtttatcatgagaacaataagtaaaaaaacgtgtaaaatagcttaaacaacataagcttatataaacataagttttcataaattgatgagatttaaattgaaatagtatgtagaataatgatttagatgtaaaagtaagatgatgtggctttatgaggcggttggacagaggcggcctgcacccctcggcggcgggagacgacgggaggtaggcggcaggagacgacgggaggtaggcagcccgcatccctcagttgcggcaggcagcgtgcggtggtgggaggtggtgcgacggaggcggcccgcgccggatcaggaggtgtggcgcggcgaagacagcaggcatggaggtggggccgccagcaggaggtgcgacggcgtcgaacaacggccggcgatccatctttgcaaacgaacaaataacccccccccccagctcaatccgctgtggttttgatcctacatggtagtccagtcaacaattcattgttaaaaaaataggtgggccccacctatcagtttctctatctgtcttgtgtctctttcccaatctcttactctcttctccattggagctgcatcaagaagggcgacggcagaggcagtgacgaggcgtggggagcacggcggcggaggaggcgaggcgaggcgtcggcgtcagcgagacgagcgtggcggcggcgaggcagggcggtgtgggggcgggcgcgagcggcgacggcaggcgcggctgggtggcgattggcagcgcgaggccaggcggctacgc

SEQ ID NO: 65859 - DNA, 6615 bp, Oryza sativa
  unsure (1)..(6615): unsure at all n locations
tatatcatgctattgtaaatgatctactattatctctcctgctcactttcttatccatattttctagccagcagctcagtacataaacaatataaaatgctatattaactatctatgatatactaatagtccattaaactccttacaaacactctcaatctgtcatatagtgttctacaaacactcctaagacgtcatgtggcgctcaaataaactagaatatcctagaaattatgataaaaaattaaaactattgattttcctttaaataggtgaacccaataattgtaactactacatctcacagaaataaatccggtacccccatctcaacccctaccatatgtgtgcacgcatgcacgtacgtacctactccttccaccatcctactcacctctaggatccaactctcatcttctattttctagctaacacataattaatgtataaaaaataataatagctaaatacatgtacttttctcagtttatttgatttggtgggttatttataattaaatacataatctgagatccatattacccatatttactatatagaagttagataatgcggctgctctaactacaaatatttgagcaaaatagcagtttgaaaacaatcaacgaattcaaatatgagtctaaagtccaagttcaatcaccaccaagaagcctggaaccataatgcatactttgggcctgaatccgaggaaggcggagctacaatgaggtggacactgatgacagcagcagcatcgacttcctcaagttcctgagccaaataacgcgctagataattatgtgcagggcaaggactaacaggaggggcagagagagatgttccatgtcttcgacaaggactagaaaacaacttcatctttgccaccgagcctcgccacgttatgtccaatgcatcaagaaaggctcactgatgagaaggtcgacaatgatccgcgaggctgatggtgacaggcggatcactacaaggagtttgtacttaaattcagaaaaaaataaaagaagcaatttgattaaaacacatacaaaaattataaaatcattaaaactataaaaagaaacaagattccatgtagaatataaaatatcaagagtccatataaaagtataagttataaatatatggaatttggaataataaaagaagtattaaaagaagagtccaaatacaacacgatacatgattaagtacaatttaaaatccctaaagaagacaatgtagaataaaacaataatttgattttaatacaaattctagataagaataagtcaatcactaaattcaaaatacaataaatatttttattagaatttttctatatttattgattcaaatgcataacaaattgcatatatatatatatatatatatatatatatatatatatatatatatatatatatatatatatatatatatatatatatgaaccgatataaaagagggctttctcatatgtacaaatatacaaatattaccaaataaatctttgtcagatctgttcatatcgacactatttaaatataaaaaattccttacttttatctcaatctggttcgttctaactatttttgaaacaaactaatacgcatgcccgcgcgaatgcgcgggctatcttcctattttatataaatgtgggcaatgctagaaagtcttacattatgaagcggagggattattttagttttgtaattattttgaacaaatacttaaatgtccaatcatatgttttattgttttatcaaaccttagggggtgctaagtactaactgatagagatatacatggttcttccttattcactgcaggtcagaaatcgggcatagagaagcgctacaaccatccttatgaggagatcatcactgcccacccagagatcattgattgtcacaccctaaaaatcctaaatatataaattgttgtttaattggaattattagaaatgattttaaaagcctagaagagaagatctaattttaattaataaattccaatataaaatggggccagataaaatttcattaaatactttgcttaactctataattcctagatttttctgggatttatttgagctaaggaagtatttttaatagatggaattgcatttaatgaataatttaaattgaaaaaggtttttaaaatcctcttttggctttgggccgaaagtcggcccaaaaccttctctctccctctccccggcccaagccagcccagtccgcccgcccgcgcttgcgttcgccgctgacaggtggggcccgcctgtcagggtcatcgtcttcctcccgacgaaaccctagccgnaccgngccgncgncgncattccaaatctaaccgtccctttccgtttccggtgaaattgattgaggggaaaggatccccgtgatccactctaccttttcccttttggaaacatcgtctaaatcgctttggaaattcgcggattcgatctcgaatcggattcgtctctctctcccgaaccctaatatttccattgcgtcgccggtcgccatgggccttcgccgccgcgccctagtccctatttaagcacccccaggtcctccgctacccgtcgccaccctcgccttcatctctcgtcgctggtagagccctagcaccgtgtagcctcgcgccgccgtcgccgccgccgctccagccgtgtgtcgccgtcgctccagtcgtcgccgtcgctcgggaagaccgccgtcgtggtcgccgtcgcgtcgccatcctcgtcggcccctccatcgttgctgtagaccaccggagcaccgccgtcgtcgtcaacccgaaggttgccgccggcgagcttgcacgcccgagccgccgctggtgatgacgtcatcgccgacgccatcgttgccatccgtcgtagaccggtcgtagaccgttaaatcttggccgtccgttgtggataggatcgatctcggccgttcgtttccgtgagccgccgctgtgcacccggttcaccgtgaaccctagccgctgacgcaataattcccttttccttttcaaaaataattcattattgcgtcataattcaattaaaacccatataaatgttgtaatccgatttaaactttaaaaattcataactaattcatcttagctcggatttagttggttcaagtctctaaatttttctaaaattgagatctacatgttaaaaatatccacatgtactgttcatgcttgtttatgtgttgttttggtgttttttctcttttctgtttagattccgacgtttccggagagttcgttttcgcaggagaaaaatttgaagagttccaaggccagcaaggcaagtcacacagatcccaaacaattaaggaccggttcacgagtttcggttgtgaaacattaaccgtgccaaccacaagccagcgtgggcaacggctttaccttttgtatagcatggttcattgcagagcaccagactgagaagtggcggagataagcccacgggggtcgcttgggagtccatgccttgtttataagggggtgattatgatccaggaacggtgcactgtggtggattgtgttgtgcgaggggtactgtcacagctcctttctgaggtaccgtggtggtatcgaggcgcatggtgacatgttgtggggctgtgtcttgtgggttcagtggtacatctctggccagagtaaaactatttgaatagccgtgcccgcggttctgggcgggtctaacaatgtctttcgtgattagtttcacacttctcatcataatagaagatgctataactggtaataatttgattagctcctggtttggaatggtatattcctggtgtggagatagaactgtgcagccgggatggttgttcagaatggttgggcctatgcaacagggtatgttgtatagcgttggattaatattgtttaattattacctaactgttttattaaattctgaaatgtttgttaaatgctgtttatgcaaatgaaaccctactatgccatcctttgttatcctgtgcacttgcatatttgctgcgtggcttgctgagtatgtcatatactcaccttgcaattatttatcagaggaggagttctacagtgatgctgatggtgtggatgattaggcgtagccctggtcaaactgcctgtggagaggagtcgcctgcgctgtttcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagcctccttgaccctagattatgccaaatggttacccatagaagccctctaaaaatattggaaaagtagaactgttctgctccctttctcttttaattaaaccaaactaatagcacatgcacttcataatctcttttagtggttctcattgaaaatttattccagtgttattagtactgtacatctgttactgtactaatggctcatttaccagcaaaagttttacaacattgttttatttaatcttgctgcaatgaaataaatttagcatgttgattttataactttcttttatttctttcggaacctgttgttcaaaagtgcaaaatttgtgatcttgtttccaactgtttcaacttatcttgcaagcctggtttactttatttacttaccttttacttaatccaaaaacttgtgctattaattgaataaatgtcataactccctcctttcacttatctttagatgccgcgctacaagcctgagtacttgtttggtgttgagggatttgtccaggagttgcgtacgatgtcctttgccataggatttgggactgcccctttgtatgcccagattccccatgattgtgatgaagagaagtgccgagtcaaagtcaccttgaacagtaacagtgaagatatcccatcagtgatgttcaaagctggaggaggaaactacattcatgcatgtcaggaggtggcaaggatcgccataggagagctccgcgatcgctacagtgatcagttggccgacactgagtatcgctaccatcctcgccaaccccagggaagtgaccgtggcagctaccttgagaccgaggggattgagaatgatgctaccacaaggcatttggttgagatgctgtgggctatggatgagacccacgcggaggttgtgctagcagctcaagatcgtgaagaccggaatcgtggaaagatttgcaagctagaagacaaggtggagcgtttggagaaggaactagccgcgttgaagggagaagcaccaccgcagaaggccagggttcgtcttaccgcaaggaagagagctctattcgtccctcgctaccaattggcgccaaaggtccgtgtggtggagaaagaagttaccccagccctagcgaatcctccgatcgtcaacgtaagtgatgatgaaggagaagaatcgaagcgcacccactcaaaggtcgaatggggagctactcaagatgatggagacgagctgaacgagccttcaatcaactccgatgcccggaagacctagaatgccttgtcaagccgttgtcctagatcgttgtgttagtttgcttgttttaagtttggttgtgtgtgggggtcctgcatgtggtttacatctgtggtgggatgtaagtgcatgcgtttgtttgctttcgagtgttaggtagttggtgagtttagtgatgtgagagtcttcagttttgtaataatgaaactcagttaagatcaataaaagttaagttagtagaaaaattaattctctgtcctaagtagttttccccggtttctcttcttgtgctcctgcccttgccagatggtgctcactcgcagcaacgggaatggccccaacatcaataataacaacaacaacaatggagagaatcccacacttgcccaagtcctggctcaacaggcacagcttatgaacatgatgatgcagcaactccagaaccagcagaacgagggaaataaccatgcacctccccagaacaagttagcaaaatttcttcgtgtgaggccgcccactttctctagcaccactaatcctgttgaagctggcaattggctgcacgccatagagaagaagttggatttgcttcagtgcactgatcaggagaaggtctcatttgcatcacaccaactgcatggccctgcctctgagtggtgggatcacttccgccttaacaggactaccgctgaacctatctcttggtttgaattcaccgctgctttctggaagacgcatataccatcgggagtggtgtctctcaagaagaaggaattcaggtcgctcacccagggatctcgcacggtaaccgagtatctgcaggagttcaatcgtctggctcgttatgctccggaagatgtgcgcactgatgaagagcgccaggagaggttcttggaaggacttaatgatgagctttcttacccactcatgactggggattatcatgatttccagaagttagtagataaggctattcgccaggaggacaagtaca

SEQ ID NO: 65860 - DNA, 28441 bp, Oryza sativa
  unsure (1)..(28441): unsure at all n locations
cagagctcctcctacctctgccgcgtcgcccccgctccctcctcctttcccaaagaggcaagggacaagccctcttttctctccctcttttcccctttttcctcccgccggcgtcatcctcctcccccctccctgtcgccgctttggccacgactgccgagcgctagccctctcctttgaccgccctaagtcggttcccaaaccgacattgctgctcctataaacccaagcttccccctttcctttcctctcccattcgcctccacgccattgccgccgcctcccgtgctctgttcgccgtcgctgttcgtcgttgcacgtgtcggaggagccggcacgagcaaggacgcggaaggggactccgggcgcgccctctccttcctcttccctgccccgaggccggagagattactcccgcgccgtcggcctctcgtcactgcgcccgcccgcacggtagtgcctccctccattcttcctcctcgctccatctcctccccttagactcgggtagtagctcgagtagcctccccgtagctagccggcgccgccccgaccgttgccgccgctcgccgtgtgctcgccgctgtcgccgcccaagctcggaagcgccgctcgtcgccggcctcgctcggcgcagctccgcccaatccaacgctagcatcggattcccgtagccgcgtagatgccctcgccgtcgggaattggcccctcgtgacctcatcgccgtttcccccttccctcgccgccggttgccgccgccgcaatccgccgccgacgcactccctccggcgaatccgagccattggctggtctcccccggtcctgtgcgaccacccggtgtgctcgctttcgcctgtatcgccgtggttcgctccgccgctcgccgctgtcgtccgccgtccgttccggctggcgtcgtcgtctacctcccgccggcccgcgtggcagccacgtaggcgccacgtcggcgccaactcggccaagaccgggtcgagccgaccacggtcagcccctccctgtgcgcgcgttccaccgcgagccgtgaggctgcgcgtgggcccgctgcatccgtgtccacctcgaaccgcgcgcgtgcaccgcgtccctcccccgcccgcgcgcgtgcgccgcgtgctcgctccgcacggtgaaccgtgtcaccgacaagcgggtcccacccgggaccacgcgaggtgagcccggtccaccggctctctctctcctccctcccgcgcgcgcgttgggccgccttgggccggccggcccattaagctcggccgaaccgccctttctctcgggccgcgccctagccgcccgagggaagtctaatttccctccctcttttattttattttcttttctttttcaaaaaggatttaattaaatccttttcctttagaccaaaaatccaataatcgtagaaattcaatatctccccaaccgtaaatccgtttgactccgttcaacttccaaaattcctcaaatctcgagatctatctaatggcacacttagaggtcattaatagggctttatttttgccgtttgttgagttgtcccgttctgcgtgtactttcggagcccgaagacccgcagtgcgaggagttcgaggatcaagctccagatctcgagcaaggcaagccacctttgaacatcttgagcctatatttgaatttaattatgttgcttgaaaaatattatgcattgataggatcgcacttaatctgtttgtcccgtctgcaaggcagattggcgaacctacctagtttgttgcatttgatccttcctttgttaattgttatcccatgttcccttgtaaccacccagttgcgcctcggaaatcgtgcactctgcacgagtatcgacggccgccttcaaacttaaaatctgaaaaacatcttgggtaaaacttgggtcttacaaaaaacttggaaaacccgacacctgggtcggtgcttgcgaactaaatgaatttccaaaaccgcggaccggggaacataccgggtgtacggtttcccgctcttgcacttaaggaccgttttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggccttggaaatgtcttgtcatgaaagcttggaggtctcccgatgtggctgatccccacgggctgggtgatccgggttagtaatgtcgtgcgggtaaagtgtaccccctctacagaggttaacaaactgttcgaacagccgtgcccacggtcatgggcggatgtgaggtgattcctagcgtagttttgtttgactactgccttgtgaaattgctgttgtgaaaaggggatcgttgtttggaaaatctgcagctgatgggatcagctaggcccgggtggccgtttgaaagatgttggcccgggtggccgtttgaaaattgttggccgggtgccaatcttgatcaattttaaagactgatacattgcacatactccgaccggacgagacgcactgtctcatctgtgtcgtttgagaagcactcacttagttgtttccagaaaagagttcaaataaaaatcaattgcaaaaacaacagccctttctttgaagcctgcattaaacacttatttcccatggcttgctgagtactcccgtactcacccttgctctatataaataatcccccccccagttgctgaagaagatgaagcggatcctgcagatgaggagttcttccaggagcaagccggctacgatgagttttagggtttcggcctagttcccaagtcgcgcctgtgttgtttgatccaagtcctagcttccgcttcccttttgtaatgcagttgtgagctcgggatctgtccgcagcccaacatgactgtacctctactctataataaagagacctctattgctgtgataatttgtcttcctgtgataccagtactgtttcctgggactggtatcgattaacaggttaatttggagcgtcacgggctagatccggtcggtactagttcagggcgtgacacaagcacaagtcaattctaccatactatatgtaaggcatatattcaaaggaaggcaatatgtagttcattttcagcataaagcaagttttgtttcgcaattcttttgtaaaggagttgatgcttcaattaacaaatcaaattttaagtttcaatattaaattcatcataattccatcataatcaatctcttgttgtcatcctttgacaacaagtcataatatatcacctcacacacacaactcaacacatctatcaatttcaaaccaatgtcacatgatcacatttttaaaacatagtctatactcatgacacatcaccaaagcgctcatgaccgtgagcacggctaatcgattagtttaaagaactctgcagagtttgtacagctttatccacatgatatgaactctctagtttgttttgagtttgcaagactccaccacactcttcattttgaattacactacttagagcctagccttgcaccagcacgatacgtgttcctccatcctaggcatacttgaaatatacctagaaccgttaagtggtgggcccacgccttaaacttaatgccgtggtggcggacacgacgggaacccaccgcacaataccgttgtattggaaacgcttagtcacctaaactaccacgtcagggtaaataggaagctcctctgaattatacgaactcatacacaccgacctaccagaatgcaaggctagtcctaaatagattactcagcttaggccatctcatactagcacatgtggatgtacgaataactttaaatgggtgacacaagttcggtccttatggacttgggcaaacactccccctatcggtatgcaactaacaccatatgcacaccacttgccgcccaagtataaaatcacattttacacattttagttcgcaaatacccatcatatttattttattccagcaaaggttcatgtatcaaaatcatattttaattatagatggaatgagcatttgcatagttgtaagcatggctaagcaagtagttgcaaatagagcatatataaacccatttgagcacaaagagtgtactctaaccatttctaggggttcaaacagcaagaggatcaattattcaaggtggggtatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaaatgttagcacctaatccactccttcaccgattatgcaattatctagataaaggacacgttatgcaattaaacaccgaaatagctaaaaaatctaaaatgctctaaaatgcatgatttatgcacagtgattaggtactgatctaaaatgaattttaggtgaaataatttttattttatcttattccattagggagttatgaattttagaagttttatcgatttatagtagtatagtcttaggtagtgttatgaaatacttttgtaaagtgatttttactagattagacttcacaggggtgtagagatgtgttttataagactaactcatttggtttcacaatttttggagttacaatgattttcttatagattttacaagttacaacgtgttttaggcatatagtgttttatatgtgcatgactctcaagttgtaggttcagaacatgctacttcctgtttaagttgaataaaaggaataatttggttaactaaaacatttttagttcacatgtttatggtctttactactatggttcatattttataaactagagatgctataaactaaactagcaatatattatattaacctagaaattgttatatgagctaagttcttctaagttttagtggatggggatggaactatggcctctctggtctaacaagttttattttggtttattcatagctagaatgcatttttttaactaccttacacatatattttgcttaaccattactaggtgattaactcctaggttatctatttaaagattagagctataatatgttcaaaaggtgcaatattttattttactatgttgaagctcactatttgctggttctatggaaatttggttcatttcatttggactaaagatgaattttctacaaattttacaaagtaaaggttgctctatcttggttattacttacataaatatttaaaggcttttattacatagtaggtgtataattttatttcatggaagtatacgttttgttgattctacagaacttgggtttactcaaaaaggatctaagatgaattatgaattttatgtgaatttctaaagttcagcttacctaaaactagtcattttaaagataatagtttcagaggcatttgatctaaagtatgtatacaatttcattttactttataggaaaacataagttggtggatctatagaaactgagtttgctataaaatgagttgagatgaattttatatgcattttataaatttgtgtatggtttatgtatgatttatcttagaccaattttagagacaaagtttgtacagtgaatgtctagttttatgcaataactctaaagttcttgatttggtgagttcacagaaatttgatttactctaaaatgagttgttttcaattttttatggattttataagtttacatgttttcctgttgaaaatataaagcttttagtattatctttttacattttcagattttaaactcatggggtccacctgtcagtatcaggccaatatgcaaaaaggcccctaggattttcaggaaatcaacccgcagtcctaggtccatatgtcattgattgggaacattacgtaatgaaccttatagttatttaaattctcaaactgaagtccctgactcctttttcacacgcacagaggcagagcagccatggctgagctcgatcccgggttcaccggcggcgattggtggctcggttggagttggggttaaaagataaaatgaagagcatgttcttgcgattccattcctctagttttcttggtcagaggacatcggagtagcgccgatggcgagtgtgagcggcggtggttcttggggtgaaagctcatgtgtgcatggaaatcgattccgaacgatgcatgcatgtggtcttctagccttcaggatgctcaccgtgggtcgagctagggttttcgaggtcttggcggcagcggtgacttgtggaacggctcggcgacggtgctcctcctcgggtgaacgacgacggctcgaacgggacgatgagctgctacaagcaagcatgcacgaggtttgtgaggtcaaggagatggtgtatgcgcgaggaatcgaacaatggctcaccgaggcagcggtaatcgacgatgacggcggaggcgattctagatcggcgccggtgaagaaaagatgcgttctccgagtccttcaaatctccggctggggttcttgaggcgtattgaagaggagattgaggcgatgacgatggcacaacggcttgctccgaggtggtcaagaatggccggacgacgacgatggttgaagcggcggcgctccggtgcgtgctccagggcgtcgtcggcgtggtcgcgttccggtggctgtgatgcacaaaatgggacgtggtcaaaagagaaatggttcggcattgtgtggagagaagggaacgcgaaaaacctggagatgaactttacccaatcagcgatggcgatggtcgtcgtttccacggccggcggcaaggtttggggcgatggagaggcagagaacctcctccctcggtttcttcggctctgagtggtgaatggagaatggcaacgcgtctgggaggagtagagagtgagaaaagggaaaccgagatcgacgacacgttgcggccacgcgtcggctcgctcaatctctccctctctcggctggagcagtggaggaagtgatggacagagtcaaggcaagcttaagaggctgtcaggtgggtccaggtcgtggcaaactaggctagggtgagagggttgggtaagattctgggtaaacttgatttttagatcatttttcggaattattttctcctctaactttgtagcttcataacttaatgtgtggaccaaattatctagtgttgaatttactggaggtaaatgattacacctagattccattttctttggttgcactcaaaaataatgggtagattaatcacagaaattaaacaaagatgggctgttagaaagctagattgaatttttaggaggcctaaacagaggaggaaaattctagaaaaattatatttaggcatgataaataatctagtatttgaataaattattttccatcttcacttatgagcagttaaatgtacttttggatgaagtatgactttagccgattaaaatttaatttgattccttttagttttctgctttgactgattaatttgtggtattaaacttagttattaacttgtaccaatattatagtgaattgcttgtgctaaacattatctatctaatttttttccatgattttaacttgcacataatattttagagaattaggattactttactttgtatatgtgttcccacttcataattgcacctaatattgttacagggattacattaaacttcttttgggctgagaagatgatatttgagtttaatattaagtccacatgttatcacccaagattaacttttgtttagtaattttaacccttttagtttatgctcatgagacatattatgaaaagcaagaccaaaatccaaatgcacaagagactcgagcctaggcatgcattatgcacatgtatgctcatatacttggtgacatttctagtctaatgttgggaatgaaaaggttttattttgttctcaaattttaatcatgcaatgatttaagttggtcatcacctaaattaaaacggaaatttttgactctaaaaattggagaagttaacctctaactattttgacaagaaattttaagtcctgaaattttgggtatgttacaagtagcccccgacttctctctcctttccttggaattcgcaccggcggaggtgcgtctatttaagggagttttggggatcccatttgaggtctgcctgttgaaaaaactctccagcttccaagcgtccctcgtcttcttcgctcccgcaaaaaaccctagccaactcgtctcggtcctttctccggcgatcttcggtggccatggatctcgacaagtctacctccaccagtgcgtcactgaagaaactgcaagaggatggcgcccttcccggtcgcgggaccgcggagagggaagtaggaggtactgaaccccagcctgtcctgggtcgcatggttgcggttgaggactttattctctgtggttttcttcctccgccttctgaatttctccttttggtcttgaatttctatggtctttccttgctccatttgaaccccaattccatcgccttcctgagtatttttacgcatctttgtgaggcctacattggggtggagccgtttcttgacctcttccgcttttactatgagttacgctggatggaatccaaaaaggtgtccgggtgtgttggtttccgacttcaggatggcctgaagtcgcgatacatcccctttcagtgcctcacatctcgcagcaaatagcgggggaggtggttctatcttcagatagaggattcggatcctgtcttcgttgtacctaaggaacagccagacaagatttcatcttggaccaccaaacccgccttgaccccgtccctccaatctttcatcgatatcattgacgacctccgagaacgggggttgtcggggtatgaagttgctgccgacttcattggtaggcggatccagccgcttcaggctcgagcccatcctgcctttgattattctgggccagaggacgcgacccgggtttctcctcagggtatttcctttttagttaaattgactcccttatgttcatgtttttcccgtcttatcggattctgttctcaatctacaggcttgaatagcgcaaccgtggagcgccgcgtccgccaactgataatcagcggcccgacaacggcgagcaacgtccccgtcctcctttgcgagaaaggggtagccgagcgcgacgctgccatcaatataagtgtacttagctgtccttttgcatctttcttccgggatcacattatgacttcatgaaacgttggctctccctctgactgatatcatcgggtcgctcgtggaccatcaggtggcggcgtcgctgaaagagaaggtcgccaaggaggggtctgacgctgctgttgccactaccacgacgagtggcggcgacgttccgaaaaaggggaggaaattctcctctatagtcggacatcgtcggaagatacccactccctcagtaagttcacccgttatttgatcacgtagtcggaaaacttccacctcacatcatatcgattgtactccaggcctcggacgcgtctcccccgcctccgcgacgacagcggcttgtgacgctcagcgagaagtaagtgaataaatttgaggtttcgtgatttcgtcaaactctgtctcaatcgcagcctttcgcagggcggcgcgggcgaaggcggcgtaagatgggtctggagggacctccagcgcatctcctgccgtggcctcgacggatgtcgtggtcgtgcccaggagccatgaggcgacacctagcggcccagccagcgatctcgtggctggtcgtggttcgccggatgccgtcctcacctgggaggagctctaggttgagatggggcgcctcctcgaggctggtggtcacggtgttagccacgagatcgcggaggcgagggcggcggctgcgtcgtcggcgaatgagcgcgccaatcggctggcgcgtgatctagcggaggttcgcgaggacctccagaagatgagggaactggtggccggcaatgagcgacaacagcaggggctcgagcaccgcatttcggagcttgagaacaacttgtcggaaatccgtggctcgttgtgggtcacatatactggtctgcaccagctcgccggggagtgcggtatcaagtctaccatcccggcgaatcccgatgagttctcgctgatgtcttctcttgcggagctggtgacggcgatggaggagatcccctccaagtatccagccaggatcggagaggagacgtctaacgggatctacaccggggcgtgccacgtccttgcgtgtgtgaggctggcgcaccctgaactcgatctgcggaagatcttggatcagggggcagttagcgacgcgcgtaaggatgtgatggaggaggtcggcgatctggggagtccgtcctcccgctttttgaagagtagggtcttagctctcttgtactctttagtcatgccttgtaaaacttttattggttccaaccgccctagtgtgtgcggtcattgccttagctttgtttggcattttgatctcgagtactttgttgtcctttgtagagatgttgatgtcgaggatgtcctgcggcgcgggcaacctgagttgctagtggtcgttccgttacttgcgtccgaaccatatgtgccggaaggcgatgtagatcgaagttcgcctgtggaaacgagcatggcggcgactcccttaggttggttgtctttgttaccatttcctttgcccttccgtctggatcgacttgatttgttgtgttctcgggagagaagagcagcttgacttagtcgtttccatgctgagcagatctcgagagtgcgcttgttgaccaggaccgtcccatccagtattggaggacgaagtttgaggttgcggaactcgagaggactatgctggaggtgagaaaggatcaggccgtagagacacttcggggtcgtgagctgtggttcaactcgtatctaaagagttgctgcacatccatgtcgagagtctgtagagagcatcgagtaccccgtggggatcccgaggaatcggcggccggatacatctcgtggctaaatggggcctgcgcccagctcgaaggcatcggtcaacgtatcgacgaggccttgaagcaggagtgtcgtcgctcaagccgatatgccggggggcacgtgctggcctgtatacgagatcatcgtccgcagctgcacctcgagttcctccgcgaagggttttctcgttctcggagaactcctacggagatagatggcctggcgaagtcgatggcgccgctggcggagaaggttttccagtcgatggactggcgttggccttcctggtagtctccatgtcctgtgacaaatgtctttggaagaagtgtaatatagttttggattttgatggaattgtaagaaatacttgtggaatagaaaagaaatctatctaactaagctttcttactctggacgttgtgtgtatgagtgtcttctcacttcgcaactttgatcagtcgtttgagttatacactctccctagcccccagccttgtcatcggagaattcttctcggaagataaggttcttggacctttgacctgcctcggttgaacaagcactgatcgtagcctccagccatgaagttggaaagtttatttccgattacacggcttggttaatacgcacggcgagaactcttacacgactagatcttacatggtctttcgtctctacaggatataacaaggccttatcggctctggtcgtccccagccgaagttcccttaggttcctcggaggccttgtcaagacgacgtaaagggacatgaggataggtttcaacgctaggtgtcatctaggtaagggattatcgggaaggaacactttgattgtcgtctgtacctgaaaaataggctttattgaggctgtaagatgtcttacaagtatggatactattgacttatacatagaatttacgtaattgatcaatgttccaggaatttgccaactcgcggccatcgccgtctgcgattttgaatgcgcctggccacagaacttgtgtgatcgtgtacggtccttcccatttgcgtgagagcttgttgcgccctgcttggctttgaacccgtcggaggacgtagtcgctgatcgaaagcgtgcgtgctcggatgcgcttctcgtggtaacagcgaagggcttgttggtagctggctgctcgaacgacaactcgtttgcgatgtttctcgagtagattcacatcgtcgtatcactgctcctcctgatcctcattggagtacttctgtattcatgtactttgatgtcgtagctcggtggggagcatgccctctgagccgtacacgaggaagaagggtgtctccttgttggacgttgtcggtgtggtacgcacggcccatagtactgatggaagttcctcgacccacttcttgtcatgtgacatgagcctgtcgtagacgcgggtcttgattccttgtagtactatgccgtttgccctctcgacttgtccattgctctgagggtgagaaaccgaggcgaagcagatctttactcccaacctgatgcagcaatcctggaaatcgacactgatgaactgggagccgttgtctgttatgatacgatggggcaatccgaatctgcagaatatccctttgatgaatttgatggtgttgtcggccttgatttctcctgtgggtgtcgcttcaattcacttggtgaatttgtcgatcgctacgaataggaacctgtagccgccttgtcctcgtgggaatggcccgagtatatctatcccccagcacgagaacagccaagtgagagggatagtctggagtgcttgcgctggcagctttgtgtgtttactgtggaattgacaagcttcacaccactgaaccatgtcgcaggcatctttgagggcggttggctagaaaaacccttgtcggaaagcttttccgactaatgtccgaccggcggcatgtgacccacagatcccttcacgtatgtcgaggaggaggtgtctgccgtcgtcggacgagacgcattttaggagtaccccatttggtgccttcttgtatagatcgttgccgatcatacagtagacttttgctttacgggatattttctcggcttctgcgtcgtcctcgggcaactcttcgctgcttatgaatttaatgagtggggtgcgccagtcgtccgtggtctcgatatcggcaacggcgcgctctgcctctgtagcccccgaggtggtgtcgggggcgaccgggctatcttcgccgcttgcctctttcactgatggcctcgtcaggacgtccagaaaggtgccaggttcaagtggttctcgtctggacgcacatcatgctagatcatccggttcgatgttgtctttacggtacacatgtcggacctcgatcccatcgaaccttttttctagcttcatgacttctgtgagatacttggataactcggggttagagcacttgtaatctttatgcacctggttcgtgactagtttggaatcccctttcacgattagtcgcttgactctgagtgcagctgcagctcttatcccggcgagtagtccttcgtattcggctgtgttattggttgccctgaagttgaggtgaattgcatgcttgaattgatctcccgaaggtgatgtcaagatgaatcctgtccctgctccctggctgttgagtgcgccgtcgtacgccattgtccatgtttcattgtcgatttggttgtctgacctattatcaggcatggtccaatcgactacgaaatcggcgagtacctgtgacttgatgattgttcgtggcatgaagtagatatcaaattggcttagctcgactacccatttcgcaacgcggccgacaacgtctttgtttctcacaacttcaccgagagggaaggaggagacaactgtaaccctgtgggcttgaaagtagtggcgtagctttcttgatgtcatgattactgcgtagagcagttttggatctgtggatatcttgtctttgcgtcgtggagagcttcgctgacatagtagactagtcgttgcaccttctctctctcgacaacaatgacagtactaacagaatatggcgtggcggcaatatagagaaataattcttcattaggttggggggcaacaagtacaggtggattggataggtagcgcttgaatgcaatgaatgcctcttcggcctcctgtgtccatacaaatttgtcttgctttttcagcagagcgaagaaaggttgtcctcgctctcccatcctagcgacgaacctgcttagtgctgccatgcatccggttagcttctgtacttccttgagtcttgtaggcgacttcatgttctcgattgccttgatcttctcgggatttgcttctattcctctgccagagacgaggaagccaagtagcttgcccgatggtactccgaacgtgcacttctctggattgagcatgaggcgatatcgtcggaggttgtcgaacgtttcccgcagatcgtcaatcaaggagtcgcttgccttggtcttgacaacaatgtcatcgacgtaggcctcgacattgtttctgagctagtcactaagtgcaccttagaccgtgcgctggaaagtgtttcctgcggttattagtccgaacggcatcttaacatagcagaataccccgaacggcgtgatgaatgctgtcttctcctcatcctcttttgccatgcttatttggtggtaaccggagtaagcgtcgaggaaactcaacaactcgcaaccggctattgagtccaccagttggtctattcgaggaagaggaaagtgatccttgggacacgccttgttgaggtcggtgaaatcgacacacattctccacttcccgttggccttccgtaccatgactgggttggctagccactctggatggagtacctctctgatgaaaccggctttgagaagcttgtcgagctcttctcgtatggcttgttttcgatctggtgaaaatctccgcagtttttatattactggcttggcatcgggtcgcaccatgagtttgtgctcaatcacctccctgggtaccccaggcatgtcggacggctgccaagcgaacacgtcagcattgtcgcgggagaaggtgatgagcgcgagttcctatttctcgcctagtgaagccccgatcttgatggtcttgtcggggttggcactggatagtggaacgatcttgattgcgccgtctggtttcggcgtcttgtttgtcttgctcactttcttgggtggctctgctgtggcaggcgggctgggcgtgtgctcgaccatgtcgaggctccgcttgtcgcattgtactgccagcttagcgttcccttgaatagtgattgttcccttcggtcctggcatcttgagcacttgatacgcatagtgagatgcggccatgagcttcacgagtgcagttctcccaatgatggcattgtatgctgtatcgaatgcagcgacatcaaaggtgatctgttccgttcggaagttgtttgcttggctgaaagtcacaggcaacgtaattttgcccaatggtttggacgatgactgaggagtgattccatggaagggttgatcggtgggtgtcaactcgcttcgtgggatccccatcgcgtccaaggtgctggcgaagagaaggttgattgagctgccgccgtcgatcagtactcgggcgaccttgatattacgaatagtgggttcgaccatgatcggatattgccctgggatgatagcagtcttggggtggtcctcttctgagaattctatctactgctcggaccacttcatcttgggcgcggccccctgccacgtcgaacagacttcacgttccactttcttgtattctcgctttgaggagtatgccgtggaacctccgaagatgtgtgagacatggagatcgtaatctgggtatgctaagtctgattcctgagtaggcgccttagcgtccttctcaaccacgcgtactcgcttgcctttttccgatgccatgtgtttggcgagcgactttttgaagacgaggcaatcttctagagaatgtctgtccgtcttgtgtatagggcaccatgctttcttcgtgtcgctgccttgtgggtctgggcgcttggcagggtccgcgtattctgttgcgagaacttctgattgagctttccttttcccactcttgcgatttttctttttgcttgactcaggtgcgtccttggctggtttcttctctccttcggtctttggtttgtcgttcttgcatctcagtgcgtcatccgcatgagcgcatcggtcgacaatttcgaataatctccgagtagtcatgatgcgcctcgttaccaactcctgagtagtatagcgatctctgacaccggatttgaaagcgcgaattacagaagcatcggtgatctcggggattgtgtttctgcactcgttaaagcgccgaacataatccctcaaggattcgcccgggttctgtgtcaacgcatgtgggtcatcttcgatcgcgtggcgcttgtaagttccttggaagttggctacgaactgctgccacaagtctgcccacgaagagatcgagttggggggaagatgcatcagccatgaacgtgcaaagcctttaaatgcggttggcaagtaattcactaacgcgttgtcgtccgctccggcagcgcagagtaccgtggagtaaacctaaaggaactcttctgggtcggtgctcccatcgtatttctctattgctccaggtcagaatctttcgggccatcggacatcccgaagtgaacaaccgaaagctctacacccaacgctgggggcggtgggttgttggcgatcatgcgtccttcgtggatgtctatccgatgatgaagatgacgaggatgatgacgatgacgatgggtcgtctagttccggcgtacgattacggggacgtcggccgggttctcgagaatcctgtcgtcgtctcccgctgttatctcggtgccgatctccatcatcaccgtcattattgcgacgtcctcgaccagtatcgcccagtacccgccgttcgcgatcgttgtgatcgtggcggttgtggcggttatcatggtctcggtcttcgcttgaatgacctcctcgatcttcgttatcgtgacgccgtgaagagatatgacgccgggaacggttctcgttgtctcgtgtgcgtcgtgcctctcggcggccattcaggtgatcgcggagatcgccggtgccgcgaggtggaggggttgctcgatgaggtgattccgccgttcagggtcttcaccatttgcatcgcaagttggtggctgtttcgggtgcgctgcagcagcggcctcttcgaacgcgttgctgaggttggtcactaattgcgttgacggctctgatgtgttgggccggagtagtcacttgattctccgcttccgcattggtgcgtgctgacgtgccgacatcgtcgatagccaatacctcacgaggcgtactcgttgtcgatgatccatagtcttcgagtaggtgcaagactgatggttcatggggatcgatgtcgattaccccaacaaatcgatctgaaatcggcgtcgctccttgttccttgtcctcatccctgatggggatgcgtgactgctggaccttaggaggtggcgtcttcatggcgctgagaaagaccttgcagctcgagaggtcgtgattctttgtcttgtgaataggacaatagacatcacgagttggagaggtacactgaattccacgctcttcgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggtttggatgtcgttaacgttccgatctccgcttcggtgggaggatccttcgacatggagttgaaaacatgaaaagaaaaaaaaataaaaaaacatggatcttcgttaactttttatgattcttttttttcattaaaacatgttttaatccttcgacatggctgagatcggcattgtggtgtaaaccggaaagacgtttcgccgacttgagtccacaccagtgttgttgaagttggaactccttggttgaggttggtgttgacgctgttgtcgacgaatctggatgtcaaagtagtagaaccttgagcaccaagtccccctacctggcgcgccactatcgacgggggatacccgtagaccggatatagagggtattggggtacgctggtacgaggatgtacgtagtacgacatcaagcaaacaggaaacagggattatactggttcaggccccttggtaggtaatagccctaatccagttgatatgggattatatgatggaaaccacatattacaaagggaatagtaaagctcgacgataccgacaggatcgtagtcgagttgatccgactagatctcccggcgacttggcttcgataagctctggcttcgtaggctgtggtagatgtgttggctctaagatttaatgccttaggtcctcccagggggtcccttttataccgtaggtcaactggtctccatgtcggactcagagacatcggacccgacacgatataatgacggccgatttctatccgagtaggactctttccatctgtagactccatgatggacttccttaacctatgctgagaacgtccgtatacgcgcaaacatactatatcgatacgtgacgtatatcgaagggtagagggtataccttacccgtaaccctgatagcgccgggagccggagccgctgtgaacgacaatatcaacggaggcagtttgcctcacaatccagcggagagacattcacagggtataaccttcgcatactgttaattcaatttttgatacttctgttagtcgtaattctattgcgttcgttgtatggtcatgatgcttattatatcttaagcatgcttctggttatgttagattttatcactagatcaccccactttgttcatgccatgattattgtcttaatattttagattaaaatatgtcaatatatgactatatttccaacaactgacaccgatggctttggtaagacctagcatctggcactcctccatctccctccatactcgctccatgtccatcaccgcaaggtcctccttagcgaacacagccgatggtgggccttctggaactccaaggctcaccggaaagtgaaccaggtacaagtcgatgtactccacttgcaaattcctacatacatgaaccattgctcaaaccaactacgaaaatgcctgcctttatcaattgtcaaacatatatatgaacatactccctccttccctaaatgtttaacgctgttgacttttttaaacatgtttgaccgttcgtcttattcaaaaacttttgtgaaatgtgtaaaactatatgtatatataaaagtatatttaacaataaatcaaatgataggaaaataattgtgacatccccgcccagagcttaataggattaatagaatactacaacttctttttcggaagccgatctcagaagaactctaaggttaagcgtgcttggcctggagcaatttcgggatgagtgaccgaccgggaaattcttagcgggtgcacgagtgaggacaaagtgtgcagaaaagatttgtgttggtctgcgagggctttctatgacctataaaagctgccagatataagcgggacgttacaataattaataattacttgaattatttgaataagacgaacgatctaatattttttaaaaaaagttaagggcgctaaatatttggggatggagggagtatatagcgagctctaactattggtgcatgctaaccggagtgtcctacggagtgccggcaccacacgaccggggtgtgcatcgctgatccataatttggatgtgatgtagagttcatctcgcgatgaaaccaaagccaacgcgcaccgcttctgtcgtggcctcaccaagggcagcctctgtgccgtaattggccgccgtgtcgaagtgacggtagccgactttaatggtgcataggacggcctcggtcacggcgaccggatcggctatatgcctagcgggaacgttgccgtgcccatgcctacccacggcatcggcttgccggagcttagcgccacctccggcatccgttttccctctgcaccgtccgcagccatggggggatcgaaggggcaattgtgggagatacaggattgatgaagtatatattgtgtgtccatactactaactatatatatatatatatatatatatatatatatatatatatatatatatatatatatgtatgtctaaatacgtgttgtcgccgcagcctctaattaatgcatggagagctataatgctatatatattatagtatgaatgtttgcccatacgtgtcgggagtggctgcaagttggaagagccaaacgtgtctatgtcagcaatcaagcgtatgacagcatccacacacactgttattgtatttttggaaaataagaaaatttgttttcttaattacactagtttatctacaacaactgtacagttaacacaatgtgggtgtgacaccctgcatagttttcttactgtttggtgtttgcgctaatggagaacatgtcaacagtcaactgtgccacctatcggcatcggttaagaaaaactcacactaataatagagggagggtttcctgtccacccacctgacccgcactgacagtaaccctaaacccactctctaccacaccgtctgctcaactcctctccctctcatctacctttttcacttctttggtgagcagcacccacctctcctgcccttatgtggtgcatcagccaatggaaccagtcacctcgaaccagcccaatgcggtggagcaagcggtgtgagggttatttccacggtgacggcggcagatccacggtgagcggcagtggtaaaactacggtagatccacctgagcttgacagttacaagctaagtcattctatcctgctcctctctttagggttcaattttttaatttagttagttgcatcgggggtatcgatatggtcacaatttccaaaatttcggttattttaatccgaaataatttgaagttttaaacaaaatttgatcaaattcaaatatttttgtggaattcacgaatattgcaaaaatccaaaaattccaggtgaaataattttgtatgggatccaatagacccaaaattttgtaaatttcagtccaaacttttgttccctgcctctctctcagctttcaccacactctttctttttctctccctctctctcccatgcagagcggatctgaaacgcagctagcagctgttattcttttggggtgactacgaatcgggcacccgacgttatttctcaagatgtattcaaaaaatgtttcaatattgaaaatggtaaaacacaatcaatcaaatcatacaatgaaaaattttggtacaatatataaaacaacacatccaagtgcatcgaaaaaaatgaaacaccatggaaaaccccacaacaacatttcaatttaactaatgaaacatccaagtacatgaactgaaacatcaaatattcaaataaaaaaaaaaaactagatcaacccctccctctgctccggtggtttgccaccacatcgatgtcggggtgccgccatgggtgaggaggtggcaccggcgtgcacctatggagatgacgctgtggccgaagaaatgctcaagaatctctaccacctgctcctgtggccactctgcaacaccatcgcccgatgccacgccgagcagggccacatccgtgtggctgccgctgtgctaagcttggccacgtccttgccaccaccactaccatggctttgctcttttgccaacccatgagcgataagctcttcgtgaatgctagcccgttgcctcacaaatagagaagagaaaaggcgtggagagaagaagggagagagagagagaaagggatgatggaatggataagaaactatgcctcacatccgacagtgatgaaggggtatgtatatttctatgtgtcagttgtaagaaccggagctaatgcctgcttataaacggcactgaagacgtttcctgtggtagtgacgtagtgtttcactatttcggctggtaacattggcaatttatttttgaccggaaaatagtggggaaatcccccacggtaattttcattaaataaaggaactgtaaaaaaagattacaaattgtcaatccatgattgaaaagagggtctcaaaactactcgaagtctaggtaaatgtagggttggtttggtttgagtcctatattggccttaccaatatttggcaatttcaatagtgtttattgtctatttggtttggagccaaattttggcatgcctaagaaaataggccatttcaacagttaatttaggctattttggcttcaatccaaacacaatttttcctttgccaaaattagccatgccaaaagttgccaaaatttgacattgacaaaaattggtaaggccaatttagaccacaaaccaaaccagccctagctcctctttcaggcttgctttccatctactgagagagggagatactttgttgaatataagatcatttctctgcctccacaagagccaagcagccactaagaagatttccatgaagcaaaaaggagacaaaaccaaacctctgcacttgaatcatttgatgaaaatcaagagaagtatcccatgagaacccaatcatattccaacaggctgcagcaaaggggcattcaaaaaacaaatgatctcttgtctctcttgatcctaaggtacacatgacacaaaaggagggtacatttgggggcttgcaatgctttctctctaagagatcccgagatcccttgtatttgttctgtccaaaaacataagccaagcaaaaacttttgtcttcatatatgctttacacctccaaatacaaggcaaagtaactagggttgtagagaccaaaagcaaagcttgtagaacttctgagaggagtaaatttcatttccccatatatataactccatctaccaggctgtgaattgactgaaatctgtgaaagatcatccagataaattttgtactcatcataagcttgcactgacaagggcaaatggaagtgattatgaactggccggtcttgcaaatgctgggccacattatgatgcaaagtttttttatttatttgatctggcaatactatagtgggggcatatagcgttctactttcattaaattattttactataaaaaataaaccagtaatacaatagcaaattatcttttccttatacaaattggaggttcctctacgagggaacctcatactaaaggcttatattataaaaaattatagagtttttgtcgatgtgtttgtccatcatacgacttctttgatcctgtggtgtattttttcgcccattggtcctctatgtgtgggtacttaaataaggaatccttccgcacggccttatcactaggtgtatgcatttgtgtcacctagctagatgtaatttttccaccttaatactttgtttttatataatggaacatagcattccagcctttgctcaacaagctacaaccaattattacagcctaacactcataatgagtgcagttcaaatagaattatagaaataaaagacaccaaccatgaagaagaaacaaaccaaatactaccaacccaagataaagagtacacaattattaaattatgtttataaacctccatccgaaattggcaaacagatgcataatcgttttctcaagattacgacatgcaatctttaaaagctcgccatcttcatcacacctttgtagttgtatccaagacctaagccaatgtattgctttgaaaattacccaaatatatgaaacatatggtgttttgtcaaaaatcttatcattcctattgtaccatagagcctaacatatagcagatgctcctataagtataatttttctatttttcttgtccactccctaaagccaatcatcaaaaaaatatgagatatgctattaggagggtatagaccaaaagataactgaactgctctccaaataaattttgcataatgacattccaaaaacagatgatgaatgggctcattttttatacagaaacaacatctcaaacttccattccaattcctccttaccaaattattcttagttaacacaacccgtttaagcaagtaccacataaagatcttaatcttaagatgcatctcatatttaacactttgttaaacttatttaacaaataactattcacaaaacttattctgcaatgttgatgccaaactctgtagtctgtactgttaaatatatgtcgaaggaaatgtgcctaattaaggacagctcctgtagcatgaaggcctctctttgtttgggacggctaccaacaacccaaaattagtctagcgcgaggtagcaaatactaggggaaaaatcagttcggatagtttccgatacccgcacgtattttagaaacggatagtctcgaatagattttttttttatagtaccggatttgaaaatgagtacagatagttttttttaaatggaaacaaatttggaaagacgagatatggtaattaagaccagtatccggtagaaatttgaaacggtcagaaactatccggattcttttccatatctccacaggtagcaatcaattttattaaaaaacatctcttttccatatatcagcaggtatcaatcaattttaaaaactaagtatatatgcataactttatcatataaatttagatgaagataaactttatattaaaattgtagagctagacaagatctacaactttgttgcaggcaactttatcatctgagattattttggggtttaaatattcgttaggaaataccatatgtatttttacaactcacacatacgattcaaatgatctctgatggagatgtcctctataacaaagtacagagctcaatgaaatctagtactattttatagtttttgattttttctttatttaagaatatttgaagcgcaaaacaaacattataggtttcgaaggggtaaaataagatgaatagtatcttcaatctagaaaaaaaaacttgctaagtgagatgataagttgtgcattgaggaaggtggtcttgggttcaatcaacggactaggaagttaaaaattacttttacactagcaaaatacccatgcgttacactatgtgaagccaaaaaggagtaggttgnnnnnnnnnnnnnnnnnnnnnnnnnttgatattgatagacaatttttttcatattgtaaagattagtcatagtagaagaaatgtttttggctagctatcagatcaagctcacttcactccaatcccgcaatcactttcactctaaatatcaaaaggaaatcatacaataaatggaaagaaaaaacttgatgtggttaggatatgtaaacccgattcaattaaaaaaacatgtaactgtttctattttacttataactatataaaattgtgcaaaatctaaatcaagagcgctctcgatttagccctaaccagcgaccttatcagctattgtccaaatacgatcagccatttgtccagatatgtgtctttaagaatcttactttaatatagtactaattgatcaagcaagtaaaaaaaatatttctaccatctatgcttcaaataaaattttctcttaaattactcatccgatttacaatccgattacaccattgtgttcgtaacaattaaatctttacaacaagactcacatgattatattttaataaaaaatcacaaattactttatatgttaattactttaaaactttattaaatttacttttatatgtttaagaagtaacttagtgaaatctaaaagtaagttagatatattataaaagtaatttatattttttcatcaaaatataatcatgtgagttcttgttataaagatataattattacgaatacaacagtgtaatcggatcgtagatcggataagtagtttaagagaaaattgtattactattttcatagataatagatggagtgatagctctgtgtagtcacgtctataaaactgcattactatttctccaattcctatttaagctggtgctgctccagcgggaaaagcaaggtggtattattcgtgctacaatactgcgatgctgctgtgatcggttggtacaatatcgtgctgtactgtgtcgggctgctgcgatgtgggctggctactgggctgcggctgctatttgctgctgcttcgtgctgtacaatatcgtggagtagctttctatttttctctttttctcttttattactagtaaaagtgcccgtgcgttgtaccaggtggtgattacagagtgtgtatactgtttggtttagacaattaatctgctaaaaaaattatttgtttttggataaataatctgctatatatttgcgtaatatatatggtgtttagtttggatgatgtgtagcatgagagaaaatggatagacgaacaatgcgactgtctttacccaaaaggcgacggatgaaaatttgtatgatgaacggaacggagtgtgtacagtgaccaaaagatgtattagataattaggatcaatgtgacgatcggaaaaatacaaatatttatattaattatagattgatagatagagaagagatagatattataaaactttcaatcaactatttatttatttatttaaaaaagttattaagaatttaatttgcgttaaataaaaaaaagttattaagaagttgattagcgttaattacgtgacccagttagtgggccgagccttctcgtgtgtgggtagactccatatccgccgctggaaacgaagcgacgcttcctcgcccttatcacaaacgaaacgaagcggttagagagaagagggggggggggggggggctcggacaatgagaagatttttttcgctcttttttaagacggactcatttttttttcatttttttttatcattcacaaaattgaaatcggattggaatttgaggaacagacgaaaatacgaacgaatagagggggcgacgaccggaaaaatctaaatatttatattatagttattatagatttgcggcgcttcacagtccatgtcgcgtgtccggattttgtaccgcgcgaatcagcaatgaattaggaatcgaaggcagataccgatggacgaaaaaaaaattacacaaacattatgtattttttattaggtataggtaggtataggtttagatatgggtctcttaaaaggatggatataaaaatagattttcgcaaatggttgatggaccgcgtacaaaaactgaatatataaaatttagaaatattgacctattgttgtaggaaaataataaagcgatatgtcttcactaactaagtgtaacaccctgaaaattcgaccaacgaaatcaaaacaccaaaaatacggattttcaaaaactttttaagtaataaattgcatcatgccgattttattcgtctatttcattggattttgatctcggaatttattaatcgcgaataatgaataactaactaggaataaaccctaaaaatcaagttggctaaaaaaataattaaaatataaattaaaataaagattaggtgggattggaaataaaaaaaatattatcacgaccatattagcaataattaaattttagtacgatggaatgagaattaaccctaattaaaaattcaaataaattatataaacaaaataggagtgatattaaattagggtgaatttttagttaggataacacaaatatggagtaaactttgtttatgcaaaaattagaatttatagggctatatttaaatagaaaatgggctaaaatcgggataaataggaaaagttactgttcattgcggcataggtgttcgatcgtggtccccctagccccgccccctcccttgccgcgtgcgccgcgtcgcccgcccgtagcgcgcgccgccgccgttgccgcgccgtcactgtcgcgtcgccgtcggcctcgcgccttgagccgatgtgcgcccgttccctcgcgcctacgccccggcgagtggcccgacccctcgacgacgccctgcgccgctggcgggccgcccgttccatagtgccgagccccgtgccaccgcgcgcgtcgtgttaccccgcctgtaacgccgaacgcttgcaaccgccgtgtctgcgtcccattgcggatttagccctacgccacc

SEQ ID NO: 65861 - DNA, 1384 bp, Oryza sativa
ttaggaccaccaattgacttgcttgctgttatgagccatttcttttagtagtctctattgacaatactctactactattattatcaccaatagaagttatcttaattgttgatttatgagttctaattaatatcagtagaataaatgattctattactgtacttgtgaggtgacagtataaattgatatgatctattggattagaaaaaatgaacgacctagattgattctactacgagcacagaccagtataaagaaaacttttaattatgtgctattgcttcttgtaatgttggggaaaaagaccagctgggcttgatagtgatagttactcctaatttatcagcttctccaacttgctgtaatttgtaagcatgcatgcatcgacaatgatgaaatttggaaatatgataatactaatataatatgaattgccttcttgttttggacatgtgcttggttggtgactagggtaattggcttgaacgtaaagaccagactgaaaacttttgaaaagagttgaatttggttcaacctgccgattatatattctggaatttacatcctgattattgatacaattaggcagcagcacatggacatgatatatatacacatctactacttagaagaagcaggcaaaaacacaagatcggtggaggaactatgattgaaatattgaattaaccaaagtaaacgcaatagaagcttcattattgatggtccaggagagatgctctttccagtggccaagggggtaccttacttagctagatgtgttaaatcagcaaccaaacttgacttgcagcgtctttgccgtgtcttccccgtaagtgtcgtgcatatgccatcggcgttttcattgatagatacagctctgcatctactctcaacctcaatctttggacactgctgtatattacatggggtatatatatatcctctctgccttccttctcccagttgcagaccaaaggagccagagcagcacaaatattgagaaaataaggagaccggccactgaagagcatgccttctctctacatattccttgggcttcttctcttctccctgcaggctcctccatgtcctgctgcaactgatactctgaaggcaggacaagtgctctctgccggtgacaagctcgtctcgaggaatggcaagttcgcgctcggcttcttcaacccaagcgcaaacatcagtaagtcatctgacaacatctcctccagttggtacattggcatatggttcaacaagatcccagtttttactgtcgtgtgggtcgctaatagggagaggtcaatcgctgagcccgacttcaagctaacacagctcaaaatatcacaagatggcaatcttgccatcgtaaaccatgccaatgaat

SEQ ID NO: 65862 - DNA, 695 bp, Oryza sativa
agtgcttgaattagagatatagcatttgtaaattgcctattgaaatatgccaccacgtagttatccaataaagtgccagactaatgtagtactacaatatttccgaacttcccttaggatgatgccatgtactattaacattttgtatgcacagtgtaattccgttcgcatcctgggtgatctcgatgcccagatatatatagtaagataagaggccaacaaggtcactcatgaggaatacctgcttcatttgagccttgaacatgtcgattttttttttttttgctgctgcagccggtgctgatgagattgtcaacgtacacgccgacgatcaaccgcgaagctcggcacacgtgtagatgctgtgttctgagtcgctcctcctgaaaccaagtgacaccatcgaggagtctaacttagcttggtataaaaggtccttactattttttttaagtaaattgcactagcggtccttagacttgtaagcaaattttatctagatccatgaacttgcaaagtgtgtatcgaagaccctaaacttggtttattgtatcatcccaatgaaagtctcatttgaccgtggtcttacttacgtggcatgacatgtagatgacggcatggcacatcatcatcatcacatgtagatgacggcatggcatcatcattattattattattattattattattattat

SEQ ID NO: 65863 - DNA, 675 bp, Oryza sativa
gtattaatagtatagcaagcaactattgtatgaattgactattacattggctatacttggctatactattaaacttgctctcgcaccatctttcttccagcaatacagaaaaactgatgtcagagggctaatagtaaatagatttttcatagagtattactactactgctagtaggagaggagcgaagcagcagctccagatctgtgggtgtctttgggtgagtgggcaaataaacaaacaaaagtggcaagccaagtagccaatccgaacgcatccccgtctttctttctttctttctttctttctttgtgcccaactctgacacgactcacagtttttttggcacgagctgaaagcctcaaagtagtaatggtccagctgctccagcactcgcatctgcacactgtattcgccgccgcgaccaccaccatcggagtcggacagtttccccgccgccgtgccaaattccccacctcccttgttcttcttcctcgctgcacctcctcctcctcctcctcctcctcaggtacctcatatatagcttccacctacttatccttgccccgcctgattcattcatacgaccacttctttctccggatcccctctcctctcctagcttcttcctctatctgtacattcgcaatatcccatcccatcggatcggattggat

SEQ ID NO: 65864 - DNA, 699 bp, Oryza sativa
aaaaaaccatttacgcccttgctcatttgatcatacttctcaatggtttttgtttcaatataatcaatatcgacaagtgtttgatagtgataatctcataactattacatgagtaaaaagttctaattccaacaaaaattttcaccttcatcactcgtcgcacgcacgcctgctggtggatcccgctaccttcaaccgttctgccgcccgtcgcccgtagttctctcgtttggatcgaagaagagaagcaccagccgtcctcctcgttcggagcgagaaggagcggcatcatcgccaatcgtcctccttgttcaaattgaggagaagcaatgtcattgccatcgtcgtctccttgcccttactgtatgccggataatgccgtcgctgccgatgcatatagcttgtggatgggaggttgtgccgctgcagccaacatcctcgccgacccgccgctactagttccagagcttgcacgcctcgactctatcgaatccaccgcccgggcctcctcatcaccggatccgccctgccactcctccttctcatcgcctgcgcaacaagcctccatttgatccacctcaccactgctgctccttgtcactgagccaccaccattgctccttctccttgtcgcacgcaccaagccttcatctgatctgcctcgctgctgctccttctttcctcgagccgccgccacct

SEQ ID NO: 65865 - DNA, 1214 bp, Oryza sativa
tattacctgacctgaattgatggtctgcacagatcctacatttgcacatcgtgctccatgtggctggccgcaggacaaggtggagtccgccagtgatggaggttgtttgctatttttcatttgctcgtcgtctctatgacatgaacaataatgtttttgctttttttttgcgcttgctagatgatggatggctgctactgcgcaacgtcgagcccatctctataccatgctgctacatcctcccttgattccatcgtcgcgtaccgttcgccactcggttgctctctccactaccagtcacaagacacagaccagcctctccatccttatagcaagatccagcaaagccaccaggatgtagtttcacgatggatttttggatgaatctttttttttcttttctagtttgattcacctgtgagtaatcttatcacttgtgtgtgattgagcctgtaatttttttcattcgtacggccattttgtgatacagactaacaatactcttagtatcagtttttactttttatactgtatattgaacacaccagtaaacatattactacatagtggatacgagatcatgggctatatagagagagggtggtaattgttttactcgcagaccacgaagcctcagtttttacccttatactgtgtattaaacacattagtaaacatattactacatggtggctacgagatcatgggctatattgagaggacggtggtaattattttagtcgcagaccacgaaatctaaataatatttataacactggtattcttttacgatcatctaggaatgatgcacgtacaatgtgagggcattcgtgcaagtaaatttgttaggtattcttttacgaccatctaggaatgatgcacatacaatgtgagggcatttgtgcaagtaaatttgttacttttgaaaggggcattcatgcgagtaaattcgttacttttgaaaaactccacaaagtaaattcgttacttttaaaacgttgtgaaacattagaaaaatgaacttggaaagaaaaactaaacggatggttaatattttaccgggtcctttgatgaagcacagataagatggaaaagagaaaaaagaaacacagaaggtggggtggtaaaaaaaacgaaaaaacgaacgagggagcattgtgcggcgctcgaactaggattagcgataccggacatttagtataataactatttga

SEQ ID NO: 65866 - DNA, 9284 bp, Oryza sativa
acactttaattgtatagatgaatatatgttaagtaatatagaaatgatggatatatatatatatatatatatatatatatatatatatatatatgttaaaaatattgtgaaaaaataatgtgaagaaaaatgattggatgttgatatgtagaattcaatgaattatagatatgttgcatgcttgcataagcttgtttgtaattagggtaaattgaaatcatgctattataattttgcaaagtttaagatatgtcatcggtatctcaatgacatgtagaactcatatgagtcaatgacatgtggttcaggatggtatatcttaaattttgcaaaattataatggcatggttccaatttttccttgtaattattactagtggacgatgaggtggcatgttatcgcgctacatccatgaattttttcagtttttttcgattttttccggaattttgaatttggtcaaaattcatccaaatcatatcgccggtttcccctaccgtacccccgcgataagcgtgataagtgatgcgattatcacacgataagtgaaaccctggtccaactctaaaatattttatattttttattagatgtttctattaggtgatttattttttgaccaatgtagattataaattagtgtaaaattataatgtcattatagctcctaatagtcgttgtaccgctggaaaacgtctttttctagtatagacaaaaaatattttttacatgagttcttaggggaaaaggaacttacgttaaaatggtaaaaagcttagaaaaattgatgttttctgcatgctttttttccctaaacactaaaggaagcagggagtgtacattgcgaagaagttggattcttttgtctattatatcaatcaaattattattagtactgacggagcgtggggctcctcaccgggagaccgcgcaggcccccctttgccggttcggccgggggcgctaagtgaggttctaagccctcggtctgtggaatattcgcgagagaggcaatgcacgagacacgggcgatgtagacaggttcgggccgctgagaagcgtaataccctactcctgtgttctggtggatctgtgtatgaagaaactacaaagagttcgagagctagaacaagtttagactctagaactcgtttgctcctcctttccccttttttcttctccgtccctctctttggtgggcaaggtcctccttttataactcaaggggataccacatgctccacttctacctactcttcttttgggtggggacccaccctctcttgaccaaaaccccgttcgccttctcttggaagctaaaatatagcttgtctttgagtgtggcccagcgtcctcactcgtctgacataggggatcaccctgtcattccttcattaatgggcggagatttgcaatggctgctatccgaatgaccctccgatgggatgggtcatacctacctccactccgctggaaggaggtgcaaaatgggtgcgcggttgtctgcctatgacatgaccagcgtcagaccagtcacagaccggtcattcttgtccaccacgtgtcagtttagcaagctgcatgtctgcccttcttcatacaacgacttccttgcaatggttgcgatgaagcctggaatatatctgggcgggactaacgtgccaactccaggagctagcacgccggctccggctagggacgagtgcctggaggctctcatcaatccgacgggacggggcgaggcgtgtgtcaggccgcctgttgccacctaacccgcgatctgaccggtctgtgaccggtcacacactgcgaccggtcacggaccggatgagcgctgcgctgcattaaatgcggcgtggcgcgctcgtccaaaccgcaataaatgcggttaggtgagccctgctgtgctcacctaaaccatacacgtggcgtcaaaaccacagggggtcggggcgcccctgccctcggggccgaaacgggagcggcccgacccctcggggagacaaaaggcggggaggtctcgtcaccctcgggcccgacccgggccacgtgggtgactgcggctaccctaacctctagtcatgataccctcggccccatgtcatcgacagtagcccccggcgtcacgccagggcgatcgcccccctcgagggaagcgctcgggcgtgacgccattctttagatctggtgacaggtggggccggtctctacaggcgggtaggaactcagcggtcgcaagtcgcacgcattggcagggaaaactgatcgataataatgagcggcctcttcgagactgccacatcactcgagcagcgcgcgaatcgggacgagtcagttcgtttcgcctggagacgtgatgatggcgcttcggtcggcgagcgaagttaacgcgcgcacgatatgtcccatctcgactgccacggcctcgtgcgccgcaaacgggcgagtgggattagcagaggcgtgggcgcaagaaacgagggggcgagatagtgggcgcgggaagcgaggagccgggcagagcgttggcaagggtataaagacgccgaggaagagattcgtttccttcctctcgccattattccccttgccttcgccgcttgcgctctaactcttcgtttcctgtgccctaccctcgccgcactcgctcgttctcaagttcctcctctgccggcgtcatggcacggggctccgcaccgctcgatggtagcgtgctgccgccttcccgcatcgtgagcgagaggcaggctgggctaccgcgccgcttcatgccggaatctgccaccggccgggagatggtcgcgctgggcgagggacgcccggcgccacgttacccggggcggtccgtcttcttcctctcttttgcaatggcagggctagtcccgccattctcttctttcttcatggatgttctggagcattatgatctccagatggcgcacctcacccccaacgcggtaatgacgttggccatcttcgcacacctgtgcgagatgtttatcggggtgcgcccatctcttcggctgttccggtggttcttcaccgtacagccagtgtcgccgccgtcggtggtcggtggctgctacttccagccgcgggggccggtgctgagccgctacattccctgcgtcctgcgcaagaagtgggacgactggaagagcgactggttctacacccccctcgccgacgaagcgcgcctccgacttccgagccagcccccggcgcaggcctccagctggcgcgtgccggtagatctgggagacggctacgacaccgtccttgaccgcctggcgggcctgcgatcctaggggctcacgggggccatggtgtacgacgactaccttcgtcgccggatcgcgccgctccagcggcgcgcccggggcgcctgggagtacaccgggtcgaaggactacatgaggacccaccaggggggcagatgggactgggcccctgaggatttcaagatggtggtccaacgggtgctgaatctcagctccgtggaggcgtccctcatcccccaaggagtcctccccctctgcagcgatccagatcgcgccaacatcttgaccatcatgatggcggtcggggcgtcggaggagcgggctcctcgaggccacgatggcgcgggcgggagccgcaggggggaacaatctaccccaggagggggtcgtgcttctgggccccgcgacgggggcccggggggcagccgccctgccgacgcccgggggaagaggaagcaggagggtaccccttccccatctcctccccgagggggcggggcggtgcgtgctagcagcaggcgctcggaaggtgccgcgccaacgccgcagcccgagggggagcggaaaaagaaacggctccgcaagatgggggggaccgagccaagccggggaaacctcatctcccccccaaggtggtcgtttaaccgacctcctcgcaggttcgtccccgcgcctactacggccgaattcattctttcaaagcgagttttcacttacctgtttctttttgtcttctggtttttcttctgcttcagcgagatcccgtcgcgcccctcccgccattccaagtccggccggtctgaggccgaggatacggcgaccgcggaggcccggaggcgggaagctgaccggcgagaagccgcggaccgccttcgggaagccgaggaggctgcccaggaggccgtccgggctcgccaggctgaggaagccgctcgggaggaggccaggctccgccgggccgaggagtccgcccgggaggcggaggtggcacgcgcacgccaggcggcctgccaagcccccgacccgactccgcccgaggcgacgatgacttccgaggccacccacgactaggccgcaggcgcaccgctcgggcccgactcctcgggcgacgctcaggacgagccaggttcgggggacgtccccgagtccggcacgtcgatcggcgggccgagccgtgcggcattctcaccgaggcggctctctcccatgccttccgctgccccactgagcgcggagccccttctgcaagccttggccactgcgaacaccacggtgttggatgggttaaatgcccagatggaggtcctgcaggcagagcgggcggagctcgacgcggcgtgagcgcgtgtcgaagaggggcaatgctcggtggaggccatggtggaggcgggccgcaaggcacaccgccggcacacctgagagctcgaggcccgtcggaaggagctggcggagattgccagggaggtggaggagaagcgagaggctgccctcattgccaccgccgtgctgaacgaggcgcgggacgatctccgcctccaatacgggagctaggcggcggagctaggaaagaagccggcacacctgagagctcgaggcccgtcggaaggagctggcggagattgccagggaggtggaggagaagcgagaggctgccctcattgccaccgccgtgctgaacgaggcgcgggacgatctccgcctccaatacgggagctaggcggcggagctaggaaagaagctcgacgccgcccggggggtccttgacgccgccgctgcccgggaacggcgggcggcgaagaccgaggcggcgtcccggcggcgcgaagaagcccttgaggcccgcgccatggtgctggaggggaagacgtcgccggagaagcctgcttcattttgccgacgagatccagttgctgacgaaggtcgccgacttcctcacgcaactcctgaactgctgcttctacttgaggtctccaactgctcacttcgcgatctagcttgacgaccgctgcttgagtttcgccttgagcacgattcagcctcaccaaggactcctagatctccatcaacaccttgccgaaatcaatgttctgcttctccatcgcttcgacttgaagttgcaaacgggaagtatatcgtggcttctccaggatcgaaattgctctgataccaaattgtcacggtctcgaactcgtaggagagattcggtcgagtagagaagggaagagattgagagagttggcttgaggaagaagaagaagaagaacagaacagaattgaacaggagagagatggaattgaatttgagtatgtttgattacatgattcgatccccttcctctcaatcctgccggcttatatagcatcgcactacacagcctctctcactcactgacagtggcccagccaatcactactgggtccacacactcgcagggaaacgggagttgggctgcttctcccttctgggccgattcacaggctgggccgctggcttctgctttgaactccctgctacagatgttgccgccgtgacaaactacaggctatgacccatttgactaaggtggagtttattttccttttctttgagaggattggcagaaattttctcctttggttcaccgggtactaacggatggacactgctattgtttattctctttggttttatccttttgatcttatagcattagtagatttcagtttgtacgcagcaaacaccagtgaaggtgatttttgctactagcatagtagcaaatagttgaaagataaatgtatggatgtaatttatcacgtgcagcctttttgtaatcttcatagagctggtacataattttcaactcaagagtgatcctagtctggatatatcatttgtcctgtatgctgggtgggtgcggagttcttcgtggtttttgtttagagctcttgtagctgctaaattttgaattctgaaatgtgatgttgatgtatttagtgaatttggcatatcacaattgattctttgtctattttcggtgttatcttttattatctgattctaatgtttgctattccctttgttggaattttcaaagattgagacagaagatggttctgatgaggagtccgatgaatcagactccgaagtaaatgtggaaacagagctatcgaaagtcactgagatgcgtatcataccatctgatccttgtcagtgtatcctttttacagtaaattgtctgatgtaggagcatttattggttttccttgtataaatctacctctgatgcttgcatactaaattttgatatgagtgcaggtttacatgaaataactatcatttctaatgctctatgttcatttttcattagctctttatttttaatttattctcatgactgtagcaactaatagtcatgattagatttgtttattcttgaagagtaggtcttcactctagagggtactactttaagaatgtaatgtgtgcattctgttccttcacaagtaaaaatttgcttgtcttatgttattcagttacaaatggttctctgttgggattaatagctaatcaagaataaactaccttgcataattagtatcatactgcagatcatcatggcagatatattttttatttccagcagtttgaaatgctatttatttgaagaattgactaatactatttcttgaagcatttgtatcttctattatatattcacattatatcttggatccttgacagaagtttcagtggatggactctttgaagcattctcacattgtgctgaattgaaccccgatcctaatgctggtaagttttaatagttaataaacaataaaagaatgttctttgtttgatgtatgcctttttaattaccagagagtgatgaagagaatggctgggctcatagagatgaaggtgatgaagatatgactggtggtaagaattcgccctgttcatttctcttttgtgttcatccaaacgttatgcataatcttttatgtattatcttgcattcaggaagtgatgctgaatgtgagttttcagatgtcaacccgataggtcaaactgatgaacatgatattactcatgctgtagttgaggtatgctgttggtttgttctaccattatgttttatgctttatatgattctgtgaaacgattgcaagtgaaataaaactcttgtgttataagcttggttgtaaaggttttttcttttcttcgggctcctgtgaatataatctgtatttactacaacatatggtataggaattggtaatggcatcctctcacgtcattttatttagaaactacgaccatatgtatatttcttactgtttttgtcacataatatgttaaggtatagttaattcatatacagatataccgtgtgattcagggtggcagttgattatcctttcaaaattattataaacatcaaacagttactttctgaacagtttgatctgtatactaagataaaactcttttgttccttcccctgccaatctcatgagctaactcgaacaaaaacctcataatgtccttatgcagcttcagatcaatgaccaacgttttgaggatgcagaggaagcagaacatgagacgcatggaaatggacactaatgcaggtgccttgttattttcttctctgaagaaaaaaaaaactggtttgttgtacatcgccaatgatgcacattgttgactaaagacttattttttgtttgtttcttttccttcccttttgagatgtcacagattaactcctttgggccaccttgtaaacttgcatcaatggcaacgtatgggagaaaaaaggtcttgctactggtcaagaaaaatgtaagctgaaagcatgctggaggtctttgtatgcgttgtcttctgtaaaatacatgtatgatcatgcaacttcatattcagagatattttgacaatgtgctcatggaaaacatccatactttgtaagtgttcaagcttaattgtcagatttttttttatttacatccttgatcgaccaaagatgtatgctgatagctgagcaacaaacatttccttttctgtagcatttgctactgatgaatggtcctgtgctcaatgtccaaggacttgcagcagaatccgttagctcgttttattgctgtcagtattgttcttgtagacatttgttcatgatgaacttttgctcggttgagtatggtaatctgaaggttaagttattttttttacacgatttgaggcaatgggcagggagctctgtgttgaagggagtactctgttaaagcatgatttctttcgaatgtaggaatttgaaaacactggagtaagaaaaggcaggaattcaatttacacgttgttcaaacccatgctatgaaccctcaaggtttctatgcattggaattttgtagcgcagtcgtccttctatcccttcttccactgcacacaacgcgtccgcacgtctaccgaagggacacattaggtgatttcccacgctttctacggaaattgccaagtaacttctaaatttttttaatgatcgagctaaaagtataaaagtataaattatattagttattaacaacaaataaaattggtttgtcaaagtatgtttagagagaaatacatttagtatgagattgtagatgaaatatgatattctacactttaattgtatagatgaatatatgttaagtaatatagaaatgatggatatatatatatatatatatatatatatatgttaaaaatattgtgaaaaaataatgtgaagaaaaatgattggatgttgatatgtagaattcaatgaattatagatatgttgcatgcttgcataagcttgtttgtaattagggtaaattgaaatcatgctattataattttgcaaagtttaagatatgtcatcggtatctcaatgacatgtagaactcatatgagtcaatgacatgtggttcaggatggtatatcttaaattttgcaaaattataatggcatggttccaatttttccttgtaattattactag

SEQ ID NO: 65867 - DNA, 7535 bp, Oryza sativa
  unsure (1)..(7535): unsure at all n locations
attgatgatttgtttgatcagcttaaaggtgccactgttttctccaagatagatcttcgatcagggtatcaccagttgagaatcaaagaggaagatatacctaagacagcttttaccactaggtatgggttgtttaaatgtactgttatgtcttttggacttaccaatgcccccgctttcttcatgaacttgatgaataaggtgtttacggaataccaagacaagttcgtggtggtctttattaatgacattcgtatctactcccgaaccaaagaagagcatgaagaacatcttcgccttgcactagagaagctacgagaacatcaactgtatgccaagtttagcaagtgtgaattttggttgtctgaagtgaagttccttggtcacgtcatctcagccggaggagttgccgttgatcctagtaatgtggaatccgtaaccaactggaaacaaccaaagacagtttcagagattcgcagtttcctaggcctcgcaggatattatcggaggtttatagagaatttttccaagattgctaagcccatgacacgattacttcaaaaggatgtaaagtacaagtggtcagaagaatgtgcgcagagttttcaagagttgaagaatcgcttaatatcagctcctattttgattttgcctgatccaaagaagggttttcaagtgtattgtaatgcatccaagtttgggttagcttgtgttctgatgcaagatgggaaggtggttgcctatgcatctcgtcagttacgtccgcatgagaagaactaccctactcatgatcttgagttagctgcagtggttcatgcgttgaaaatttggcgtcattatctttttggtactcgtacagaggtgtacaccgatcacaagagtttaaagtatatctttactcaaccagatctgaacatgagacaacggagatagttggaattaattaaggattatgatatgggaattcattatcaccagggaaaggctaatgttgtagcagatgctcttagcaggaaaggctattgcaatgctacggaaggacgacagttgccattggagttatgcaaggaatttgaaagattaaatttgggaattgtcagtagaggtttcgttgcagccttagaagcaaagcccactctaatcgatcaggttagagaagcccaaattaatgatcctgatattcaagaaatcaagaagaatatgagaagaggaaaagctatcggtttcttggaagatgagcaaggaactgtatggttgggcgagagaatctgtgtccctgacaacaaagatttaaaagatgcaattctgaaagaagctcacgatactttatactccattcaccctagtagtaccaagatgtaccaggatctcaaggagagattttggtgggcaagtatgaagcgtgaaatcgcagaatacgtagcagtatgtgatgtttgtcagcgggtcaaggcagaacatcagaaacccgccggtttgttgcagcctttgaagataccagagtggaagtgggaggaaatcggtatggatttcatcactggcctacccagaacgtcatcaggccacgactctatttgggtaatagtcgacagacttaccaaagtggctcatttcatcccagtaaagacaacatattccggaagctggttggcggaattgtatacggcaaggattgtgtgtttgcatggcgtccctaagaaaatagtgtctgatcgaggtagttagtttacttcaaagttttggaagaaacttcaagaagagatgggttctaagctaaactttagtactacttatcatccacagacagacggacaaaccaaaagggtaaatcagattttggaagacatgtcgagagcttatgctttagacttcggtggaagttgggataagaatctaccttatgcggaatttttgtacaacaacagttatcaagctagtctccaaatggctccgtacgaagcactgtatggtcggaagtgccgcactccgcttttgtgggatcaaacgggagaacgtcaggttttcgggaagcagaagagaaggtaaagatcattcaagaaaggttgcgtgtggctcagtctcgccataagagttatgccgacaatcgccgcagagatttgagttttgaagaaggagattatgtgtaccttcgtgtcacgcctcttcgaggagttcatcgcttccacactaaaggaaaattggcaccgcgtttcgtgggaccttacaagattgtcagcagaagaggagaggtcgcttatcagttggagttacctcaatctttggcaggagtccataatgtgttccatgtgtcgcaattgaaaaagtgtttaagggtacctaccgaagaagctaatcttgaacagatagaagtccaagaggatctaacctatgttgagaaaccaatccgtatcttagaaatagatgagagaagaaccagaaatcaagttatccgtttttataaagtccaatggagtaatcactcggaagaagaatcaacttaggaacaagaagatgaattgaagtcagctcatccgcatctattcgccagttcttccgaatctcgaggacgagattccgtttaagggggtaggtttgtcacaccctaaaaatcctaaatatataaattgttgtttaattggaattattagaaatgattttaaaagcctagaagagaagatctaattttaattaataaattccaatataaaatggggccagataaaatttcattaaatactttgcttaactctataattcctagatttttctgggatttatttgagctaaggaagtatttttaatagatggaattgcatttaataaataatttaaattgaaaaagatttttaaaatcctcttttgacattgggccgaaagtcagcctaaaaccttctctctccctctccccggcccaagccggcccagtccgcccgcagccgcccgcccgcgcgtgcgttcgccgctgacaggtggggaccgcctgtcagggtcgtcgtcttcctcccgacgaaaccctagccgcaccgggccgccgccgncattccaaatctaaccgtccctttccgtttccggtgaaattgattgaggggaaaggatccccgtgatccactctaccttttcccttttggaaacatcgtctaaatcgctttggaaattcgcggattcgatctcgaatcggattcgtctctctctcccgaaccctaatatttccatcgcgtcgctggtcgccatgggcattcgccgccgcgccctagtccctatttaagcacccccaggtcctccgctacccgtcgccaccctcgccttcatctctcgtcgctggtagagccctagcaccgtgtagcctcgcgccgccgtcgccgccgccgctccagccgtgtgtcgccgtcgctccagtcgtcgccgtcgctcgggaagaccgccgtcgtggtcgccgtcgcgtcgccatcctcgtcggcccctccatcgttgctgtagaccaccggagcaccgccgtcgtcgtcaacccgaaggttgccgccggcgagcttgcacgcccgagccgccgctggtgatgacgtcatcgccgacgccatcgttgccatccgtcgtagaccggtcgtagaccgttaaatcttggccgtccgttgtggataggatcgatctcggccgttcgtttccgtgagccgccgctgtgcacccggttcaccgtgaaccctagccgctgacgcaataattcccttttccttttcaaaaataattccttattgcgtcataattcaattaaaacccatataaatgttgtaatccgatttaaactttaaaaattcataactaattcatcttagctcggatttagttggttcaagtctctaaatttttctaaaattgagatctacatgttaaaaatatccacatgtactgttcatgcttgtttatgtgctgttttggtgtttttgctcttttctgtttagattctgacgtttccggagagttcgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggagttaacctattgtttgttatagcccttttgttcttgattactttattccttgataccttgggatattataacttgactagttgagctttatatattggttcagctagatattagatatgattgcttagtcatgcttagaaacattagcacactattgagataacttataattcactattatttaatgatggcttaatgatagctcacgatggtcaatcgtgattggttaattaattaaactgccaactaaaacttgctaatggtgggttgtgagcacatggttttgatggtcgtgctcatgataattaaggaccggttcacgagttttggttgtgaaacattaactgtgccaaccacaagctagcgtgggcaacggctttaccttttgtatagcatggttcattgcggagcaccagactgagaagtggcggagataagcccacgggggtcgctggggagtccatgccttgtttataagggggtgattatgatccaggaacggtgcactgtggtggattgtgttgtgctaggggtactgtcacagctcctttctgaggtaccgtggtggtatcgaggcgtatcgtgacatgttgtagggctgtgtcttgtgggtacagtggtacatctctggccaaagtaaaactattcgaatagccgtgcccgcggttatgggcgggtctaacaatgtctttcgtgattagtttcacacttctcagcataataaaagatgctataactggtaataatttgattagctcctggtttggaatggtatattcctggtgtggagatagaactgtgcagccggaatggttgttcagaatggttgggcctatgcaacagggtatgttgtatagcgttggattaatattgtttaattattacctaactgttttattaaattctgaaatgtttgttaaatgctgtttatgcaaatgaaaccctactatgccatcctttgttatcctatgcacttgcatatttgctgcgtggcttgctaagtatgtcatatactcaccttgcaatcattcatcagaggaagagttctacagtgatgctgatggtgtggatgattaggcgtagccctagtcaagctgcctatggagaggagtcgtctgcgctgtttcttatttttttccgctgcttagatctttattgattgagaggaactatctacctctgtaatgacattttattcgcttattaattagagtaataattgtactctattatcaatttgttattgtgtgcctcggttgattcctggacgagggttcacacacatgtaagcgtttggaattttggataaaaattccgggcgtgacattgataaacacatgccctcccttgaagctcgtgtagacatcgtcgcttccgaggtcccgaagcttgccgagtccgccgcgcggaaggccattactgagtggggccgtccagccactgatatcacccacctcatctttagcacctactctggctgctgcgcccctagtgccgacctgcagctagcatcgctcattggcctccgccctaccgtctcccgcacaatcctcagcctctatggttgctctggtggtgctcgggcactccagcttgccaaggagctcgttgagaacaatcgtggcgcgcgcatccttgtagcactctccgagctgaccctgatatgtttctcagcccctgatgaaagcaaaattgtcgggcatggactattcggggatggcgctggtgcaatcatcgttggcgcaggccccttggctgatggcgagcgcccattgttcgagatggtcgctgcctcccagaccacgataccaggaacagagaacgcacttggcatgcaggccactagcagcggcatagatttccacatctccatccagctgccgacgctgatcagggataacatccaggagagcttgctccattcattctgttcggtcggaaacacagatcctaaatggaacgacctcttctgggcggtacaccccggtggccgcatgatccttgacaacatagagggtgagctctaactacagccgtggaagcttgcagcaagtcgtcaagttctacgtgagtacggaaacatgagtggcgcgacgattgcgtttgttcttgatgaactacgccagtgtcgggagaaggaaaaacaagagccagaacagcctgaatggggagtgatgctggcctttggaccagggatcactattgagacaatgatcctgcgtaacccattgcctcatggtcttatggaaaattaattaccactatcatgaaaagaatgcaaagggaatcaacacgtgatgcaccagtatttcactacgctatgataattaattaatggatgacactgattgttcacgcttaagtatttccaactctacttgttgcaaatataacttttattacttccatatgtcctctggttctttagctttcttgatttgtaacaaaatttgaaatacccttttaccgtgtcatttgtcagtatagtcgaattattacctctgtcaaggccctggtaataagattatgtattttttttatttccaaaatcgcaagaatacactgatttggggaaaatttacacaaatataccgttgatgctcttttgatgagcgagagcgttgcagccatgtcaatctcgcacttcgggagagagaaaccgcgatctcgctaaatggcggcgtgaaggttgttgaaattataagcacataataatttaatttattccataaataaatcatgatattgcagatgtaaactagcatgaacgtatcataagatctataacatgaacaacacgaacagatcaaatatgcgcaaaatattaaacacgtaccgagattgcggaaaaacctgttgctcggcaagaattactcgcggttgcgggcgccgacgaaggcgcgcagcacgcgagcggagaggaagacgagccgtcgcggacgaacagggagcagtcacgcaaaacgcttttcaaaaaccttattgctgccttctcccggtgcaagacgtcgaaggcagaggttccggagacctgctctcccgattaccggtgcacgccggcgagcgggatggagtagtctacgagcgacggcgcagcacagagtaggaggcaaaccctagattggtttcgcgtatgttgcgtgaagtcaccggctcggtttatatagagataggtcgcttgatcagggcgcccgcacgatctccactccgctaaccgaactggattagtcgcgcgtaacttatccggactccacgaacaaaactaacaaaacaaatccgaatttcccgcagcaaaacaagactgcaaaggaggctgcttctgcgcaagggtgaggaactaattgttcgggccattcgacgcgtacatcgtgcacgcgcgccgcctgtacggcccgacgaggcgaggcgagcg

SEQ ID NO: 65868 - DNA, 39199 bp, Oryza sativa
tacctagaaacttttttaaatgctaaaggggggttaggcaaggagatccactctcaccattgctttttgttcttggtgctgagttgctgcagagaatagttaacaaagcttgctccttaggtctgttgaccaagtcaattaatgaacttgatgagaggggtttcccaataatacagtatgctgatgacacttcaattcttctcaaagcattgcagagagaggtgttctgttttaaggcattgttgaattcttttgcacattctactggcctcaaagtgaattaccataagtcctgtctctacccaatcaatttatctcatgagaatgcagtgctttttgctggtctgcttgggtgcaccataggcacaatgccttttacttatttgggtttgcccatggggacaactaggccaagggtagtggacttttgttgacagaaaacacgaggcctgggagatctgcttaactccagtgcaggtccaaaactcgccttcggatgtgtgagcgtgccagttgatttgatcctgcaatcaacaataaataaagacaaagaaaccgcgattaatcttataaatgatagccgatcggctaggtgccgatgacatatcatttattttaggccgatgtcatgtgtagatcgatcggcagtcatgaataattaagaaagaactaattctactcgatcggctgtagacattaacaatatataactgttatgtcgatatatacttaaatcaagtgattgggataaatcggtcgccatgccgagacagtataaatcacttagatcgaaatataaattaacgacagaactatatacgttcatagcatagccgatcagatagatctagcatgtatcggctaatactccgataccacttcatattaagatattgaagcaagtagaatatatcaaatagaagcataatatacttaaatgcatcaagatcttaacacaaagggcggatttaacatatcaattaggcatgtaaggtaaaagaagttaaataaggtaagatcggctgaaaccccgatgctacgctaatcggcaaccaggaagcacgctagagattgatattctaagcacgacttaatagatcaaactcaactgatgcagcattaagtatgaaaagaagaacaatatctagacaatcaagccactggatgtttcatagagtggtagatactttatacaatccaagctaatatcgctatttaacctaatcgaccgccttctaccaacagatgttagccgattgtaggttagatgacgatattaccaaagattatacaagatatatgataacttggcgagttacataaacaagattagagtgtcataaagatggaagcactaatcccgagaatacaagccgccataacaagttttacctcttgttgaagatcgaaaccgatgcagctcaacccggaagcaagaacccgtcgaaacaaaacaaaagtaaaagggtggcgatgcgccgaaattgtattgaacgtgtgttatttattacatagggctcggggtctatttatacctgagaattacaagatatgtctataccggacatgactattatctctaacaaactccaagataccataagtctttgcggcagacttttgcccaaacatatctctaaggaaattacataaaatatcctaattaatagatacaattgccttctcaggactctatccatgcgtggcaatcatcttgaagcatatcaactcaaaccgatgatgtacaccaaatcgtatttttggaatcggctgtatcggctagccctgtctaactcgaactctgccgatcctgaccgtagccgattcggattgcagtcgattcttgctctgtttccacaacgatcttcgtcttcgattccacttcgacctaatcttcttttccgatgctgatattaccaaatctggttgttaacaactttgcacccttggtagacagggtagagagaagattaacagcaagctcacaatttctgccacatggtgggagattcacattgataaactctgtgctttcctcaatccttgataaactctgtgctttcctcaatcccaacatactacatgtgttctttgcagctgcttgtctcagtggttaaagctattgttctctgccaagaaaaattgcctttggaggggaaacaacccaacttcaactcgaagatctcttgcttcttgggatctagtgtgcagaccaaaggataaaggtggactaggagtcatcaatctaagagttcagaatatagcacttctgcttaagcatctagtcaaattttacaaaggacatgatctgccgtgggttcaactgatatggaactcttattataacttcaaagtgccacatttagtttggaataaaggacctttttggtggagggatatagtggctctatctgatgtcttcaggggaatctcaaactgccatatcagaaactgccatatcaggactggatcttcagctcttttctgggatgacatttggaatgataagataagaagcaatgtttttccatctttatatatggttgctttagataaaaccctctctgttaagcaaatgggttctactcctcttgaggattgtttcttactgcccctgaacacccaagcttatggagaattcactgttctagaggaggaatggtcctctctctttgcagaacggtaaaggtgatgaatggtctttcatccggaactgtgataaatacacagctaagaggttttataagctcacatactcaaatgtgcatgtgccaaggccttttgtctggatctagaaaacaaaatgtgtaatgaagataaaagtttttgcttggcttttattcagagacagacttaacataagagatatgcttgatagatgacattgtgcaaaggaaaacaaagacctcacttgtgaattatgcctgaataatatcagagagacaagagagcatctctttttcttctgccctttcagtcaacattgctggcagcatttgggaattgcatggaatcctgacctagaatttttccagatggtggttttggctcgcattcagttcaataagagaggtttcttggaaattttcttcattgctgcttggcacatttggaagcaaaggaatgggaaaatctttcgcaatgagcttccctcgttcagctcttggagggctttattctaagccgatgttcttctgcatttgtgcagaatgaaagatccactaaaacatattattttttattggttacaaacagtgtaatcctttgatctttttgtttcccttttgttctcttgtaatttgtatttataaaattacactatgaggcaaagtcctggcagtatttccagtcaaaaaaaattaattgcttcagtttagagagttttttcctacaggcaggtgagatgaccaccagacaccagcacagtagctcattacaagagcagaaaccagattgaagattgtttggcagctcaaactgcactgtgtaggcagtagcccttgcttgagaagtgatggccatgaccttgagcctttgatcatctggaacagcaacacttaggtacgcaagaagctcttggaagtggcgatatacattgtgtaaaatatccatcaattactattatccctttcatccatcagaattgtgttacttgctgtctacggtttaacatggcactctaccaccaaattttgttgtaaacatggtatctaaacactgcttgagcgatccaacaatttagcactcagaaaatctaccactaagttatgtcgacatttattttttcttattaacattttaagcttctagcaacaacataaaataggaatcaaactaaacaatatgcaggaggcgtgccattggtgttggtatttcttaacgacattactagaaatataattcctaacaatggcgcagaaatacttctaatatattatggttacatagtccatctgcaagcgcatggatataccattgtagcatttcacccgagagtattccatgggtatcgtatatattttatcccgtgggaagatcatgtagagagaactcaactaataatttatatattacttgtgataatcatattctaagcaggggttaagataatccaagggtagagtgacacacaagcagtaaacactcattctcataatatatcatctaagctaagtggaaagaaaagagaaagaaaatctatttctatacttctaatatacatagtatacatacattctagttaactgatatactagctaataccctctatcggatgccctcctggtactttgagaagccacccctgactgccgagttccttacaacaacccgtcatgaccatacaactggggctaaatacggaggaatactctccctagggaattaacttaggattatataccggcgcggaggaatacccgtactgagatgtcaccatcagcggcccacctctcatcctcaatatataaccccaaataatgatatcccgtaatctagacaccacgtctaaactaccagatactactctaatatcatcgtcatgacatagagtaattgcatatgcaaacattatacccgcaccaaagcatctcctagataagctagccgtatattcagtataacatgaacataatataaagtaggtactcatatacttgaaagtatttcaataccataaatgtatttagaagagtattctaataaaagtacaaagcttacaaaagagaagagaaaagctactagagccatacccgaactcttccgaaggcttccggactcctgatttctactctatccctattccaccagctagatactactaaactaaacttaagagaaatgagagagctattgcttgaggtgtgtgttgaagtgaagagagtgaactccttaaataggcaggtaatgacggttatggtggttagaaaggtcggtaataccctccaaccgccatagggagtgaatctccaccgttcccccaaaaccctgcatccagcggcttcacggtaggttcggccgaaccaggggccggcccaaccagcccacatttttgctggtggcctcctctggtattcctctcagtagacttgtgaattttggcccagtgtgtcgtgttaattctgagttcttggcccattcatacataagtctggttctcgacatcgtccgattgatttatcgtctgagttgatgtcgattctcctccattttattgtcattctctgcaaaaggttagtatacctactactagtggaatattattattctaacatatttatgctttgcaagcatcactagttctcctctattttggtaatattgacggtcgaaactgatcgataacgaccatcaacaattggcgtgccccgtcatctagttattagaatgtctagttaacagatcaatcttctctctcaattttccctccccttcatgtcgtacaaaatcgtaaagtggcatcttctcgcagaccatgatactttggattgcttctttccaatttcatttgatgtgctcaaatctctgtcagattctattccaaagtcccttggaatcaagaatttttggaacgagtgctgcgaatgtcttttgccacttgtctaatgtaacatgcctttggtgccgccttgtacttagatggaacactgggatcattgaagtcaaatccttgctgttcaagtgttcatttggagactctttaagtacatgtgttattatttgcacttctttggtaggcattccctcgcaagtaatcaaagtcctgaagtttcaaactcagtactttgtttaatctgctttgtgcgaacataaacagcagtaaaatattgcaattacatactagtgatttttgatttgctgatcttgtttgggataaagaaaattacctgtgtacagtttgttcatattttgcttcattatgcctaccactcccctggctggtgctgcactgctctgcctccccacactgcctgtacctcgctgctccaggacatataaatcttcctgctaattagcaatgatcagtagtccagtacatactcaagatcaaatcaatttttgggacctgtacaaatttcctgatggttccttctacaaaaattgaatgtgcaatatctgaatgttgcctatttttgcatgtattgttttgctgaaactgagtgtgaattgattcttgtgatttttttttacagtatgtcagttccatttcagaaagcttagaaacaatgtgatccaaactgaaatttagttttcctaagttgcactatgtgattagttttatctgtatacatccaaatgaaaaatagtatgcatctaatcttgttcacattgagggatatctctgaggtaattactgccctgctatttcggtatggtatgcatatattgatatatactggtccctgcttaatttatattgggctttacatcttcagaatagtccagaatgctttacatttcagcttttatgagctaaattaacatttgttcttaaataagttcaccggccttgaaatatacaagcatttgccagaatacattctaaacatctctcttttgtcgaaatgagcgtttttgtgtgtcgaaatgaaccggtaagaaccagtttggtatgctccgatctttttgtttgtttatgtataataacttaaatgatagtattattatttgtagaaactatgatgatgaaacctataacactttaaaacatgatgaattcaaaccacttttatgaaattgataatgatcaattgttggtggaagaggaaaacaaggaagattcttatgcataacgtatgcctggatcttattcaattcttatgtgtccaacaataggtgtgtcagcatggaattgaatttggattggtatggtgtgaacctttgatcccatatttgtatttttctttggacatttgagctgaatgtcagttgaattagacttattgtaaagcaaactttatatgtaaagagggcatatctgttaaaagatatttggttaattccactgacttgaaaagttattttttaaaaaggaaaatgtgtgctcctgcttctgatgatattctgcaatgagtatattcttgcagttgcagtgtattagagttcatttatattgcctaatggcatgcatagcacgtacacgcttactaatgtgtagcagggtttaccaaaccgtttgagggtaaccctacgtttgacggttactggctttgtttggcagccagttctgctgcagcagttgaaaatcgctgcagctggcagccgttttgaactgctgcagccgcagctgctgtcgaaaaatctcttccgaacacacccactgcggtaactgtgaggtataccgtggtttcaaaaactgaaaaggttatcgcatgtaataacctggataaacgcatgataaccatatggatagtattatgttgtatattattagaatgtcttgttaacaaacatcaatcttctctcaattttctttccccttcatgtcatacaaaatcctaaaaggtcattttccattttctctcagaccattgtactttggactgtttcttttggaacttcgaacacggctttggtacgtttgagtaaaagtgtacaaccacctaaccctccgtctcaaaaataaggatacagattcatagtatcatagtattatcttaggatgggggtgtcctatagtatggactaatatattaggatggtgaaaaatgacgtaaaccttgaattactattttttatttatttactgcgttcaatttaatttaaattaatctgtccctaacaatgtgatgctattaggcccatagcccgatacattaggccgtcccgtttcgaattttttacatttttaatttttttaatatttacagaaataatctatcggcgaaaaaaattaaaaaaaaatagaccctgccgccctccactcgggcggcaagctgacgtggcaaacgggggagggacgggcggtgacggcagacgggtggcggagggttttttgcacgaaaacccttgcgcccgatgcaaaaaagccagcccggacaggccattttgcaggcggccccttgccgccctctggccgggcagcaggcctcgctgcttataaaaggcctgccgccctgcccctagccctcattcctcccctcacacctctagtaaaaaaacaagaaggggggagaagagaagaagaggcgaagccctgccggattcagacgccgattttaggtaatattcatagatcctatatgtgactattgagttaactaatgtgtattttttaaaactttgtttgaataaatacattatatttttagggttttacttgtactaatctagaactgcatactgttagatatcggtaactatgtagatctgctagtttgaaatcaatactttaccattacattagcatacacaacaatatattacattgtaggcgtttattacatgaaagaataatatgatctagttatttcgttgacaaatatgtccaacaaacatacatttcaagtttaccatggcctaggaaacgtccgttacgggccaactggggtagatctgtcaaaatttattgtaacaccaaggggaattgatagaccggctgagaggagtgtaccttctataaaaggatggttgatgaggggcttgagagttgatccacagacaagtgacataacaatcaatgttatagtaagtcgggcaactgagggtttttattgggaactaatgccagttcaaaactctcgtatgtggagatggtatgtggagaatgcattgcaacgcgggtggcctctagctatggttccgtttgttcacccgaaggatctaggtgtgcagatgaacatggatgatggcgagggaccaagtgctgaagtaaatgagacttttgtggaagaggtcaacgcaccagaggaaggtggcgtagtagctccagtaggcattcaacctggttgagtagccaacgagggggagactgtcggtaccattgtggatgaaatggagagagaggattttgacaacgagcgtgtagaggaaggtggttcgtcagatgatgagacggatattaatccagccgaatgggctagtgaggatttttctggtctggtcgtctctgaagaggatagtgtgagatgggaatacaaagaaaatgaggttattcagggagcgatttatactagagcagaagaaatgaaggaggcggtaaagcattttgtagtgtcacttcatagagagttttgggttgccaagtccaatcggtcgcaatatgaagttcggtgtgttaaggaaaaagatgggtgtccctggagagtgcacgcttataagggaaaatggaaggattactggacagtgtcagtcattaccagcatgagcatttcagaaataccacaggtaacattacatgtgcatttgttgcatctgagatgtatgcgcatgtcatcaataatctgacatatgaaccaaagtcaataatccgacatatcgaagagacatacaagtatactattagctatgccaaggcgtggagagccaaacagaaaataatagagatgagatttggaacttacgaagcctcgtatgacaatttgccacgcctgcttggtgttatcaaacaaagataccctgggagctcttacgcagtgaagaaattcccctcaattgaacatcctggcaagagtgtgctgcaaagggtgttcttagctctacatgcatgcaagatggcattcgtgcactgttgtcctgttctctacattgatgggacattcttgactggaaagtatcggggccatatactaacagcaataggggtagatgggaacaatcaggtattgcccttggcatttgcttttgttgagagtgagaataccgacagctggtactggttcctgaaactggttaaaacagaagttgttggtatgaggcccaatgtgtgcctgatacatgacaggcacgccggcatgctgcgagcgatagaagagttgcagtttgggagtatggatcgaggataccctggtgaatgggaagatgtacagagtaggtggtgcatgcatcatatgtgagctaatttcttcaagcaattcaagaacaaggagctcatgaacatgttcaagaggctatgcaatcagaaccaggagaaaaaaattcaatgagctttggaagagattagatgagttgacagccaaatgcagttatctgcatgcagcgggaccatcgaccgccgttattgaccatcctcaagctcttggacctctcccaacagatagtccaacattggttagaagaactggagtagagatccggaaattttctcagtggattttgcatgaaccaaaagagaaatgggccaaggcttatgacacaggtggttctagatatgggataatgacaacaaattttgcagaagtttacaactgggtgatgcgcggtgtccgtggactcccactagttggcatagtagagttcattttacatgggacatgtaggtattttagggaccggttccagacagttcttccctctatgccgaacaacgacattttattcggaactttcatgcagaaaaagctagaggagtgatgtaaaaaggccatgaaacatcgagctctagtgcaaggtacccaacagcataggtttaagatactatgtcaagataaggcacgcaggggtatctaccgcaagagagtgaagcagggatgtgttctcaaagccgacggcacatgtcattgctcatgtgcaaagcctaagctgctccacgggccatgcacccatgtcattgctgccgcatcggagtgtggcataccagatgcagtatatgtgtcacagtacttcagtaagcaaacaatatatcatacatggagtggcgagatttatgggttcggcatagctggggagttcacagagactaatgatgaagtaatcaatattcctgacccatcgaagctccaaggcaaggctggaaggaggaagactcgtcacatccacaacgatatagacgagtcggaggcgggcagggtgaagcgctgtagcaaatgcgatgaacgtgggcacacctacaagcattgtcctaaagacaaggaaaaaccaagtgcagcggaggcaggactatcaggatcagtagcagatggagctcgccctacgggtgaaggcactacctcaactcgatcccgtcctagacgtcgtcgtgccacgtctggctacgtggtgtagttcttgtgttctatgttggcatgtggctttgcttgtaatttggttcaaacttatcgatgtgtttatgtttcatcgtgtaatgtcagacttccgcatgtaatgtctttaggtctcgtgatgtaatgtcagactttggcacctactgtctttaggtatcttgatgtaatgtcagacttcggcatgtaatgtctgtaggtttcgtgatgtaatgtctgtatgttttcgactgctcacctgtcgtgcagacgacgttgcttaggcagacgtagcaccacagcggccaccctgactaactagtcctcatctagttgcgcacgttcctaagccgactccccctccgcacggaggtaagtatatttaaggattttttgtacatgcctcgcacatctatgtgagccgattgatccaattgcttcaggatttcatgcaccgttcagcaccccgccttccacgggtaggccatctgttgtgcccctcacagctatttaaaaaaacaatagtacttcgacaatcaatttacatgcattttatgtcttagtttacaagggtcccgttgtcgatgtctaggtttcgcccagtttgctccgacgcaggtcgcccacttctcctaggctgcagggtcagcgtctcaggcagctgcgtcgacctcgcactcagcgcagttctggcagtacaccgggacttcgtcacaggcagtcggcacgtcgagtcagggtccaccactggacaatgctaggacctcgtcggactacggggtggcttccaccttgctcttctccatgagcgacttcgacttcgcttcagtctcgacagaggacgtcatcggcccctcacagctgggaggcgcaccgccggtgcagacgcaggaccagtcgccatccactccagcgccagacactcatgctacccgtgctgtgccaccgaatcgtttcacgtactcccaggaccacgtgcgagcacaggctcggaggaccaagcgtggtcgcggcgcggggcagggccagtagagcagacttatctttgtttatttactttacatgctagtactgtatgcttgtgtaatgaatacgttgttgttattcgggtttctcatccctgaacttcgctgttaatttttacgaaagcacgatatctttcggcacatgcatgacatatttctgccgcaccgatgcagcctcctttattcgcgtgcgatacgactgcggaatggctgacccaccagtgcccacatacaactttcggcgccaatcaggcgtacccaccatggcccgcgacgttgacatgtcagggatatcactgcgatttttggtgcctatataagtcgccttaacgagcgaggcctctgaagcatctaggcccccgttgttaattttggtaattaatgacaagcgctaagtgtggactaaccattgctattaagatatattttaagttaggtccacgtcatgtgtgcgcatggatgattatcgatggattaaaatttgatggagcgaagcgaagaaaagaaaacggtaaaactagtgctttagttttaaaattgatcgaggtgaagggcgatcaaatttgctagtttatttttagtttcgccgtactatcaaggggggtaatgacctagaaatgagatgattttaattgccacattaggtcattatgcatttagacttgtgctcacatttcatctcacacacacaattattcatctttcactgggatcgtcctgaccaggggcggtcagaccggccatagagtgacggtttgaccggagtgccccggccggtctgactggccccaagcgggcggtctgaccggcgcataaggccggtctgatcggaggcacatgcgcggtcagactggccccctggaggccaggatggtgttgctcggggtggccgatacagagccgacggagccgtatttggtcagaccgagctgatggcagtctgaccgagccaaggccggtctgaccggccactcactatcggtctgaccggccaggccgatggggccctctaacagcgctacaacggctcgttttctagccgttgcagagtagcacggtctgactggccacatacctccggttagaccgccagagcattgagttggggaatttcgcccccaacggctagttttggttggtgggagtataaatactccccctccagcagcaaggggctctcttggcacccaattcaattgcatacaccccttgcacctctctcacacccacttgagctttgtgttcatccatctagtgtgttagagggttaattagccaagagtcaagtgcatttgcttccattgtagagcttgtgtggcacttgattgatcatctccacgccggatcattgcttgttactcttggaggttgccgcctcctagacggcttgtggaggagttgcctggtgacctctccgagaagattgtggaggaggcccggcgtcggttgtgagtggtttggagttcaccatcttcggagtgaaggaagaactaccctagtgatcgaggcttgggtagtcctctccgtgggccggctcccgccttgcccaccccttgacaaagggggcgtgcggtggcttcgtggttgagcggtgtagttgggctcgcctcaacggggagtaggaaaccgacgagtttccgaacctcggtgaaaaatcttttgtctccttgtctcatttacttgttgcatttacatttgtgcaatttacatttctagatatatactagagaccatttcaccttaggattgctaaacattaacataggaatgtgatttactttcctagagatataattgagccattatcacgctaggtttgcaaaacataacttagttacttagttagagttgaccctcaccaagcctagcaacttaggttagttttgattaggtgtcatttagtttaaatcgcctattcacccccctctagtcgacatctcgatcctacagcctcacaatctttaataactcagtcacattcggtactctcttccccacttgcttcattacaaatcctaccagctttcgtcaatgggtagacgcctgggcattgaggatccgaattggcatagtgatccttgtgtatacctactaccaccttggtgccagcgtcctctctgcctatgcggtgactgatgccaactaatggcttcgaggaatcctgatattcgaggaaggcccttttttaggtgccctaactatgaccgtgaggtattttattatttgcatatgcttattcattccgtatgggcaattattttattcttcgtaatactactctattcgtcaggcccgcactacggcttgcgtatatatcgagtgggtcgatacagaaaatcccgttctcgacctaaccacttgtttacaagaaggatgctggtatttcgcattcgaaagtactgagcaatacttgcagagaaaagcggcttacgaacgataatgtcgtgaacaacagtgcaactagcgggtgctaactacggcactccctccatgggaagcccgtccaagatgcacaagcggtgatcgttgtcaggttcttcgttccataaagcctacgagattgggtcgaaggttctttgtttgtccaaatattcttgacgacaatttcatggtaagaatattttgattatcatgattccttattttctcacaacatttactaactttgttcgcttcacatctattctttcccccccggaaccaccaaggagatgtcaatagagagaacggatagacaccagaagggttctaactccacctagccgtgctgtgcagcttgaactaccagagcaatacagggatactaaagcgtggttttagagaggagagggatcctcacgtagggattagctattatcagacaacttggcatattgaaatttgtactttcatgcttccttgtcccattatcacatcgtcgttgtgttcaactcttgcactgcctccctcctagttcgaatataatatcatctatgtaaccgcaatggaaatagatgtatcatgttcaaattctactactatttcttcatgttacataattctccttgtttaagtctatataatgtttctacgaccgagattgcgataggcctatatcaatttcgtacactaatacgttgaataagttacaaaataatatcttacttaacatatgaaattgcgaaaacaaccaacttcaatatatttttaaaacattattaataagttttaccaataaataattctttaattattattaacataatagagaaaaatcatttggcttgtacttagtacgagccaaatgctctttagggctgcaaaaattgcatttagccccttgccgccctctagaggtggcaagggtgtaaatgcaaaatacgcatatggcaccgtccctcccccgtttgccacgtcagcttgccgccctccattggggcggcagggtctatttttgtaattttttgcgccgatagattatttctgtaaatattaaaaaaatttaaaaatgaaaaaaattcgtcctgtttcccattgtccatatcatacaatgtcttttctcaacgggccggatataacaaggtttttcaccccatcacatcgaatgtttggccacatgcatgaagtattaaatatagaaaaaaaactaattacacagattgtgtgtaaattgtgagacgaatcttttaagcctaactgctccatgatttgacaatgcggtgctacaataaacatttgttaaattaggcttaataaattcttctcatggtttataggcaggcactgtaatttgttttgttattagattacatttaatacttcaactgtgtatccgtatatccaatgtgacacggcaaaaattttcacccctggatctaaacacagccagtcatcatggcacgtttccttacaacgcctacgtttgaatcgaacaatgaaacgatggattatatggtactacctccatccccaaatacttgtcgtcttgagtttttgtttgtaaaatttgatcattcgtcttattcgaaagattatagaattattatttattttgtttgtggcttgttttattatgaaatgtactttaagtatgaattatccttttttatatttacactaatttttcaaataaaacgaatggtcaaacgttgcaaccaaaagtcaaagtgacatctattatgggacagaggtagtagtccatttacatgggtaagctatatttatatagtatttatgtggactggatgtttctatttctatgttgtttgaggagaaagagtcaaaacttacactataagtttcatatatttgcactataattttcagtattatgatgtaattggttattggtttaatttagtatataagtaaaaaaataaaaagtagaagggaaatattagggatggtctatgtgtcaaacaactttaaaaaataaattttataaaaccctatatgatggtccaagttttgcaaaattgcgtaaagtttggcacgtggcacatttctaggtattatggttataaagttttgcaaaaccacattactaatcattttgactttgatttaccacacttttaagatctacaatcatatctcaaatttatgagtgttatctatcatatagatgttacacccacgatttctattttgatataggagtatgtaaaaatggttaatggtgtagttctgtgaaattttcgaaccataatatctatggttctatgctacgcgctaaaatatatatggttttgtgtaatttggaccataatacctgtagttttgtacaattgatataacccaattagttaatgtgtgaaacaatagaactccttgtattattagttatcacagaacaaaatatattatagaattttttttatcacaaaatttcagataacatagaatgaccacatgttgatgagttgggaaaatggaaattaagaagtataattgtaatgtggaaccggagaagggagaacatcagaagcaaaagtacacgttatcttggactagtcaagaatatatatactgaccaagtatgcgaagttgatccaacaaaaattaacaccccaaatgtactgaggagagcttgataaatattttacgggggcttctaaactactccctccgtaaaaaaaaccaatcctaaatttgaatctacatatacactatgtacagatttaaactgaagatgatggcagcgagtcagcgacgcgtgtgagaacggggacgagttcagctgctgacgtgagtggaggaggggggcaggccaaaacatactcggaacaaaaacgggtcaaaaacccaaacctaactgcaagtcttggtacgatccaacggtcacaaatttggaaaaaaaatacaaatgaataaatcttttcattttcttcaactcttgctcccgattgaatctgtctccctcaaccataatactacatccgtcccaaaatatagctacatagtactaggaccagattcgtagtactaggtaatgccacatctagtactaggtagctacattttgaaacggaggaagtactgagtataacacctccccaactttcgaaaccagagcaaatcgagtctctttggatagaggtttcatccttcatgacgctcatgagactgtcggtgagaaaaattaaaataataacagcccccacctctccctaggccctagagcaaatcgagtctctttggatagagatttcatccttcatgacgctcatgagacctacatgttaatgagaaaaattaaaataataacagcccccgcctctcccaggccaggcccacttacatttggcaactttcatatgttgtagactgtcctcacagaccaacacaagtcttttctgcacactaggccaagcacgcttaacctcagagttctttagatatcggtttctggaaaataagttgcaacttgttgatgtaagtattctattaattctattaagccttgggccaagatgtcacaatccatgagccctgcgctgcatccgctggccttcgacccggttgccgaggtcgctagggtggtagacggcggccgacatcggcgagctcgcagggagtgcgggtaggaatagcgaggagctactatcctgaaattgttgtcgccgtccgacaaggcatcgttgccttgctcctctcctgacattcgatgggagtttcccggactaggatgccacatcagtcaaatcagctatccatattgtcttactacttcagggcctgtttagttcactaacgaaaatttttagcgtgtcacatcggcgatacggacacacatttaaagtattaaatatagactaataacaaaacaaattacagattccgcctaaaaattgcgagacgaatttattaagcctaattaatccatcattagtaaatgtttactgtagcaccacgttgtcaaatcatggcgtaattaggcttaaaagattcgtctcgcaatttacacgtaacctgtgtaattattatttttatttatatttaatactccatgcatatgccgaaacattcaatgtgacagggtgaaaaatttttgtttgggaactacacagggccttatttaacccggttttgaaagatggatgtttaataatttctgaagataaaggacctacagtgaacttattccatcccaaaacagtgtggtggtgtggcttggatgggccgggctgggcctcctacagtccggctcggtccaactatatatctctcccacctttatctattctattaacaaaaaagtgaaaaataaagaaaaattcattcttcttctccttctccttcttctcttcttggaggatatttcttccccctccgtctccggcgccgatctgcatccacccgccgagcagagaccagcgccgccgccgccgccgtccgttcctcctgtatcgcgtcctggtgagcatccgcccctcgttacgcacatttttttattcgaatttttttttcaagaatgaatttctgtgcgttaaccctagatagtacgtagcttccgttgtagatctggatctggaaagcttttctcttgatttgttcgtaatgtgatactaatagcagtttctttgcttgtttgtttgtttccctaaagaaatttcttttttctgggatgtccgacgttggagacgcccctgtgcagcgccgctcttgttcgaatccggccggtggtctgtaggattgggcggctgcggcggcggcgagatggacgacgacgccagcatgagcataagatgggggggattcttcgagtcgccggcgaggaacctcggcctgcagctcatgtcgtcggtgcctgctgagcgtgacaccaagcagctgctctctggtagccccttcctgcatcatcagcatcagcagcatgtcccgcaccaccaccatcagccccatcacccgcgtgactgcggcgccaatggcaatgccaatggtggtgctatgcctcctcctcctgccacggaggctcccccttcaatgccgatgaacttcgcgcgcagtgacatgtggatgcacccgcaacagcagcagcaacatcatcatccccgcgagcacaaggctcttcacaatctcactgttggccatggttcttcgcacattgcgcatcatgacccagtgggctatgggatgatccccggtacgcataccctgcagatgatgcagcagcaaacagagcctcaactgcaacccccaccaccgcctcagcagccaaaagaggaatgcatttcctcgccattgatcgaggaaaatgtacctgttattgatgagccaccacctcccaagaagcggcagcagggccgccaacccaaggtaccaagggctaagaagcccaagaagtctgctgctcctcgtgaggatggcgcaccacccaatgcaccagcaccacggagaaggggtcccaggaagaatatagggatggtaattaatggtattgatttggacctctcaaggataccaacgcccatttgttcttgcacgggcgcaccacagcagtgctatcggtggggtgcaggtggttggcaatctgcgtgctgcacaaccaccatctcaacgtacccactgccaatgagtacgaagcgccgtggtgcacgaatcgcaggcaggaagatgagccatggtgcgttcaagaaagtacttgagaagcttgctggtgaaggttataatcttaataatccgattgacctgaagaccttctgggcgaagcatggaacaaacaagtttgttaccataaggtaaaagacaatgaaattctaaaatttgttggctttgtaggttgctctgcagctgtttggtctgagtaattgtctgtatgtactctagattacaaactgcagaatccttttaggtgtaggttttaggcatgtcctgtccctttgcagtagtttacatgcctcatctgtgacctgggtgctgacctgtatggtggctatctgcatgtatctttgtcattatctttacaagtagcagtgtaatgcgacaatctctaatttaggtggcatgaaagttaatctgttcaacgtttctcattatgcttaagtcttctgttatacaatgctccattgcaatgcctggatgttttacagaatacaatatagttgctatctcatgaagtagaaacgttatctttttcatgctgtgttctgtatgcatgcaaagtttatatagcctatatatacatgtcttttcttttattgaactgatgtttgcatgcatgatgaatgtgggcaaaggttctgtacctaatctggattacttaaccagttctaataatatctttactgtgagcaaggttcttgccaatttcatttgatgtgctcaaatctctgtcagactctattccgaagtcccttggtatcaagaatttttagagtaaatgctgaggaatgtcttttgccacttgtctaatgtaacatgcctttagttctgccttatacgtagatggaactctgggaccattgatgtcatctttgctatttagtgattaccctttaagtccatgtgttattatttgcacttctttaggaggcaattattggctagtaatctaagtcctatgtttcaaactcagcactttgtttaatcaactttgtgcaaacagtaaacagcagtcaaaatattgcaattacattctattattttttgatttgatgatcttttttgggataaagaaaattacctgtatagtttgaacatattctgctctattatgctgcaagatatcaagctatctgcataaatcttgtcatcctgaaccttcaaaaaatacagtaatatttcacatgttatgcattcaaaatgttgatcctgtctactagggcaatttaactctgtcaaggctaattgcattataaggtatgcatgttctctattttttctatttgtagattacagagaaagtggtgccatttgtaataaatgatgttatgattcagcaattttcttttttataataaagtactataataattagaatgctgatatgagaatgaacgatgatgattaatgagcatcagaattatatgaaatgttagataattaattatcacaaaagctattttctttccaacttcatatatgctgaaatgtgggttgctgctagtttcgtgttgcctaaactgcagtgttacatgagaatattgaatgtttgcacatatgttttagaggccttgagtgccacaaacgatggacagcacctttttgtaaaatgtaaatacccagtaaaattattgtgcaaaatatttggtagtctatgaagccattaggaaaataatgtaattctgagcaaatagaagctaatagtgccaataccagagctattgtgatagatattgttcactgatatgatatgtgtgaaacgttataacttgagctattgcgaattgcggtagcagagtgtgcgatttatcagcatcatcatcgtacatctgggaatgttgtcttgggtgatctgtacatgtactctagttccatagatcttacatgctagcccctgctgttttttcttgatctgttctgttcttggtgtgcattcgccagaccgatgtatgaagatatattatctgcatttgttgatcgttgtacattttttttattttttgaaagaaaagtatgctatgtttagtttgctgagatgcaaatgcaatgcatcatcaggctagagttgatgatcaggctgagatgtggctgcaaatagtttttactgtgatgtttctcattgcttccatgttctcagttaccatggaagcagcagtattcccatcatcaatgccatggaattttgtgtatatgatgtgatatggttttccctactgttcatacttgatgtgttctaaatgagagtgtgacactacgtatcttgaagctacaaaatgaataattacccttttattctgtctatacatgattgttcctccatttggtcatttcattgtctcgtgtggtcttcacatggcttcattgttacttgctgagatatatcgaaaccaatctcgccatcattcatccattctgatgcattttgcagtagtgcttattgttttgttgtacaaaagattattatttattagtattgtatagaagaaataaacaaaagcagctctaataaggtgaactacagctgcggctaaaactgggcaagtttttgcattttaacttatggaaaatattgtttgtgcaactctccaaggaccaaagggatctgtattggccatgtttcagcacacggcaatgaggttcagacttcagaagtccaaactgatttgtgtcttcccttcccaccatgtactactgataatcttgcaacttgaaactcatcattgaccaacagtttcatcgatcagagcctattaacatgcagagagagaatatctaatagcatatgtggtcaagtttgctcacatcttaagcttttcttagatttctaagggcgtttacagtgtgccgttgtggctttcagccttactcccaggaaccgaatattcgtgtccacgtactcaaaccgtttggcctcctcaggaccaaagcacccatctttttatcctatggcaggattggtgtgtaggcagctcaaattcctagccccacatttctgccatacagcacccctttcatgaccctggtactactaaagaggaaggcaatgtttgatcatgctcctcctgcagtaaaaagagcacattccagctgggccttattgccttccctctctgataatgggctttctgatcaggagattttagatgttgcacctttgcaagcccagccatcaagtccagaagtcaccctagtagtgcttcagattcctatggctcctgtgaaaaaaaaggattggaagactatcctatacaatcctactagaaggtagagctctaggcttcttaatgccaaccaagagctcaaatttgatcatcgaatgggaattggcaaacaaaggggaaaatcggctaaaaggctgaagaagttggcaggtatataaaaaatccttatccctggcagcaaaattactgaatctgatttcaatgctctggaagatgatataaactcagattcttcccgttctgattgttctttatctttgttgcaaaagatgggggtggacctatgtggcctgaatcctgaggatgtggctgaataaagtttagggggagaaaaaaaggaagaagctttcccagccaaacatggatgattaggaatgaataatgtttctttgctcagaacatgatctttttgtttttcagtactgtcgaactgtgatcagtgtcagtgctctttgtgtttgcttggaacttattttatatggccctatgcaggctaatttaattagctatgtatctatatgcactcctaaatgttttcctcatgaataatgtgtttaaatcctggaatgtgctgtgctagaatataagaggcatgaatgctgatacggaactgttgtctttgaggcaaaagatagaggaaagtggttgtcaggttttctgtgtccaagagaccaaaaaacaaaatttctctttggctgatattaggacttctgctcctaagcgttttgatgcgccctcaaggggtgcttcagggggaatcttagcggtttggacctctaaagtgtttttaggaaccccaggggaaataaacagtttttctgttacagtaaactttgtttgaaggcaatcttcagaagcttgggccttaacttgcatatatggcccatgtagtggcccaaaacgtatagagtttgttatttggctgaaaaatatctcttttgggacaatggataacatgatttttctaggagactttaatttataccgatcggttgaggacagaaataagtcgggagccgacatgaacgatatattcatttttaatgatgtaattagttctcttggtctgctagaaatccctttaaaaggaagaagttttacctagagcaatatgcagaccagtctcctcctggagcggcttgattgggtctttacaagtccagcttggactttagttttcccaaacactactgtccactccctgacccggaatatatcagatcatgtgccctgtgtagttcaaattgataccaagattccaaagtctccaattttcagatttgagaattattgggttgaaatggaaggattctttgagcttgttagcagaatatggtcaatagaccctggttatgaagatccggcaaaatgcattagcttcaagttaaaatgtttgaggaaaagtttgctgcattggagtaaaaacttgtctaagttaactgctcttttggttaattgtaatactgtgatcaatttcttagacctaatagaagagcataggcccttgtccatccttgaatggaatttcagagaaattgtcaaaatgcaggtttttaagctccttgagtttaaaaggctttattggagaaaaaggtgcacgaataggtggatgttattgggtgaggaaaatactaaattcttccaagccattgctactgaaagatatagatcgaactccatttctcaggtgcaggatcagcatgggcagatagtcactggtcacaatcacaaagcagatttgttcttccatagtttcaaaaacagaatggggatttctctcttgcctccaatggactttaatttgagggatcttttccccaatccggaaaacttggattgtttggtggatcagttctacactcaggagaaggacaatcttattaaggtaattctatcagataaagcacctggccctgatgggtttaatgggttttttcttaagaaatgttggcaaatcatatcacaggacttctacaggttagcagctcactttcatgcctgctatactgatctgcagtcgataaacatgtcttacataaacttagtgccaaaaaagtcttctctagaaatagtaaatgattacaggccaatttcactgatgggcatcagtttaaagtttataaccaaattgatggcagataggctacagagtgtaatgcccaaactggttcatcaaaaccaatatggttttatcaaaggcagaacaattcaagattgtttagcatggtcttttgaatatatccatcaatgccagcagtcaaagagagaaataatattactaaagcttgactttgagaaagcatttgattctatagagcactctaccttgatatccattatgaaatgtatggggtttcctgaaaagtggctgcagtggataagatgattttttttcctcggcacattcttcagtactgctcaatggggtacctagaaacttttttaaatgctaaaggggggttaggcaaggagatccactctcaccattgctttttgttcttggtgctgagttgctgcagagaatagttaacaaagcttgctccttaggtctgttgaccaagtcaattaatgaacttgatgagaggggtttcccaataatacagtatgctgatgacacttcaattcttctcaaagcattgcagagagaggtgttctgttttaaggcattgttgaattcttttgcacattctactggcctcaaagtgaattaccataagtcctgtctctacccaatcaatttatctcatgagaatgcagtgctttttgctggtctgcttgggtgcaccataggcacaatgccttttacttatttgggtttgcccatggggacaactaggccaagggtagtggacttttgttgacagaaaacacgaggcctgggagatctgcttaactccagtgcaggtccaaaactcgccttcggatgtgtgagcgtgccagttgatttgatcctgcaatcaacaataaataaagacaaagaaaccgcgattaatcttataaatgatagccgatcggctaggtgccgatgacatatcatttattttaggccgatgtcatgtgtagatcgatcggcagtcatgaataattaagaaagaactaattctactcgatcggctgtagacattaacaatatataactgttatgtcgatatatacttaaatcaagtgattgggataaatcggtcgccatgccgagacagtataaatcacttagatcgaaatataaattaacgacagaactatatacgttcatagcatagccgatcagatagatctagcatgtatcggctaatactccgataccacttcatattaagatattgaagcaagtagaatatatcaaatagaagcataatatacttaaatgcatcaagatcttaacacaaagggcggatttaacatatcaattaggcatgtaaggtaaaagaagttaaataaggtaagatcggctgaaaccccgatgctacgctaatcggcaaccaggaagcacgctagagattgatattctaagcacgacttaatagatcaaactcaactgatgcagcattaagtatgaaaagaagaacaatatctagacaatcaagccactggatgtttcatagagtggtagatactttatacaatccaagctaatatcgctatttaacctaatcgaccgccttctaccaacagatgttagccgattgtaggttagatgacgatattaccaaagattatacaagatatatgataacttggcgagttacataaacaagattagagtgtcataaagatggaagcactaatcccgagaatacaagccgccataacaagttttacctcttgttgaagatcgaaaccgatgcagctcaacccggaagcaagaacccgtcgaaacaaaacaaaagtaaaagggtggcgatgcgccgaaattgtattgaacgtgtgttatttattacatagggctcggggtctatttatacctgagaattacaagatatgtctataccggacatgactattatctctaacaaactccaagataccataagtctttgcggcagacttttgcccaaacatatctctaaggaaattacataaaatatcctaattaatagatacaattgccttctcaggactctatccatgcgtggcaatcatcttgaagcatatcaactcaacccgatgatgtacaccaaatcgtattcttggaatcggctgtatcggctagccctgtctgactcgaactctgccgatcctgaccgttgccgattcggattgcagccgattctcgctctgtttccgcaacgttcttcgtcttcgattccacttcgatctaatcttcttttccgatgctgatattaccaaatctggttcttaacacatgccccccaagtccggaatatttgataatgtttcggatttgccatatatcgactccgagtgaatatcgcacttgccgttttctgaccgttactctagccctttaaatactaaccgccacccccgagaaacttcacaccgtttcctccgttttcaccactgaagcaagccacgttttctctctctctccagcgatcccctcggtgcaccagcgatttcaaggcgattccgtccccggttagatctccgcccccggcaatgtcgacttccgccgatccatccaccgcgccatcggccgagtacgtagaggtaagtacccatcggctagatccctttcttttgtagcagattgattttctctcacctcatcttgttttcttcctctctatccccatctgtaactgtagcatatgtccaatctggttgcgattccgagtctgtcgcacgagaaccactactttcttggtccaatcggcaaccttgaccctactgatttcatcactggtgaaaccaacagaatcccctttagattagccaaccttaatctgggtcactggaagaataccttcaaatcttggccatctcttgagaaaactacccctgagaagagttggaccacatggtacaagcgtgtatcggctagtaaggcagttcactgggatgagatcgggatcaaccaatcactttccctcaccatagccaattccgctaaggacgaatccctgatggctgccgccacctatttctggtggaacaccatcaacgccttcctattcaaccaagggccgatgaccccaactttgattgacatcactatgatcaccggattagatgtaacttcatcggccaatcctatgagcttgaacactaagaaccaatttgatttcaggaccaaaagcataggtggttggtctagttacgtagcagcatatatgggtaaagggcttgtcactccccgagagcatgtagcctttttgctgatgtggctggagaaattcctcttttgtggatcaagctgtggccccacaaccaattggcactttgtagccgaagccctagaatcacgattgacaatttcccttgggcaaaatcctcctcggctatctatatcaaatgttgaacaatgcatcggccaagatagccgtcggctcagtagttggggcaggtggaccatggtggttgctgcaaacctggctaaacttggcagttatgaaagttgtcaatcaaccatctgtgacagaagctgaattcccaaggttggagccgattgtggaagatgatggagaagaacgcactcatcgtagatgcatgtcatatggagaatatgcatatacgccaactgatgctggagcaaagttgtcggctgagctgcttaaggattggttctgcagcttttatgaaggctttcagaaagatgcccgggtttggtttccttatgaggactcagcagatcttgaacttccatcagatttcagatttgaagatatcaatcatgaaaaataccagaaatccagggaagttcttacggctgcaatcagcccatgcatccttcttgttggcattcattagggcagaaacatccaagtttcttatgaattttaccacccaatgagctcagctagacaacttggattgggacaactcccaatcggcttattctttgctgacaaaatccagtgccgaggagaaatttcatcaactctgatgatggatcggctactcaacatcccaggaccccccttgggcagtattgagaacatagagctggcaaggctcaggagctggaactttgacagatggtggggtgaatggaaacaacatatcttccatcaaccagcttccatgaacataatagatctgttccctgatgttatccctcaggtaaatctttactttatcaatcttgctcgaacaactggtagctgatttgaaccttgactaatcttttcttttgacctgcaaacaacagaatcctctcctcctcaccaaatcaacagtagcaaggatattgaatatgctccaggtctaattccaaatggaggtggaccatctccccctgtcatcggctatcacgcccccattacttcaaccctcctccaaggcctaatcagggaaccagccgatgcaggtaaggaaagaaaaaacaggtcatcggctgtggacacatcagctccggctcccaagatgaaaaccacatcaaagaaaaccaagccagctgatgacctgcctgccttggatccacccatcgaacaagctctggatgaagaagacattgaagatgatattgatcaggctgcaactgaagtgagcgatacagagagaacaccattggcttcgcccaagcaaactcctccaactccttctgctccgactcatttttcaagggtaagcagctctcctctgctccttttgcaatcactttacttatagccaactgctcactgatcttatagttacagaagaagaaaactgctatgaagaagaaatcggtagcaccaactctcaaaccggctccaccagtaagatattctcaatcctctcattaactgatcccggccgattatgtctaacatttgtcctttttacagcctcctcgtcctccttcacctcctgtgcagctagaatcaggcaaccgtactccatcggctgcagacagccacaacgtcgaagaggaagaacaaccagctgcccctgctattccagtaagtttttgttgatacaaatctgagatcggccaatcatgttttgatccttaaccatccacaatattatctcttgcaggtcttagccgatctgttctcatttgatatcaagaattatctcgatgaaacagaggaagacaccaccagtaaagctatagctcctctgtctgatgatgtaaagagaacgcttgaggatatctctcatcggctagaagcatcactagacaatttggtgaccaactgtggctcgatccgggcaaggttcacagatatccaagctctactcccggatgaactagccgatgcccttactctagccatctaccttgagcaacaccaattcaagctggaaaaggccagacagagattagccgatcgccgggagtgcaaggatattgaagctacaatccagcacaatcgacagcttgtgcatgtagagaaatccaagcttgatcagctgtctaagggcccgatcaagtcaaatatcgattggcttgaagctcgtaagattgacctcatggcacaacttcaagaatgcaacgccgagctggatatggagcacaaaaagttagccgatctcccgaagtctatcgaagatcaaaaagccagactcaaatcggctatcaagaatgttgcagatttgaccaagtctctgaaagtcatctctggaaccgatgctcaagatgcccaagctattgaggaagtagagcaaattaggcaaagggctatttcggctatccagcgatacttgtctcaatgaccttctgtgtaatagactttctatgtaattggctaaggtactttagttactttgctgctgattaatacaacttcgaaatttgctcaaaaatttccattatttgtatatatatgcccccctaattttataatgtcagaagcattgataaaattataaaaacaactaagggcgacatatttatatcgaccattgtacatcggcaaaccacaaccgattataatagaaaaacaactaagggcgatataaccatatcggccattgtacatcggcaaagcataaccgattacaatataaaaagaactaagggcgatataatcatatcggccatctcaaggcgatgtaaacacatcggctatcatgcatcggcaacaccagccgatcatgcgttaacccaaacacttgggtaatatttcttcaagtatttgccatttagcgctctgtcataaacttcaccatcgagtccttgcaacatgtaagcccccttagataccaccttatgaatttggaacggtccttcccaattcggcgaccacttgccgaatttgctatcccgagtcccaatcggcaaaatcaacttccatataagttcaccttccgaaaaatctttgggcactactttcttgttataatgccgagtaactcgctccttatctttgataacctttgctagggctcgtaaccgtgattgaaccagatcctccctctcatcggccataaggttggaatactcatcggctgttaaatcattttgcaattccgttcttctagagccgattctaacttcccatggcaaaatagctttatgtctataaacaagtttataaggaggaacctgtatcgagccatgacaagccatccgataagaccacaatgcttcggctaaacgagtatgccattgccgaggataatcagaaatcttcctcttaatcaacttgatcaaactcttgttagatgcctcggcctgcccattagcttgtgcataatacggtgaagaattcaacaacttgattcccatgctatcggcaaactgaataaactcatcagacacaaaaattgaaccttggtcagtcgtaatggtttgagggataccaacccgatagattatatgctcttgaacaaactgtatagcatccccagaatcaactttcttcaaaggaatagcctctacccacttggtaaaataatcggttgccaccaatataaacttatgtcctttactcgatggtggattaatcataccgatcatatcaattccccaacctctaaacggccatggtttaatgataggattcatagccgatgccggcgctctctggatcgctccaaatttctgacaatcttgacaacccttataatatctgaaacaatcctccagcattgtcggccaaaaatatccagcacatcgaagcagccacttcattttatgagccgattgatgagtgccacatatcccttcatgaacttcaccgattgcaacttttgcctgatcggtactcaaacatttaagcaacaccccatcaattgtccgataataaagctcgtcgtccaacaatatatacttcaacgctttatatcttaacttccgagaagccgattgagatggatcctgtaaatactgatagacataatatctccaatcatcggctgttataacagcaacttcaatctgaacatgtttgatcatcagcttatatcccgatgcgccttgggctagatcattagcttcaatattctgctctcgagatacatgcttcaaagttactagccgaaattccctcatcagttcttggcacttctcattataaactatcaacgtatcattcttgcattcatattctcctgccaattgactgatgaccaacaaagaatcccccatgatttcaatagtatcggcttcgacttccttgagtaactgcaaccccttgagaactgcctcgtactctgcttgattattagttgcataaggtttaatagtataggcaaactcaaagcatgccccccgaggggagattataaccaagccgataccacaaccatgagtacaaactgacccatcgaagaacaaagtccatggcacaacctcaaccgagccgatagaatcatcacgatagtcaacaataaaattggctatagcttgtcctttgatcgcctttggtgactcataccgaagatcaaactcagtcaatgaaaatatccactttccaatccttcctttcagaataggagccgataacatatatttgacaacatcagccttgcatatgacagtacattcattggacaacagataatgtcttaacctcgtacatgaaaaatataaacacaagcataacttctccacaggggagtatctagtctctgcattcaagagccgacggctcaaatagaacacaaccctctcttttctttcgagctcctgaatcaagaccgagctgattgacttatcaccggccgataaatataaccgaaaaggtattcccttctgtggaggaatcaaaacaggaggggaacttaaatattccttaatattatccaaagctttttgttgttctgccccccaggcaaattgctgatcggccttcaatctcaataatggtgtaaaaggttctaactttccagacaaaatagaaataaaccttcgaacaaaattaattttgccgatcatctcctgcaattctgtcttgtcctccggaggtttaatcttcttgatcgcattgatacttctctgagttacttcaatccctctctcatgaacaagaaatcccaagaactggccagccgatacgccaaaagcacactttgtcggattcatcttcaagccatatttcctggtcctctcaaaaacttttctcaaatcggctatgtggtcctctatttctttagacttaacaaccacatcatcaatatagacttcaaccaaccagccgattagatcatggtaaatgtaattcatagctcgttgatatgtagctccagcactctttaagacaaaagttatcacaacccattcaaacaaaccgattgcaccaggacacctaaaagtcgttttatgaatatcttcctcagccatgaagatctgattatatcctgcgtttccatccataaaactcaaaatcttatgtcccgaagcagcatcaactagttgatcggctactagcattggatattcgtcctttggggtagctttattcaaatatcggaaatcaatgcacaccctgaccttgccgtttttcttaataacaggaactatgctagaaacccattcagcatatcggcaaggacgaataaaaccagcatcatacaaacgcttaatctcagccttgacaggttcgagcatatcggctttgcatcttctcggaagctgctggtgcggtctaacccctggtttaagaggtagccgatgttcgacgattgatcggctgtgtccaggcatctcataatactcccaagtgaagcaatccctaaattctttcaagagctctatctgcttggttctaaattctgcagataaattcttactaataaatgtcggccttggccgatcgccggacttatatctatttcttccaaatcatcggcggacattaaaccctgtccttgtttgtcatcgagatcatctaccgtgtccttggtgtagacgtttgaaccctccatgacgccctcaaagcaatagctcgggttctccatcttcaattggctgtatatcagaatcacactttcagaaaatctccatcccaaactttgccggataagcaatcaaggccgtccatctcctaaagagctaaatcagcactagcaacattgactgacctgtcggctggcacgatttctatcttgtcgccttgccattgaatcaagcattgatgtatggttgaaggaatacaacaattggcatgaatccaatcccttccaagcaacaaactgtaagaacccttcccatcgatgacaaaaaacgtagtaggaatagtcttactgccgactgtcagctccacatttagaacacccatggtttctgatggattgccaccaaagtctttgagcaccatgtttgttttgatgagatcttcggcgtttctgcccaacttcctgaacgtagcataaggcatcaaatttactgcagctccaccatcgaccatcatcttagacatcggcttcccattaacatagccatttatatacaatggtttaagatgccgattctctgtaccctcaggcttttcgaagactacttgttctggcgatagaatcaacttagccgattcttcttctatttcatcaacatcggcttggtcgatcccaaattcggctggcaaggtaaaaaccatattaaccgatgcaatcacaacgcttttccctttggctaatctctttgcttcatcggccacagcttcatcggttacaggagtgtttcttaacgcgccattcctgcttcagctttgttttccttagccgatgattgatttcctgctcgacttcccgaaagcgctctcggtttctcattctttgaacccttctgttctaattctttgtaaatatactaggaggacaccactgagttttcctctttttgtcatcctccgggtcatgatcctgatttaccgggcccaacctttgatgaacagaaacccttgcatgcttcagccgattgcctttaatatacgactggcttgaactctctgcaacgttgccgcattcaggacagtcttcaatagatggcagcctcataccttcattccaacagaatctaaagaactcacaactctaatgaggatcgaagccatcatcatctttctcgtagcgcttctcctgttgtctatcgtacttcttttggtacttattgatgatcttagccgaattcacttgaaaaccccttgcacggcccccatcggccgttcggccagctgtatgcaccatattgacaggaaaaggattgccatcaaccttcatcggcctcttggaatcatcaaatttgattttgcctccttcgatagctgtttggatctgctgcttaaagaccttgcaatcattggtagtatgagatccagaattgtgccatttgcaataccttttcttgcccaattcctcagcggatggaatagtatgactagcaggcatttgaatctgcttctctcggagtaacagatcaaaaattttgttagcattggtaatttcaaaatcatacctctcctcttttccagaattcttcacccattggcatggtataacctttgtgctccttacccattcggctgcagctatttcagaatcatcatcctcatcatccgatccacacatgtaagaacagacattattaaccttcctagaattcctcctagcttcagcaaacctctgctcgtgcaaagttaccttttgtgtaagatgcgataagctttcaaagtcctcagatgagaatttctcccggatcggagcaatcataccctgaaaagccaaatcggctaactgggcatcagttaaactcaagctaaagcacttattcctcatctctctgaacctctgaatatattcatgcacgggctcgtcatgtttctgcttgatcactgtcaaatcagacaacttcatctcatgtaccccactatagaaatagctatgaaattgcttctccggatcggcccagctgttaatcgatccaagcagaaaaccaagtaaaagccgatccagccaaagacaatcgaaacaacctaaccctcaaggcatctacagccgatgcttcaccacactgagctaaaaatcggctaatatgctcataagttgatgtactatcttgccctgacaactttgaaaaatctgaaactttgaaccggttagggagagggactctctcaaaccattcaggatatggctgtcgatataaatttcctgtctcttttggtttaagcccaaactgttccctcatcacgtcagcaatcacatcggcccatggccgttattgagctgccccttgcgattgttgctgcctgggctcaaattgattgtactgtggagcaaattgaggctgaattaaccccccttgctgatattggtcttgcggggaagggagttgatattgataatttaaattgcccccctggtaattttggtagtttggctgaatatttcgcaccaagtgctcagggacaatctgaggtactaccatgtggtctggctgcatgtgatggaccaaatgctctggaacaacctgattcgaagtatgttgcccagctgatggattcatcaagccttgctggtgaatcggctggatagtctgctgtcttgatggcgtttgctgaatcggttgtacaatctgctgccttggtggcgtttgctgaactggctgcacaacctgttgctgaattggttgtacaacctattggattgggggtgtttgttgaatcagctgctgctggactgggtcaacagcaaattgaggtggtagaaatatggcagcaacctgatcttgcattagctgattcgcaacttgcccactatgctgcggctgctctctcgtcaacagccgaggaaaaagcgtgttgacagaaaacacgaggcctgggagatctgcttaactccagtgcaggtccaaaactcgccttcggatgtgtgagcgtgccagttgatttgatcctgcaatcaacaagaaataaagacaaagaaaccgcgattaatcttataaatgatagccgatcggctaggtgccgatgacgtatcatttattttaggccgatgtcatgtgtagatcgatcggcagtcatgaataattaagaaagaactaagtctactcgatcggctgtagacattaacaatatataactgttatgtcgatatatacttaaatcaagtgattgggatagatcggtcgccataccgagacagtataaatcacttagatcgaaatataaattaacgatagaactatatacgttcatagcatagccgatcagatagatctagcatgtatcggctaatactccgataccacttcaaattaagatattgaagcaagtagaatatatcaaatagaagcataatatacttaaatgcatcaagatcttaacacaaagggcggatttaacatatcaattaggcatgtaaggtaaaagaagttaaatcaggtaagatcggctgaaaccccgatgctacgctaatcggcaactaggaagcaggctagagattgatattctaagcacgacttaatagatcaaactcaactgatgcagcattaagtatgaaaagaagaacaatatctagacaatcaagctgctagatgtttcatagagtggtagatactttatacaatccaagctaatattgctatttaacctaatcggccgccttctaccaacagatgttagccgattgtaggttagatgacgatattaccaaagattatacaagatatatgataacttggcgagttacataaacaagattagagtgtcataaagatggaagcactaatcccgagaatacaagccgccataacaagttttacctcttgttgaagatcgaaaccgatgcagctcaacccggaagcaagaacccgtcgaaacaaaacaaaagtaaaagggtggcgatgcgccgaaattgtattgaacgtgtgttatttattacatagggctcggggtctatttatacctgagaattacaagatatgtctataccggacatgactattatctctaacaaactccaagataccataagtctttgcggcagacttttgcccaaacatatctctaaggaaattacataaaatatcctaattaatagatacaattgccttctcaggactctatccatgcgtggcaatcatcttgaagcatatcaactcaacccgatgatgtacaccaaatcgtattcttggaatcggctgtat

SEQ ID NO: 65869 - DNA, 10525 bp, Oryza sativa
  unsure (1)..(10525): unsure at all n locations
cgccggccgtcgccgacgccggcaaagaaagaatggggcggagatccccggaaaagagcaagaaagggggaatagagactcaccgccgccggcgtgcgcgggagtcaaccgccgtcggtcgccattacgccaacgcaggagagaaaagaaggggtggcaccgcgccgctgtgctcgccgggcgccgccgcacagcgctcgacggctgcgcgcgccggcgaaaggaggtgcgacggcgccagcgcgccgtgccgccgggccgtgcagccgccgtgccgccgtcgcaccatggctagggtttcggccgagagaagagaagagtggctagggtttggccagcggttgggggctcgggttttgctctcccgatctccccgcttggccgtctgatcgaaaccctagcgatcggacagccaacgtcggccggaccgcttttggcccaagagggggcgcgcgctaggcctctttcccggcccaggcccaggttgcggcctagagaggggtgagagcccgcatgtgcatataccagggccgccagagtccaattttggtccctcggggccgaaagaaaaaggaaaagagtctatttttagtccctgtttcagatgcatttacaattatagttattaaatgtgtttatttctaagcaatttgagccaacgtgaaaattgtttagagaatagataaatgtgagaaatgcttctgaacatgtattttgtatattttcatgcaaattacaatagaattttgaattgtttttgcatgatttacctccgtttaagatttgaaccgaagggttaatttttacagagtgaataacagaattttgtcattgtttatatgaattttatatagatcttttgctgcaaatagatgaaattgatgaaaattagtgtttctaaaattaaattttgaaccaacgggataatttcattttaggaacattaattatgtgctatgatgttgtaattttctaaccaacgttgataattgtaatgttatagttatggctctatgtgttatgtctattttctgcccaacggtgatgtagacttaatacataataattttaatattaattttgttctcacaatacatgattatctcaggtggctactccttgatgggttacattaaagatattccgaccctaaaaggatataactatgaagaatggaaaagagaactcgaccttgcttttatcttgggagaggtggactgggtgttgactaccccatgtcctatagaacctgcggaccttgtcagaggtgaaaaagagtcagatgctgaatggcaaaagagagagagggacaatgctcccctcatcatgtcgtatgacattgaacatgtgaaatggtccttagccaacaagaactgtttggctgcggtaaaggacacgattgagccaacaatattgggctcaatcccagagtatgacaccgtctctaagtacctcgaaagtataaagagccagtttactggttcttcaaagttttatgcgacacagctgataaagcagcttgtgacagagaggtaccatggaggtggtgtaaaagaccacattcttaggatgagcgacatggcttccaagttgaagccaatggatttgggcatctcagatgcctttttggtccatctggttatgacctcattgccaaagaactttgacaactttgttgtcaactacaaaataagtccagagaaatggaatcttgaagagctcatctctaattgtgtgcaagaggaggaaagaatcaaagagaccaatggtgcctccaataaccttgttaaagataacaaggaaaagagccactggtcaccccccccccctcaaaagcaaaacagcctcagcatctgcctcagtaacaacagttcacagttaagacaagatcagtgtccccactataagaagacagggcattgcaagaaagttcgtcctgacttcctgatagtgatcatggcaaagaaaggtgagaacattattacatttgtaaatgaatctcattatgattggttattctagatccacatgatggattgattctggagcaactattcatgtgtgtaattgtttaaagggattccgttcgatgaggactacgcaaagaagcgaaagatccattagagttgccaatggagttgaagcaaaagttgaaactattagagatcttcgcctagagctcgcgaatggcttcacacttttacttagagatgttttttatgtcccttctttgcaaagaaacttaataagtgtatccaaattggattttgatagatatgattgccattttggaaatggcaaatgtgaactatggtataataatgcatgtattagtcttgctgtgttgcaagatgagatttatttgttatctctttctgagaatgtgaatattgtgtcctcgttgacaaaagaaaagaaagcgaactcctgatgtctcatagaaattatggcactgtcgtttaggccatatttcgagggggagaattgagagactgattaagaatgtaattctttctccattggagttcttagttttagaacaatgcatagaatgcatcggtgcctaaaacaccgtatgagctatggatcctccgtgtgggggggagtcttgcagaggctaaagtatttaacctaaatcttgggaagttggaccccagaacaataggctgccattttattggctatcctgaaagatcaaagggttatcatttctactgtccaaacagttatacaaagtttgtagaaacgagacacgtcgtcttcttggattagggggagctcggtagttcgagaaattgatcttgaggagaggcgggtgtctgtacctgctccgtcgactcaggaacctttcttctctctacctgctgatgttgtgcctccaatgcatgacgttgcggtaccaacacatgttgttatctctcctgtggcaacaatgaatgaaagtgaggaacctattctacaggattcaacagaaattattgccacactagaggaggagctgcaacagcctcaaacagataatgtgccagaacaggaggcccctagaaggtctgaaatagacagaagatcggctatccatgatgactatcatgttcataatatagaagagtcgcacatggaggatgatcccacctcatatgaagaggccatgagaagcgctcgctcatctgaatggttggaagccatgaaagatgaaataaaattaatgaaattaaacaatgtctgggatttagaagaaattcctaaagaagccaaaacagtaggctgtaaatgggtctataaaaccaaatatgactccagagggcatatggaaaagtttaaagcgcgacttgtggcaaaaggcttcacgcaaagagaagggattgattacaatgagacattttctctagtctcttgtaaagattccttaaggattacaatggcactagtggcacattatgatttagaattacatcagatggatgtaaaacggcatttctaaatggagatttggaggaaaagtatacatggcacaaccgaaaggtttcgtcatgaaaggaaacgaaaatatgggatgtcgtctaaagagatccatttatggattagaacaagcttcgagacagtggtacttgaagtttgatgggacaataaagaaattttgggtttcaagagaatgttgaggacaactgtatttattcaaagtttaagaatgggaaattcattttcctaattatgtatgtggataatattctactggctagtagtgatgtcagtctactacaggaaacaaagaaattctagtcctcaaannnnnnnnnnnnnnnnnnnnnnnnggctttacatgttttgggcatagagattcaccgagatagaacaaagtatgcattgggactttctcaaaaggcatatatagaaaaggtgttgaagaaattcaacgtgtacagatgcagtgctacacctgctcctatagtcaaaggcgaaaactatggggcatcgcaatgtcctagaaatcagtatgagctcaatgaaatgaaaacaaagtcatatgcgtcagctgtagaaagcctacagtacgcgcaagtgtgcacacgacctgacttggcatttgttactaggttacttggaagatttcagagtaatccaggtccagagcactggaaattggtataaaaagtcttgcgttatttgcaaggaacaaaagacctcatgctgccttatagaaaatcagaatcgctctagatagtggggtattcagattctgactttgcaaaagataatacaaagtcaatatcgggatacgtgttcaccctggcagtaggagctatttcatggaaaagctcaaaacagaccatcactgcagggtctactatgtatgccgagtttatagcatgctatgaggcaacggggcaggtgaactggctaaagaagtttatacccggttttaaaggtggttgacagtattgagaaaccactaaagttatactgcaataacgaatccatagtaatgtacactcacaacgatcagtcaagtggtgctgccaaacacattgacataaagtactatgttgtgaaagacaaagtccgagatcaaacaatcagtctcgagcacattagaacagaaagaatgctcgcggatccgctcacgaaaggcctacctcccaacgtgtttaaggaacatgtagcattcatgggtttaagggaagccttatgaatcctggactatagggcccaaaagttaaagtatatgtttctgaatagagatgtgtatagtggctattgaatccatcgatgattaaccgtgatgtgtaacatgctctatatgcaaatctgtgatgtaatagaaaaaggctaaaagaaatagtgatatcaagggggagaatgttagatggatctccctccccttgagccgttctcaagggggccttgactcgcgccctgatcggaggcacccagcccaatggctggtgggcccccatcaccctgcgccatataaagaggggtggaggctgggacggcacttgacacgaggttcgccgccgccaactccaccccacaaaccctaatccgatcgagagggggcgcagccagtgacgggaacgtgccagcgccgcgccacgcctcatcgtcgaccgcgactcccactgctacaaccaccgtcctcgtcaagcagagcgacgacaacgacgatggccgggacttcctcctcatccaacgcgtcaaccggtcacatcctaaacccttttcccttaatctctattgttgttcaatcattcaacccaaataaaccacccgactagatgtaaacctagttgatccaatagacaaccctaacaggaaggtgtcgaagttgaggtagatgttcaccatccggacgcagcggaagccgtggccgatgttcttgctctccgcccacagcaccgactcatcctgttactccgggttggatggcagcagccgaacctgtttgcaccaacacacgtacgcgtgcagatgaacgaatatgtcagatcatcatcaaagactagtggttttgcaacaaattcacaacttgtgacgccagggcggaaatagtaagcatgtgcgttgattgctactgcgctccaaccactgcgttaactgatttttgacatatatgaaataaactggattaattaatgaacaataagtatgtatgtacatatagggtggctccgtccgaggtccgagggagtgcttgatggcttggctggtggccttgttcaccagcgcgaacgccaggtagccttccttgtccttgacactggcggtggacggtagccatagtccggctcgtggctcggtggagacgatatctatactaatataaaaatgaggagttgccccctccaatcttacaggtgaaatcatctcgatcaatccttaccgtccatctgcgtctgtcctgatccatatcctccatccatccgccacggattgtccgcttcctccttctcgcgcgatgaacttgcgctgaccatgctggactcgcgctcctcctcgccccgattctcctcgccccgcctcagtccaacggtgctccagccgatgctcctcctcctccaccctattcctcctcgcattccccgttcgcgccgccggagggtcgtccccttccgccgacgccgccatactccaccgatgccctcgctggaaccgatttcttccccttccgccggcaccgcaatccacatcacaggttcacaggtcctcgccggaaccgatttcttccccttccgccgtgccaccgtcgccgcaatccacttcacaggttcatcttgcgccgattggttcccgtcagatttgagtaggaactaaaggaaccatcactattcccctgaaccctaaggtaataccaatttctcctattttacatgtttttgtgatgtgtcaatttgtggatcaccatttgttttcttgatcattcacaattgccaatcagaaattggccatagagtttgaagattttaacatatcaatggatttgcatcctttcagttgatcctgtgcagcccctgtcaatggatttgtatcctttctttcttctgaacttttcagatcactggaggctctaaattttgcttgtaatacagatgattagcactactcactgtgaagccatcctactgttcttgttcgtagttactgaaaaatatataaagccatcctactgttctataggagaatctaaacccagtggcaacatcacatgcaaaacacctccatatgaaattaatccttctttttcttcctatttccttgcagatcttcaaatttgtggttccccgagtatatatatgcccaggttgtatgcttgaaggttgtaactcctagcgatggacggcattcctaaattaactgcaaatgaattaagaagacaaagagaccgagagcggtacgcggcactcagcgttgaggagaaggcagcacgagttcaaaagaaccgtgaaaataggaagaggaagaagtctgcatctacatcgggcacaggtgatgatatattcattcacttcttattatgctcacccctatttcgtggcaaacaatgctgaaacctgggcaaactcgattggattgtagttttgaatcagagcctgtgcctttctccacacatggtaatgtcttgtggaatcaatttataatatcaaattgttctgtgcgtctgtttttttttttggggggggggttcaatctaataatatatttcaacaggtgtgcttggcgatattaaaaatttgagtttgcataatggaagccaaactgtagattgtcagccatcatttcaacctgtgccttcctccacacccgtgtcttcctgcacacctgtttgcagaaaccgacaaacctaaggaagtactttttgcggcacacttgccgtatactgctgcatgcagctcaggcaatgtcacaggtatgatttcttcgttgctttacataattacagtgccttgctatatttgccaattgatttgttctcatcactaaaatggtgaaattggtgtagttatcatgcaggctcccaatgaagtgctttccaagtaccactgaaatggtgaaattggtgtagttatcatgcatgctcccaatgaggtgctttccgattaccaattgcaaattaggttatttcattcctaaaccatgcttcttacccaacattgatttgttgattgatatctcagttaattatttcaatggtgtgcgtcaattgtatatttgtatcttccttacaattttcctcgaatttctgtgattttgcagccctgatcgagttgcctatttcctttatcattttgttcaagtaatctgtagtagtataaaaccaaaatatttcttattggttccaaggcaggtttcctgctcaccaagcaagttgatgctttgtttcaggaaatataggacaaataaacagatgactgttttagacaagttcaccctattgatagcattaaaattagatgctcaagatggatgatagtaacaacaaaagcaagtggttaagtcctccaatgtttcatcatttacggaggagttcataaggtgaaactgtaaccagatttttgtgttagtcatgtatcctctttccaattttgcgagatcttttactgcatttcatctcagcaaatgatgtgaataatatgagccatttgatgatatttctttgcatacattttcatttaactactgttaggcttttaatattattaacagactgttatggttattccaacagtttactatatatcatctatactaatataaaactactattataatctgtaggcttgccccagtctctctcgcggcaatggtctgcgtgtgctacaatctgcatccctccacgcctgagtaatcccctccgttcccatgttgaccgacgcggccgccgctgtctcctccaaagcagcagcggtcctagccgaattggccatccccattgccaaacaccatcactggcgccggcagcctcaatccgcgtcgagtttttgtctccaccagcatagtggtctctacacatgaggttggtcttaggctgcaacttttaactcttattttccatcttttaatcgaactcgatgcgagcacgggcttaatgcattcaagccacagtctcaaagcattctgtatttatgttgatgttggttgattgctcttgatgtgcatgtcaggtacttggaggttttttatttccctcatgacgaggacttgttttctcttatctttcaggcctcgagtgacaaatcagagcagcaatcatgctttgttgtggcttttatctctgccgatctcacggcaatctatcgacatgcacatttgtattttgtagttggataaaaaaaaagtagcaatagttgccatctttttctctaggaaaaactgatttgtttatatgctttctcagtttatgtcagagaaaatggttagttgagcttgtctcctatactgaatgtgcttggggttaactgggctttcagtcagtaagcatggtaacagactcttcattgagttaagtagtccaataattattttttaaagcattttagtcagagtagaaacaattatattttttctctactgactgcatctggtatttttggtaattagctggcatcacgtacttatgtatatagtcatatggacatcaagcatgtttgtgggataatataagatgctctaggcagagtagaaacatttatattttacattcctttgtgtcatattttcccttttttagggaagggggcagatcactgctcaataataaatttattcatagtttatattttgtttaattagatgattgactatgaaatttcatcacctgttgtcgagctggagtccccagtgaagacctctgtatgggaccattatgctttcattaaattccatcaccttggaaaactggttttgggtaatagtaatccctgtaatctgtatattttggtgtgtgcctaattgtatgaattgaaagattgaattaagttatgagcactaaccaaatggacaggcttgctttcagtctcctgacttttgcctatttgtctctattcctctgaaatccgtcatgcatgtgcagcgttttgaggatttggctaaacaatactttattgtcaaccttgacgataatgacttctcacgtactgagaatcatcaccaaggtttttcattttttatcttatgaattactctttgtggttgcttaaggaatagtggacttctaactgaatatgataccgacgtgccttgcacgtgcacgattactagtataggtagaactatgagtcagagtcgtcgccgcgaagctagtcaactccgacgtgatgctcgccacccgctcacggcggcggtgctgcccttcaacgcacctgacgtggagctagccgccgggttccgcccctacgacgtcatcctcttctccggcgaaccacgctctagcacgtgctagccggttcgtttgccggaccgaagtcgttggtcgtgaggaagcctcaccagggcaccccgtggaccacttgccgctcctcgggctgcgccgccgcacttcggccctcaccgcaagccgctttcgttgctcccagtccgaagagaaaggaggagaaagagatgagagagagagaggtaggaagaagggaaggagagaggacgacatgcgggccccacatgtcagtgagtctcacagtatattttttctatgaatgacaaatgggtcccatacatatttttaaattctaatgccatataatagccatgtcaattccacatggaacgaagactaagtcaatatcaccacgtcagtaaaaccgctctcaaaactgccataagagtcaaattgcatcagtttaatagttggggtcgagatatttggtactgtggttcaagaatacgaatcagatttaatcactaggtaagggagcgaaagtgaacttattactatttcttatatggctggaaataagtctattttgtgtccctcatctctttgcgccatacacttatatggctagaataagtctattttggcgccctcatctat

SEQ ID NO: 65870 - DNA, 11936 bp, Oryza sativa
aaatacctgtaattgggcccaatcaccatgccattggattaagggccctcctaccatgatcctggagaaaattcggtgccaaatgggccagcaaaggtttggtcgaacccattcggccccctttttcacaagcagttactatcgatctcctaatgatggttgtgatagtttatagcgctccaaccgccatcaggaggatagatggcaagaagagagtgaagatgcccttagaattctatggatgatcacactcccaaggcacctccacctataaataccccctcacctccttcattccaacacacaccaagcatgagctgaattacaagaggctctattgtatcttttatgtacattagaattgggagagaataagggagaaagagttggagaaattctagagttgttggtactttcctctttacttttgtaccttgtcaattactcttctttaattcataatatctttattgagtaattgagatttactttgtgatgattatctcttagttagttcctattatcgagtaaatgaacctataaatagtgtttactttaatgtttcattggcattaaagtagtattaaatagtctagacgtggtgtctatactagagtacctgcatttgttgtgtatcccacagttcgttagagtagaggtagtggcagccctcgagatcactgtagtcctccctgtccgggtacggagtagagcgctgttaacagtgaaatttggtaaaccccgaagtcatcatcggcctagagtcagtatcggtttcagagtcctggaatcagctgatggaattatcaagtcgccaatagtcggattcttactatattcggttaagaaaattaatctactaatgaaagtttatctagaagacatcgagttcaaggaggatgcggcatgacagtttatgtattaattaggaatagtttgttagtttccttttatctttaggaaagtgtgtttagtgcccgataaggactttatgttttccttttatctttaggaaagattctttcttgtccaacaatgactagtatctacccatgggtataaatatgtacacccggggtcattctaaattatctcaacgatcaatacaactactcttggcgcatcgccaccgtctttaccgagggtgcatcggctttcgatcttcagctaaggggtaagtcttatgttccgtcagtcttggccatcgtattggctacattggcgtcgttcaaggctacatcagtacattcgacctcttggattgctctggttcagttgatatatttgcctatttatttatcatatatcttagttaatctagttgagcatcttaatttgatcatattggctgagatttgttttagggtttatgctggtatcgactaaatatcttgctagattagattaactaaggtatctaccactcttaaaatcagtcaagggcttgattgtctagatattacgtttcttttcatacttagtgctgcatcagttaagtttgatatactaaatcgtgtttcgaactataatctctagcctgctttttgattgcccataagggtttcatcggggtttcagccaatgagttatatggatgttggatcggtttacaaggattagatacatgttggttttagccgattgcaacaaaggtttcactgtttatctaatcttgttaatttaatgacatcggaccttgttggtatttcttaacgatattactagaaatataattcccagcaatggcgcagaaatactcctggtatatattggttacagagttcatccgcaagcgcacggatataccattgtagcgtttcacccgagagtatttcaaagatatcgtatttgtttaatcctgtgggaagattatagtagagagaaccgtactaataatttatatattacttgtaataaccatagtctaagcatgggttagtataattcatagggtagaatgacacacaagcataagactactcattctcacatttaatctatctaagctaagtgggaagaaaatagaaaagaatctattcctatacttctagtatgcatattatacatacatcttagctataagattaactagctaataccctctttccgatgccctcctggtacttcgagaagccatccctgattgtcgagttcctcactacaacccatcatgaccatacaaccggggcttaatacagaggagtaccctcctcaggaaattaacttaggactgtatacacgcacggaggaataaccgtactgagctgtcactatcagcggtccacctctcttctgcagcatataaccccaaataatgatacccaataatctagacaccacgcctaaactaccagatactactctaatatcatcgtcatgacatagagtaattgcataagcaaacactatacacgtaccattgcatctctcagataagctagcagtataatcaatataactcagatataaagtaaagttggcattgatatacttggaaagtatgtattacaatagcagaattgtataaaaaagaatattctaaataaagtacaagtcttacaaaagaagaaaggagagctactagagccatacccaaactcttccaaagacttccggactccggtttctattctattcctactacattatcttgagaatactaaattaagtttgagagaatatgagaaaactttgcttgaagtgtgtgttgaaatggagagagtgaggggtttatatagcctcccaatgacggatgtgacggttggaatggtcggaaataccctccaaccgtcattgggggctaatccacaccgtccagccgcaactctacatccaacggcgccaggatgggtttggccagacccttggttcggccgaaccatgggctgggccaaaccagcccaatttcgactggcggcctcccctcttgatatattttgtagacttgtgaattttggcccagttggtcgtgtcatttctaagttcttggcccatcgttccacaagtatgattctcgacatcgtccgattcattgatctcttgttttgatgtcgattctcctccattttatgttcattctctacaagaggttagtaatcctagtactagtggaatatttattattctaacacaaatatgcattgcaagcataactagttctcctttattttggtagtattgatggtcgaagctgattgctaacgaccgtcaacaaaacccccaagcttgaacctttgctcatcctgagtgaaggacaaaaggaaacaaagatttggttgttgatcaggagttgctactatgcagtatatctcaaatgtataggtgcaaggtatatgtactctctctcaaattaaataattctatggcacggtggcttacccttacccctgattcccacgagacactgtctcaccttgtcttgagtggttgaaagacaaaacagcaattagagcactaatcacccaatctttattcaacttttattccggaagtttttcaaaggattttgcaaaagaaatccaagttcctcaaatgattcactcggtctctccaagtgtatcaatattatttcctcactatttatgcctctttgattcctactctaaggttgatatgtggagctcggtagggatcaaacatggcatacttgtattcacatttattactaagtcaaaaactcaaacgaaaatagataactaaacatactcaagatcaagatcgtccaaagtgtgtgtgtgataaatggtggaaatgaaatgtgagaaataaagaaaacgcttctcctttgtgcttacttccttctcccaaaatccttttcttataaataaggagagggcatggctacattattttctcttttttttccaacgtcatgctcatgcttgaaagagcataactttattattttcataaccttgcctttccctccttcttttctttctctcttttttttcaaaaaggatttctttttaggagaagaaagcacataaaagcatggagaatttatttttggtggtagtatggaaatggaatggataattgctagcttctagtgtaggagtttagcatctgcatatatgtgggtgtatgatcttgatcatagagcatgagaagtatctacacaagtcacaaagatttgacaaaattcaatggaattgcaagtaaccaaaatgtatatggtttaatcaatatggaatatttttggctctggtaagaatttatatcaaatgaggaacttcataagtttatcattttgaaaaataaaacatccggaattcaagtcaaacttagacaaggactatagcaactcttatttactatctcatatcttgcaacaacttagactcagattagcaaatgcagctcatttaccttaggttcccagataattgttggctactcatatttaatttttgagagtacttacctatgaactcatatatgagaaatataaaacagagcaactatttatcatttcaacaaagagaaccaatttgtcttacctagcataataaaatttaacctatctttttggtattttctattttgcaaatttttatgttgttttcaggtttatagaatgcaattggaaaaacaaacatgcaatcggaaagggaaatatgcaatgtgatataagttaccttagtgggcggatagacatctccctccaagcttggctttcgctcagggttcttaataaggattgaatccctagaagcggaagtacgcttaaaggccatcatgctgttgctgcatgaggctgttcatgttggtgaactgagcatcagcattttgttgccattcttgcatttgcgctatgtgttcctcgaggttgtgttgggtctctcccgtctgcatatcaagggtatccattctcctggtgatttcacccaagtcccaacgagaggaactcgtgcgccattcaccgggagatggaggcataccacttgatctgggggactgattgttccagccttcccactgtatgtcatgaggcgcccgccaccggctctcactggcactttcccagctcgagatcccaatgttgtggtgtggagcttgggtgcatccccagttggctcccaacctgcctcatacatctgtacgggtgttgaggatgttgaacctttccgttcattccttgccatgttgcgtgtctccctgtatgttccacctacacgagattcttctatggtctgcaggggtatggttagttcatgatagttgtacaaatgataccccgcgttaggcaacggaatttcatttgtacaaccagggaaaaagtatatcaaagacccatctactccatgtttaaggatatgcccttgcactagataactctcatcaacacagggacgagcggttgaaatataagcaatttgatcattggtaataacccctagtccctttgctatgcgagtaatcagagaagtgcataacaggagcagtaaatcttatactttctaaccattgccttatcatacattttataggagcaattttaatcttcctaaccatggcaaacatgataatcagttcatcctctctaatatgtctaagatcacctataggaaacaaagtcatagcaatccatttgtgaataggcctaattgtaggattatggatatcattcatcctaatttcttgcaaattgaagcaccagaaatgtcttcccaaaatctgtttttctcaaacccggaaattccttcccgaagatcgattttataggaatcgtgaaaaccaagaagtgtacttaatcctttccatgaaagtgtgtattcattatggaaaaagcgaaaggaaattccatcttctatttctttcgaagtgcacagaaattgcaaagtaagcaaacgagaaccaggctcatctactacagtaaatctctgccatccaacagctttccaaatagcacgaaagttagtatccatacctatctttttagcagcgccggagagtatacccacgtgtgggcatactcccggtccttcagcatgtagtaggtttgtctttcccgatcaccgacaaggtcgaggtcggtgtcgctcaagagatgttgtggaatgtcagcatcctccatcgagacgtctacggatgaacgagcactagactcatcatgatgacttgatggagagccggatcccttcttgaacagactagacagttgcctcctcatcctgcacaaaggaacaagaacaaactaactcgacgggggttagaataacaaaagtttcacccgccggttagcttcatcaaagcaacttgtttatgcaactaaatgcttgaatttgagggaaactaacaaagcttgaatgaattttgagagcaaatcatggagagggagtgaaaatgagttgaaatgggggtggatttccttctcccggccggttggcttaaatagaatgcccacaacggtcataaccgacctgtgggacccactagccgttgcctcaaagaaagaggcacgcaaccgttggccttgctggaggccaaacccttggtgggcccaaccaaccccacattcggccgttggattccaacggtcagtgcggtcatggctcagcgaattttcgttgaaaattttattttggtttgctctggaaaattcatttgaagtaattttctcaaaattcaattctaaatgcaaattttggaattcacatatgcattgatgcaaaaatgcaaattgatggaaataaatatgtggatacataccaatttacctgttggcgaaggtcacgtcattttcggtccaacgtgcaagaccatacctcccttcagtttagttcgcggagtttccacccatctccggaggtgatggagcgggcgtcttttgctttaccttccacaccttctttggttttggtgcgggcgatggcttcctctgagctggcttctcttgtttcttggctgttctgtgggtttggcccgtatttgatccggaccatggaacattgttcggtcctcggctaaaactcaaatttttcttccttcccgttgatacggaaacggatgcttcctgttcctacatcaatgttggcatccgcggtgctaaggaatggactccccaaaatgagcggcgtctcctttttagtgtccatgtcgagcaccacgaagtcgaccgggataaagaaatcccgaatcttgatcggtacatcttccgctatcccagctaggtagcggaccgatgagtcggtcaactgcaggtgcatcggtgttggtgccaacaccatgaagttgagcttgtcgaagacgtctttgggcatgacgcttacacttgctcctaactcgtagaggacttggtcgaatttatgtgtcctaatcgagcagatgatcgtgggacaccccggatccttcttcttttccgggagcttgtggagtatgacattgttgcactgctctgtcagcttgaccacttcagttgttgggagcggccttttgttgttgagtatatccttgagataacgtgcgtatgttggcacttgcatggcatccaacaacggcacgttaatgtggatcttctgaatcacctcaagaaaatgagcgaactactcatctactgccggtttcctgcttctctgagggaatggcagcagtcgtgtgtcacaatactcctggggcacggtcttttctggctgaacttcttcatcagtcgtgcttccagatggtgcttcttgggtgatactgctggtttctacagggttaggatatggcggatcacgagtggacttcttcatgggtttctgggcagtcattcccagagtggtccatgctgtcgcagacctcacacgtgacgtgtgagtccaaggccttgatggtgccttttggccttttctcgtgatcgtccaagagtttcatgaggaggtccagtttggcagcaagcatctccggctccttgacggtgtgcatgcctcgatgacaggtctgaagtcattcctcgctctagcccatattggagaccattttctctatcaagtcgacgcctcctcgaaccgtcttagagaaaaaggctcctccagctgccgcgttcaggtggtcgcgagacgtgggagtgagtccattatagaagttttgcaggatcagctagtcatccatcccatgatgaggacagacggccatgtattcctgaagtcgttcccacgcctcaggaatggactcgtcccttgtctgctggaaacttgaaattctcccacgaagggtgttggttttgcctatcgggaagaactttgacaggaatgccattgagcatttgtcccaggtgttgatcgtggcacggttggcataaaaccactgtttcgctttcccaaggaggaaaacggaaacagtcgcagcctgatggtgtcaggactgacccccttcattgtgtgcatgctgcagatctccaggaactgttgcagatgtgtgttggcatcctccttaggcttgccacagaacgggctagcctgcgccatcgtgataaggctggacttcagatcgaaattcacgtctgccatgttgatttgcgacccagtggccacattgtcagcagagggagcagcgaattcacagagggtcttgtcagccatagtcttgaaagttcgtggcactggtatggctggtttctgtgtcggaagagttttctgcggagcgacgactcgcgacttgacgctctgaaagaaagcctctggattttccttgaagtttttcggcaagttaaaaccaatcatgcactaccctgtttccacaataaaagtgaaaaaaaccaaggttagcctgcaaaggacaatgattatacagaggtaaatatagagtaatagtagtggtaatctcttttataaatcttcccggcaacggtgccagaaatgtttattggtatttcttaacgacattactagaaatataattcccagcaatggcgcagaaatactcctggtatattatggttacagagttcatccgcaagcacacggatataccattgtaccatttcacccgagagtattccaaggatatcgtatttgtttaatctcgtgggaagattatagtagagagaatcgtactaataatttatatattacttgtaataaccatagtctaagcaatggttagtacaattcatagggtagaatgaaagacaagcataagactactcattctcatatttaaactatctaagctaagtgggaagaaaatagaaaagaatctattcctatacttatagaatacatattatgcatacatctttgctataagattaactagctaataccctctttccgatgccctcctggtacttcgagaagccacccctgactgtccagttccttacgacagcccgtcatgaccatacaaccggggctaaatacggaggaataccctccccaggaaattaacttaggactatatacaagcgcggaggaatacccgtactgagctgtcaccatcagtggcccacctctcttccgcagcatataacacaaaataatgatacccaataatctagacaccacgcctaaactactagatactactctaatgtcatcgtcataacatagagtaattgcataagcaaacactatacccgtaccattgcatctcccaaataagctagcagtaaaatcaatataagtcagatataaagtaaagttggcgctcatatacttggaaagtattacaatactagaattgtataaagaagaatattctaaataaagtacaagtcttacaaaagaagaaaggagagctgctagagccatacccgaactcttccgaagacttctagactctgttttctattctattcctactccacaagcttgagaatactaaactaagcttgagagaatatgagagaactttgcttgaagtgtgtgttgaaatggagagagtgagaggtttatatagcctcccaatgatggttgtgacggttggaatggtcggaaataccctccaaccgtcattgggggctaatccacaccatccagctgcaaccttgcatccaatggcaccatgatgggttcggccgaaccataggctgggccaaaccagcccaatttcggttggcggcctcccctcttgatatattttgtagacttgtgaattttggccgagttggtcgtgtcatttctgagttcttggcccatctttccacaagtttgattctcgacatcgcccgattcattaatcgcttgttttgatgttgattctcctctattttatgttcattctctacaagaggttagtaatcctagtactagtggaacatttattgttctaacacaaatatgcattgaaagcataactagttctcctctattttggtagtattgacggtcaaaactgattgctaacgaccgtcaacagacctccagccgatgtatgctttaacctttggatccgtgcttattctatcgtatcattattagccgattggtttctattagattatattgttgttatattacattatcatcagccgattgactttatttacatcaagtgtcagattctgcatcaaacatatagccgacagctcaaaaccctatcgctatcggctagtattggcatcgactggaattattccatcgacttgtcagtcaatcggctcattgatctgctatttgtatatcttgtcagttgtaggatcaaactgactggcatgcctgcatctcatcaacctttggacctgcactagagctaagtagatctcccaggcagttgtgttcttcaacttagttcgcgccaacatagttttggcaccatctgccgagcgcggatttctcgtcaacaagcgtgttctggtagcaacgagcaaatcagtgcatgaagtattgcggtagaattaaattaagctttctgtagacactgtttctcactaggaaatctattagggttacggataaggcataccttctaccctacgatttaccaaatataccggattggcatacctcgtatcatacgatatgtttccgtatgcgataaggaaatatacaagatattatggaaaatatcctcacaggctagagattatcagagtcctactcggagaggatagggactattctctatcgtgcagggttcgttgtctttgagttctacttagagactaaggcaactcatggtataaaaggcacaccttcgaatgggctgaggatcatcgaatcatagcaccaacacacccatcatagtttacaaagccgaatgacttaagccgaagccaccggggtatctcgtcgaacaatctcgacaaggatctcgccggtaccatcggattcatccgttccctttgtattatgtggttttccatataaatctcatataaactggattagggctactacctcacgaggggcctgaaccagtataatccttgtctcttttctactttgattttgtatcgtgtagattctcgtaccaacgtaccccaatacccaattcatccggtctacgggtaccccccgtcgatagtggcgcgccaggtagggggctttggtgatcaaggttctgccgacatgacttcaagccgctccaacaactttgtctacatcggccccattgcaggagatccaacctcaattccgctaatgtggactcaactcggatccatcgactttccggtttactctgcgataccgatctcgtctggcccaatctctgtcgggaacaagaacgtcgtagctacgacttcgagaaatgacatgtcatcggtgcctccctccatccatacggaaaaaacagacaacgactatgacaacgtcaacctcaagcggccaatccccatcccctcatcgggaaccaggcgccgacaaggatgttctctcagaaatcatctgcctggtgtgttatccataaaacacccaagcactttctatcagactacccagtggcacaacatgtgaaggatgaactcagatcttataaagaacgaggaatccaacgaacttcaccgacaaata

SEQ ID NO: 65871 - DNA, 2851 bp, Oryza sativa
aaatctcagccacaggcgggcgcttgggccgttctgtacgggcctcggccacagcccacagccacactagtaaaatgttttttttttcgaaacaataccaatattgctgcccagcttaatatttcgcccaacggcaagctcctgccgatatctatctcctctgtacgtatgagtgtcagtcggatgcttgcatgcagcaatcagtatacatacttgtgcaattgaatactccctccgtttttcgttataagttcattttgaatttggtcaaaatcaaactacttcaaatttaatcaatctatatacctacttaaaatatacctacttaaaaaaataagtaaggctttcggtagggttttttcgtccgtcaattttttttcacacgcggtatttttctcacgcgcggtttttttggccggtttttatcagattccggtttttttacgtgtggtttttgtccgatttttttgtccgattgttttttggtgggcccggatattccccaccgcgtccaatttttttgtgggcccggtttttttccaaccgttgattctgatgggcccggttttttatatacaaaagaaaaaaaccacaggaatccatgttcaccatgttcacgcacagaaacacagtagtccaggttcacgcacaaaaaacacaggagtccagttcacacacaaaatatacatacaaaaaaacagagtccaggtttaccaggttcacgcaagaaaacaatatcgcatacgagtcaggttggttcgcccacaccttttcctgctcctgtttgcgcagcccaagtcaggagttagattctatcccgattctatcccgagtcagattctatcccgcttttgtttccgctatatttagctagcactcccactaacgtgattttatagatttttctcgcaggacaaaatacacaaatatgattacaggcaatacaaataatagaagcgcacaagaagatatagatcacaaggctcttcttcctctaggatgtcaagccacctccaattaatgtcgattccaggttatcaatgaactcaaccctgaatgcaatttcaatttcattagatttataagattaatattgaataaaactacccaaggtcttttttctgtccatgcagaaacatatagcaagttagcaacaggcatattttcatttcagttgctcagcggctattttcataacataccaccacaaaatctaggagttgcaaacccaaacatgaaaatctcttttttaagtggctttatatattactagaagaaagaaaaagtattggtaattgcagcaagagcaattttatgcagaaaaacattaactgtgcagacagatgaaccatcgtttaattattgcaattttttatcatgctctaagaaccttaatgtttatcatgctctaaaaaccaagtaaatacaacacgactagatgaatgtctttctgctttctttttaccttatgtccgctctgcttttattcttatttattggcagtaattaccggaatatttttggcaatcatctcgattctatacctccaacccatcaaagggtgataagaagaaggttcacaatgcagcacgacattgccaattgcctgaaaacaatgtcatagccaacacttataccaatccagatcagcagacatcagtatggagctcttaaaaattccaaagcattacaacggggcatagcaagtacaataggttccaatttagccatgcaactaaacttaattctgaaaaaaaaattgacctgatcatcataactctttagattaagaaagatatatcttgatgatctttcagaatttcatgttcataagcttatattattgttgagaaaggctccaattctatacacatgcataaagcaaaatattttaaatcaaagatgtgtagggaaattttatagactccaatgctaccagaagtaccttaaatcacggatgcattagtgagtctttttgcaataatctccacattcttcagcagagcactatcatgaacctcagtacactgataatttagatgtatagtccttggttccaatatcgctatactgtccctgcatcatggaaacaaatgcaagtaagaaaaaatatccatcacatatcaaaacaaagtttctttaaatcaaataaaagcatcatggcatatagcaaactaaggtttgatttttttttttttggtgctacattggtacatgtcagaattgagtgttcctaaacagatgaccaatcaggcatgcacattgcaaccaaaacaaagcaggaaaccatgtgatcagatattacatcgtaagagaaaaaaaaattggttgcagtagtacggctgtagtttgcacaaaatttgagtccgtcgcatatcgctcgcgccattaggatcgaacaaagacagagagggcagataccatgttcaacccgaaagagattactagaaccaaaacgattactacagattcaatttggactaaaaagggggatgaaataaacctcataaatacaagaaggattccactagattactacaacaaccaatcgaggaagactcaattggtcagatcgaagccgcgtgaagcgcagatccagcaagaaggaagaagagggttctggcggttcaggggctgaagagagcatagaacggcagggggattgtgggcgccggtcagcaaggaagagaagattgcattattgcaacgatgaactcaccgtggccactctagatccgctccaccgctgatgtgtgcagccgtcgtcgaggttgtcgcccccttcttccaatctgccaccccacctcatggccggccaagaaaggagagcaggggcgccggcaccatctag

SEQ ID NO: 65872 - DNA, 10840 bp, Oryza sativa
tgagataggcttttgtgattttccaaagaattaatcttcgagtgggctaaggcccatctattaattccaacaaaggggatagcgctatatcgctaatctatccagcggtatcgctaatcctttaagtgcgcccaggactgtaactgtctcacgctccaaacaagcaagagctactcggtctcgcacccttaatacgcgagaccaccggccaaaacacacaacccagcatcgaggtggtggagcccgtgaaggaattggcctcgcgcggctatccgcgagagcgcctctctgacgcacgtcggggcccacctttggtctcgcacttccccaccatgaaaccgagtgcgatttcgcattctcccagcgcgagaccgaaatgttaattgcaaggctaagttgattatatttcgtgtgaagaccgtggagtacgtatatatattttctttcatgatttttagtagttatgtgtaatatatatatatatgagagaaagtagtaatttaattagtgagactagtcttatccacattaactgcgattgataaaatcattacttaatgaattatagttaaattaatattatggagtacttattatattattatgttggtaatcgcaataacatatcacggcaaataaacttttagtgtaattctcatggagtctgatgaggacacaactagcttggatataaccaagactaccttatatattaatcaaccaaaggtgcatatgttctacattagatttacttgttatatatttgaacaaacgttgctacacaaagagttttgtgtgttttcgtttgcagaggtacttgcttgggggaagaaaaagaaaccgagcgtaacgaatgcacgaatgattaaagaaattgattggagaccaaaccaagaccttctccaagtctatttccatctcaccacgtcacttttggtccatagaagacaagagataaagttctatacgttttggatccggattcgggcctcctgacaagatcaacttaaaatggacctagccgctgatctagatggaatttcggggcctatgagtacttgttggaagtcttatggagtctactttaagatggttttggtcccacatcaaaattcctaccaagctgccgggaatctacaaaacaagccacatatctcatccagtccgaatccgatttgtgttttggccttgatagtgtcgtgggcttagcccaagggggtctgagcactacggcaaccctaggacgtccttaatcatacttaatcagtagtcgtcatcgcttagaggcgggttttgcttagattaatttgttaagaacagtttcgccactagatcagtttgtagaaccccaaattcgagtggttaatcattcatatgcaattgtgttgcaatctatcttattcttgcttgtgttcttcgattcgcacgtagggattatccttctcggccaggtcaaccgggtttcggcacggttgataaccagaggagacgtggtgctgcaattgcggggctcagtagcgtgttcgttcagaagccggatcgagttgtgtcgcgactccgcccaaatcgattgtttatcaatacctatcggaagatcgggagctaacatccctcatcagttggtatgagagcgcggttgcccgttaggtaatttatcttcccataaccagaaaattgccacacaaaaaaatattctttacctagacaatgtgacccgttgcattgttctattagattttcctttgttgaattctagattgcattgtcgtgttgagtgctggtttagttttagatttaattttaagttttgagtattgcatctgttcatcacttaggcctagggttcatcactcaagtcggtgtgagttgtacgtcagttttaggtccagtttttcatctcaacgattgttgctggtatcttgaaaaattgaatcctctcttcgtcgggtaaaaaaaggtaatgataatggtgctacaactactcaaggtatgtatatttatgatgtgccaactatgtctactacttatgctacattagagcaacccatagtggaaacaattgctgaaatacctttgtcacaaaataatttgcttgatgtttcttgtgataaagaagagttgtgcgatgctccacttatatccatgccacaactagtgaatggacatgttagttctatagtagagccaccatgtgttgagtttaaacatgttattaacattgctagcgagaatgaagaggttaaattattatcttctttaaatacatagggttatattctatttgatgatgtttgtcctatcaactgttcagagaagaaattatttgctagatttgaattgccatgcccttctgatgtgatttttcatattattggcaattatgatagtaaaggagaatataatgtgcatcgagtatatatttgttcgaagttcactatacctccttttcatgatgaaatgtattgtctagaggaccgtctgcgtataagtaattctctatctagttcctctagttgtttaaatgagttacatgttagtttgcaagaaggggagtgttgtggtttttcgactacaaagattttaggatccatccatatggccacaagaaatgttcctcaccggatgttgtgatagataaagataagttcaaaatgctccatgacaaggtgaaactgaggacggtttccaatcaagaaggggaggatgatgaggacacaactagctcggatataaccaagactaccttatgtactaatcaaccaaagatgcatatgttctacataatatttacttgttatatatttgaacaaatgttactacacaatgagttttgtgtgttttcgtttacagtggtacttgcttgggtgaaggaaaagagaccgagcgtaacgaatggatggatgattaaagaagttgattggggaccaaaccaagaccttctgcaagtctacttgcatatcaccacgtcacttttggtctataaaagacaagagataaagttctacacgttttggattcggattcgggcctcctgacagcatcaacttaaaacgggcctagccgctgatctagaagatattttggggcctatgagtacctgttggaaaacttatagagtctactttcatatggttttggtcccacgccaaaattcctaccgagctatcgggaatctgcaaaataagccacatatctcattcagtccgaatctaatttgtgctttgggccttgtaattgtgtcgtgctcttagcccaagggggtgtgttaacaaccaaatttgataattcaagtatcggagatgaagataaaaccgaagcggaatccgagatagagatcgttccggaagcagagcaagaatcggctaaagtccgaatcggctacggttaggatcgctagagttcgagtcagacaaggttagccgattgagccgattccgacaatatgactcgatacatgacatcaggttgggttatggtgcttcatatggattgccatgcacggattgagtcctagaaaggcaattgtatatattaattaggatattctatgtaatttccttagagataagtttggacaaaagtctgccgcaaagacttatggtatcttagagtttgttagagataatagtcgtgtccgatatggacatattttgtaatcttgggtataaatagaccccgaaccccatgtaatcaatctaacacacgttcaaatacaatgtcggcgcatcgccacacttttactttcgttttgtttcgacgagttcttgctttcgggttgagctgcatctgtttcgatcttcaactagaggtaaaacttgttttggcggcttgtgttctcgggattagtgcttccatctttatgatactctaatcttgtttatgtaattcgtcgagttatcatatatcttatataatctctggcaatattgttatttaaccctcaatccgctaaaatctatcgctagaaggcggccgatcaggttaaataccaatgttgacttagattatatagggtatccaccactctatgaaacacccaacggcttgattgtcctagacattgtccttcttttcatacttaatgctgcatcagttaagtttgatctattaagtcgtgcttagaatctcaatctctagcctgctttttggttgctgattagggtaatatcggggtttcagccgatcttacctgatttagctttatgtttcatgtgcttaattgatatgcttgatctgccctttatgttaagatcttattacaataaagtatattaggcttctgtttggtatattttacttgctttaatatcttaatatagagtggtatcggagtattagccgatacatgctagatctatctgattggctatgctattagcgtctataatctcattgttaatatatatttcgatctaagtgatttatactgtctcggcatggcgaccgatctatcccaatcacttgatttgagtatatatcgacataaagattacatactgctaatatctacagccgatcgaatagatttagtgctctcttaattattaatgattgccaatcgattcaaatatgacatcagctcagagataaatgatatgtcatcggcgattagccgatcggctatcatttatggatttaaccactattttcctgtctttgtttcttgttgattgcaggatcaaatcaactggcatgctcacgaacctaaaggcaagattttcagacctaacatccctcatcagagtcccaacggtgtgctgcacagaaaattaacgtcgcgtgtagtgcaataatgataagttacaatatttatatattcatggagtcgcattagttggtacaacaatttggtaaatactaccatttttatgttctagcaaataggaaaatatcttacttattgtttttttataaaacaatggtctcatttagtcatgaacaataacttcgtgcacttgttttttaaggtctattaggagtacaatattttgcactatgtattgtgaggttttggagtgatgttttatttttttcggagttcctttaacattccatattaaataggacatcaatgcaagaaatattcctcaaatacgaaacatcatgcacaacatatagaatattgtacaaagacatcatgttcagtgctactcattgttgtggtcagtcggagtcctaaaactaccagcttgcattttctttgtctgtttccttgcacctgcggcatgtcgggagctaaaagagaaacacggttgggctcacggcgctcatggttaattctatgctggttgttgtcgttcccttctaaaccaccaacttcatcagtctgcaatgccgaaattcattagataccgaggacgaccctccacccaagctacacatcttgtcgtacgatgatgtctacggcctaaaccctgacattagttttgggtggtagcctacagaagcatagtagatatcaatcaaattgtcaaactagagcagagaacaataacataaactaaaatatacaaacctgttgacggtgcttgcatatacagaatttcattcggatgcaagagatattcaccaaatagccaatcaccttgtttcaacaaatccatataaccctgcactccaccactgaaagtcgtaccttgcattcatgttacatgtagtacaaagttattctcttaagttgcagttagagtcatgtatcgtagaaaagtaccgccaatatgtaatgattaacaatgacggttgtgagcgtaccagcataatccatgtattgtccttgccatgggttggtaccatttgttggtggatgcatgggagaaccacctgactaggccctgcaaatatcaggaagtaaatagttaaaaacattcgtatccatgcaaaattaaataattgaactgatagtagaaattcatccactaaaacataccggcctcattactcatgcgaggaatctccatgcttgtccctgtgaactggacacatcagaaagcatcaatagttgagaaaaataagaaaattgtgaaattacatggcagcggagacccagcgccgaatgacgcaaaccctcctttacctatagttgccctagaaatttgggtcatggtagggaccccgtggctagtccttgtaaatgcaattaattagcatgaagtgaaaggacatgtggacatattgaaaggaccttgatgtcgcctagaagggggtgaataggcaatgcggaagataaaactaaaaagggttggattgtctgataccaggttagagagtcctatggatcggattgtccaaactgagatcggattatttgacctacatagtaacaatcaaacaagtaacaacctaaaagctctagatccaattcacaagtaaggaggagagctcaactaacaacatgattggcgtggcacaaagcaatgcaacaagaaggtaaagagagtgaggatatcactaagatttacgtgatgatgtattttgcggagttcaaatccttgaggggattccaatctccgtcgagaagcttgcaaagagcccggtcttttttcaaccctatcctcgtgaggttgcacaaatccactcctcctttcactaagggtatctatttccttgcggaggtgagatccggccttcacaaacttctcttggccaaccacaagtagatcggtggcccaagaataacacctagctgtctaggagtcctcaacctccaagagtaataaacaccacacaacactttgacaaatcatagtgctcaagataaagaaaagtgcacactaggctcccaacctgcaaatccacactcacaaagatccaagtcacaaagaacaagggggatttgagatagagagggagagagctcaaaaatccaaagcacttagcacaaagctcaacccaaaacaagatttgaatgaaatgaatttgagcaactctagaaaactgttagtggggggtttataaagatccccccaaaatgtgaccattggaggggaatcttttagcccacgtcagatagtccgatactaaatcggatagtctgaaaatttaaatctccaaggcaatgagatacaaagaacgaatttccatgaaatatcggactttctgagacattggactatctgatgttaaatgggatagtctgatattttacaagcaaaaacttcatcctcaagtagagactcaggttccatgaaatttcgaggtctatgtttcatcagactatctgatccaacatcgaatactccaatacttagaaaaaaactcactcgagaggagttttcaaaacaagaaagagagtgaagttccatgaaaaatcggatagtctaatttcaaatcggtagtctgatgttgatgaagaaaaatgcaataacttttttactccgaagtccaattttgatgatcttggactttaaagaaacctagttagaggatatcaaatacaccataaaacatgagacaaaaccttcaagagatgttgaaaaacttgaaaagaaacacggtgtaagtgttgtgacatgtaaaacaactcgcagttggaatttgcttaggtttttcaactcacacaaagatgaattattttaaacactagtattcaaccaattatatgcatgtggtatccctcttaataatacagcatcctaaactcaaatgtaaaaaagcaaagttataccaataggaataccttcataccatacttggaaggttaccaacgtcaaggacatttgatcattgggaaaatctcatcttcttgatctttggcatttcatcttcaatttctcaaatgattgatgcggataatccatggcttcaaatggcctcgcacggtccatcacaacaaagtcttcactcgtccttcaccatcagtttcagttggtcggtgtcaagccccttgcttgctcttcaccaccgcatggtccatcgcagcagagcgtcacttgcgcttcaccgtcttgccataggtagtcacttcgtaccccctcatcttcaatctcttctctttaattctcatccatcgataagtccatcttctagcttcttcatcggactaatcacttgcttatacactcaataagcgcattagtcccttaattgtttgtcatcaattaaccaaaatccactaagggcatagatgctctttcacatatgcgtaacaatgttacccaatcgagccgaacacgtgaatgatgcaaatcctccttgctagtgtgaggttgcgacatctagagccttgggaggaaccacttgagacatgggacgaggcatctgaggcatgggatggaccattcgcgttccctctgtcatcaattcaaaaacatcatttagtcgtgcaacaattccaattgtcaaaaagtaagcatattgcacaaaaatgtcttacgtgcatacaacacaaactcaccctgccactgagaggtgatgggcattgagctttgcggggggtacctattcagggtgcgctacaaaacaatatattagtttataattgaatgacgcatattttatcattccataagaaggttttttacctagaactagggcaaacccacataggcgttccgagatttatgcgatcgttggaaaagtgggcacctcacgaaaagaaattgaccatcctgcatgagcagcaattgatgatcgtgtggaggctgaggggcgtgctgaggtggacagctgggaagaggtagacagccgctccggcattggctcgaacgtccttcttgtagacatctaacgaatgtcggcacgacgggaggcacatgattcacttacttttttcacgaagaaagtcgaccgtggccataacttcatggttagtacccacaatcccatctctaaacttctcccacaaagttttggcctcccttactaaatcccctgcaatttcggtatgcaaggaaggtagtaacaagtttagaaagtgtcttcgcatgaagaacgaaacaccgatgcaacaaaatctttcaatctgaagtagtacagtcaagtgagccagggttgctagctgcatctcatatatttggtcaaggttggctagtccgcgcttgtcgagatcctcgggtgaaaacagtcggatgcgagtcagcgatgagtactaggccatgtattttcgtaagtgttgtggtcgtatgccttgttctctgccttgttctcctgaacaacatcagcctgcgcttgcgattatgcctctatccatgggctcatccttgagtatatagaacgacaatacatgttgtcagcttgtctcttttgccttcggtgaaaatagcatcaataaaccattacttattgctcgtagaatttggagtaatgtacaaaatgaacttatgtgtgcacttctggtggaaccataagtccaatgggaactgggacatccagatctaactccagaacttctactagcctattaataactacattgaagtagcaggatgaggatgaatggaagatgtgatctgtgaaggctaaaatatggagctcctgcacccttctatttatagagggagataccttggactataatggccaaatgggccacccatcccggcccggcgtgagcatgaccaggcacgggcgcacggcccaagatcagccgagtcggcacggcccgaccaacacgccgagccatgttgtgcctacacattggctgcaccaacgaccgaggcatgacccaataagactcgggtcatgtcgagctgtcccaaaggcacgacaagcccaccatggtccttctcggaataagtctatttctcctccctagtctatttgggatatgtcctaggaattcactttgactcccttaactagtgactgaatctgattcgtatccctgaaccacaataccggatatctcgatcccccccaactattaaaaccggtgcaatttgactctctcgatggttttggaaagcatattagttgacgtggcgcttacgtagcggtattgacctgatctttgttccacgtggcgcttatgtaggattagaactaaaaaatatgtgtggtacccatttgtcattcacacagaaattatagtgggacctaatgacatgtggggaaaacatgtcatcctttctacttacattcttcctcccacctctctctcccttatctctttctcccccccttccccttttcttcggctggcaccggtaggcgggagcaatggcggcgggcagcgagcattattcccagagcactatcttggagccgttgtgaacgccgacgtggatccttgccgccacggaagtgttagatggatctccctccccttgagcccaacggctcaagggggccttgacccgcgccctgatcaagggcgcctagcccaatggctggtgggcccccgtcaccctgcgcaatataaagaggggtggaggctggggtggcacatgacacgaggtttgcgctgccaactccaccccataaaccctaatccgatcgagagggggcgcagccagtgacgggaatgcgccaccgccgcgccacgcctgatcgtcgaccacgactcccactgctacgaccaccgtcgccgtcaagcacatcgtcgccgccgtccttgtcaagcagagcgacgacaacgacgatggccaggacttcctcctcatccaacgcgtcaaccggtcacatccctaaacccttttcccttaatctctatttttttcaatcattcaacccaaatagaacaacccaactagatctaaacctaggtgatccaatagacaaccctaacaatggtatcatagcaatcctagcatttagattggttcgggaaagaaatccaaagatcaaaagaaagaacagcacacgatccgcacgggtcgaaagggagcgagtcgaataacaccct

SEQ ID NO: 65873 - DNA, 3938 bp, Oryza sativa
  unsure (1)..(3938): unsure at all n locations
atggtggctgcggccgcacccgacgggagtgggggcttcgcgcgccaatggctcggcgacggcttcgtgcttccctcgatcgatgctgtgcctaaagctcaggcagcagccgagcaggacgggctggacggccgacaatgctgccacaagacgggaggagtcaattgagtggttgctattgacctaccacggtgaaaggataaggttgacattggaaggctttatcgtgggtgctgcatcgtgggccttgacacacgcctgggctcctggccagtgatgcctggctcgttttggctcgcgagcggctcgtgagttagctcgagctagctcgttatgactaacgagccgatacatgagctcggctcgttaacaattcctaacaagccgagccgagctgagacgagctaaccacgagccaagcgagctaacgagccatgagcttttcgtccaaccctagatccagtacagtgtcctgaggcatgaggaggccccaacgaattatctgcttcgtttgtttgtaattattaggggatgttaacatgtttagttgctagtcacatattatcacgtctaaggttagacatatttgattatattgacagttgttggttatagtcatagttgtggtaagatttttttttctaataaaatgggtcccatatgtcattgatttatgaaagtgtggcaagattcccttagatttgctaaggtgtggctaataatttgatcgtattaacttaagcaagtgtggcaatatttattgataaataatggtaaagtatggctaggaagcaaatacaccggggcccctttgaattgtaggaataaaaaaacgaaggaataggaaaaacatacgattctaatagggatgtaagtgtaaaacagaggattacaaaatacaggaaaaacacaggaatgatcgtttgattggactgcaggaaaaacatagaaattggatgagagagattgtcggtgacatgaggccgggagtatcatgactagaggcttgaggcagacacaatcgcccacgtggcctggcaccctcggggggcgtcgggcccgagggtgatgtgttcgccctcctctttgtctccccgagggggtcggactgctcccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacaaaccggtcagatcgtgggttaggtggcgacaggcgatctgacgcacgcctcgccccatcccgtcaggacgagggcttctaggcgctcgtccccagctggagctagcgtgttacctcccggagatggcacgttagtcccggtcagatatatgccaggcttcatcctaaccattacaagcaagacattgtatgaagaagggcgaacatgcagattgctaaactgacacgtggtggacaagaatgaccgatttgtgaccggtctgacactggtcatgtcgacggcagacagccatgttcccacgtcgcgcctgcttccggcggaagtggaggtaggtatgggccgtcccatcagaaggtcattcggacggcaaccatacaaatctccgtccatttatgaagagaagtcaagccaagtttgggggaagagagaataagtccccacacaaaaaagaagagatggtgcatgtggtatccccttgagatataaaaggaggaccttgcccacttagaaaggggattcggatccagaacgatcaaggctggattgagaaccagaggagagggtttctagagtaaaagctctctgaccctccagctctttgtagtttttcatacacagatccaccagaacacaggagtagggtattacgcttctcagcggcccgaacctgtatacatcgcccgtgtcttgtgtgcttcttccattttcgcgaaccttccacagaccaagagcttagaatctcacccagggtccccggccgaaccggcaaaggggggcctgcgcggtctcccggtgaggagccccacgctccgtcatctggcgcgccaggtagggggcgctgcgtgtgtttttctaagctctcgtattctttcgtgtgcgccaaccttttcctgttcagtccaatggctgaacaagcaaaggcgcacaacctctctccgagtgttagcggtgacgacggggagccgaacccacgccgtcgagctcgtacttcacccgccccttcacgccaaagtcctaggcgggagaaggcgctcgagagggccgaaggatccgcgacttcgacatccacgggagatggaaaaaggcggcgagatggggagcgtcgccttctcgtctacggcgacggcagcacgccccagggcgcgctccaagctgcgggcgcgctcctacgtcacccgcccgtcgccatgacccggagtctccagcccaacgttggctggacgacgtggccaaattggtcatgacggcacggcagcgcctagatgctggtgggcggtcctccgccgccaagacctctggtactgctaccaccggctccgcgtcgtcaagacgaagggcgcggcgagcggcggccgctgttcgccattcggccgccactccttcgtcagcgcctccgacccgggaagatctgcgtggggggtcggatgcccgcaccagtatcgagcgccggcgtaatggccgacgtgctgcccacgcaacggagggcgcctcctcgtccggggtgtcacctcaacatggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaagtctacacgaccgggatcgaggccgccgggggtgacgacagggtcatggcgaatttctttcccatggccctgaagggacaggcgcgaggttggctaatgaacttgccacccgcgtatgtccactcttgggaggatttgtgccaacagttcaccatgaactttcaaggcacatatccgcgcccaggagaggaagcggacttgcacgcagtacagcgaagggatgatgagtcacttcgctcatacattcagcggttctgtcaagtccgcaacaccataccatgcatccctgcacacgcggtgatctacgcgttcaggggggggtgcggcacaaccgcatgctcgaaaagatcgcctccaaagagccccagactaccgcggagctttttcagctcgcggaccgagtggctcgtaaggaggaggcgtggacctggaacccctccggttccggtgtggcagcttcggccgcccccggatccgctgctcagacagggcggcgtgacaggaggaggaagaagaggtcagcccattccgacgacgagggtcatgtcctcgccgtcgaaggcgcttcgcgggccacccgaaaggggaggcctgcgagcgacagaaagaaggaggccggcgctcccggcagggagcgcccaaccggcaagtggtgcatcgtccacaatacctcccttcacgacctcacggactgccgcgcagtcaaaagtttggctgagcggacgaggaagtgggaggaggagaggaggcaggagcgccgagagggtaagtccccggcggttccttccggcaatcggcgaagtgaggccaagcagaaggcccccgccgaggacatcaatgacggcgatgatgacctaggtttccaagagcctggggccaccattggcactggtgatgggggagcgtgtgctcancgttctcgccggagcctcaaggccatgaagcgagagcttcttgccgcggcccctactcatgaa

SEQ ID NO: 65874 - DNA, 30973 bp, Oryza sativa
  unsure (1)..(30973): unsure at all n locations
atggcctgttccatggaggtttcacctgatttgtgggccctccaatcggtgtgctcgcgcctgattggctggaggtgtgtttctttgcatgccgggtgtgttttcttcttaaaatccctgcatacacatatttcaccaacactagtggaattgattagtaataatccctaccactatgttggtttccacattttattccattatatgcaggcattgacggtcaaatattatgacttaaggaccgtcaacactgttgctgtggaataggcaaatgttgtcccatggttatctacggaatcggctcaactatcggttgccttggtctaaacatagatgcgactcggtccagagagattcgaacaaccctacattcataaccaggtatttagaagtgcatttgttgtcttttagattacatatttactatattgcaaattgatcgtatgcgataacaaaattaactctaaacggtaaaattgaaaccacttctacttgaacaacaacttgaatagaagtatacatgtttaataatttattcaaatacttgtttatttatcaccaacaaatataaattttgtggaattttagctctccgttttgacctcctgaaatttcaatataactttcagcctaactaatttcatcttttcaccagatttaaaatacttggaatttatgtgtgaaactttgaaaaatggaacctataaaccaacacctatcaccacaccatattcctgaatttttgaacaagttttacctagacaaatcgaatttaccatgagagggaaagaaaataaatcctggaaattgaaagaacgaatctatactcagtttttcacccacctctctcaccctcatagacagccatgtcttgggtccacttgtcactgaccttgggtgcctcttaaaccccacaacacacccatgggcgtgctcccacctcagaacttaaggggggcagagaaaaccccttcttcttcctccccattcattttttttcgaaaggattccctttcattttcactgcctgttctttcttttcctcctcaagctgagttcacatctaacttctcctccccaaaccccatccaatagcccaagatcaatccatgcatgttagaccacaacaatccccatcatccaagctttccatccatcccaacatcttgcacatgcatggagagttgagagagatcgagaaggaataagagagtggtggtttcagcctacagggcagcaacagcagcattttgttttcctccatttggtgagcttccttttcatccatggtgcctcttttgaattccctccatgttgaacatctatagcataacgttgtccactgtagacccccgattttggaaatcggaaatcttctgtgtttatccgtaccaatccctggatcagtagttggtacacacatacatagttgaatcacaacatatcacgaatgaattcaggctaaaagagttaaatacttacattagggccaggtagcccgtcaactatcagataacagcagcggaagaccaaataatataagggcccggttaacatgccacaggcagtcgactggggaacgagacctagaaccagaccgcactccgatcatcttgttggatacgcaagcgtaccgacaagggcttctcttcaacactctcctaaaagatgtataaatagcaagagtgagtaccaaccgtactcagcaagccaccacaacaacaatgcatatgatagagggtatttcaaggaatagccacggttcttttgcgcaaagcaagttttgcaattcttttcataagcctaagacctagcatagactgatcaaattttagtaccagtgttcacattaaacaatgacggttctgtccaccatccattgtgatcccaaggatagcttcccgccattgagtcgtcatggttttctgaggacgtccaccttccctcctctcaggaagtggctccatcagcataaaaatcatcatgcaatatcccatcccacacaagttaagaatttagagtctagccaagtgtaatacatgtcccagtgctcaataaccgcgagcacggctattcgaatagatttggtttactcacactgcagtggatgtacactttacccgcactccgcactancaacacatgagcctcgtcccaacacatgagacgcgtcacggcanagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcaatcctaccaatggcgacaccgatgtagggcgacgcctctcggccctacctcaacggctgtcccacagtagcgcacctacctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacagtactagccttttccagataccacccaaatcctccgtccgccccagtcgaaaacggttgtttagttttatttctcctttcacaaatcatgtcatcaacatcatggcagtgtggcgctcatgtctccacatgccgcatctcaattaccttcccaaaggtaattgcccaagcatatagcatttgataaatatgggtatgcatgattctagaatagcacttctaagcaattgtcataattgactagggactcatacgtaaacatggttacgaaggaataaggggtaaacaataatcaaggcatggcataatcacaagtaggatgttcatcattgcatgcaattttatttgtaaataaaataatttcgcaattgggatcaacatgttcaaagaatagtgatgacttgcctgcgcatgatagtccttattcttgatataattattgttcaaccttcacctcctggaagttgtagatgttgccttacaactgaccgatacacaatttctataatacgcgagaaaaaccaatattcaagcaacattcaaatatgcacaaacaaaatatatttgatgaggtcgaacctagggttgctcattttattcgcgcttgctgatggattccaacatgctaagggctaaagtttcttaatctttctgttgtcatggtggtctatttaggagctagccaacgtagtataaatgagatacatatctggctaatatgtggtttagtctagctaaaggctatggaaggattatggctacacatgcatcgatctaaataaaatggtcatatactagaggttctgttgtcgtcggatggatttgggatcaagcaattaatcgcagggaaccatttgtattattattttattgatggaggctttgctttaattatgaaaatattttacttgtcacaataaattagaaaaggttaataattatccatgctttgtatgttagagttgtttaggttaatcatattatggttacagattatcccatcacataattttacaatgaataatcctaatttacaattgaactataattatatgagatcaagatttataactagtatttatctaatattcatgtttgtcatatagtccctctaatttaatatatgcaacaagcaaattaatactataccgtatagctataatgggatgtacagtataggtgtgtgcacaatatcttaatattgaatcatttatttgaatagttgctatttcctacgagctacacagtacatgtgattttaagtggatttatgagtgagttaccgtctatacaacttaagggtcgatttccaacctacacatatactactgtataggaaatgccgttaattaatttcgtgcgggtgattttagtcacactagctctgttattatctctcataaacaagttaaagactcatctatgtgtgttcaacttttagtcgcaaagtatgaggctaaacattatttatacaatttggacgtcacgagtataattatatattgacatatattaataaatggcactagtatttcctatgctttaattaatttgaaacaatgctcctaattagtttacataggttttacagtgagaaagcgtgttaaagacaattatttgacatctactttacagtacaatatcaattttatttattagcacatttttaagttaactattatgcatcatcttgatattaattatttaataattataaatatattttatcaaataaatagtgaattatataccattggaaagcttatgaatttagatgaatttaggttcaagtttcactcaaatcagagctaaaatgaataagttatgctagtgtaaagattcaaatttgaattaattctaataattacgaaatggtactgttcctaattcatttatttataatacaaccttatccacaagctatagtgactgacaggtggggtcttcctatttcttttcttttattttacttttctttctaaaggaatccatacgggcaaatgacaggtgggcctaactcctttgactagggtcaaaccggccattaaacccggtagggcccgcttgtcatagactcgaaactataaactctccataactagatttttaacgacccggacctacatgtaatagacttaactaataaagattaagaaggggattactatttactaatcacgtggggcccactctaacctctcttctctattctcttttctctctctgctttctctgttttctcctctctctctctctctcacggccgagcggcgcggctaccggcgacgaagggaggcgggagggcttactggaccggcggcgacggcggcgaggacacggcggcggggtgcggcgtggcggcggcgagacgccggggcatggcagcggcggcgcggcggcggaatgcggcgtcggtggaggggaagaaagagcaaaaaggggagaagatggggggaatggcgtggggagggaagggaaagggggggtatttatagggctcgggggaggggtggccggctttaaacgtcgacgggatggcgcggcgacgcggggctcggggcgatggtgacgcgcggcgttgggatggcgagcgcgacgacaacagtgcgcggcgcgggcggggctcgaggcggtgatggcgacggcggtgacgcgatagcgcagcagtggcgcggggatcaagggtgacggcgttgcgatggagcgcggcgcggcgataggacggcgctcggcgcggcagtggcgacgggacggcgatggtgacggcacgcggcgcggtgatgatgacgacgtgatggcgacggcgacgtgacgcgcggaggggtggggctccaggcgacgcgatcggagacggcgacggcgcgtgacacgatgggacgcgagggggcgcggcagcgcgcgcagagcgaagcaacggcgcgcggcacgtctgagcgacggcgacggcgacacgatggggtgcggcggcgcggggcgcaaggcagcggcgcggcagggctaggcgcgacacggcaaggcagggcaaggctaggcgcagcgcgggcagggggagggcggcgatgggacagggttgagcacctagggggcaatgaacagtgctagccgatttatttggattttattagatgttttttctaatttagaaaatggactattgccacctattttgttacaatgtgtttcacacaaaatctatgttattccatcaaaatttatattcaaatttaatattgaacatatccttattattattatatatttttctgagttttcctattttcttacttttaaggctttggttgatttataaattgagaaaagttgcaaattaattttttatttactcctaagcatttgggtgaccgtattaagtgttcaatgtgaatttgcccaaaatttaatactgtccaatatttaaggtttattaaagattctataatttcctatatttgggattttggtatttatctgttttcacacatattggtttatcttcttggattggttttaccaccacatggatttctataatttagcatttgtgattcaattcaaattatataatatctaattattttttcccagtaaaactattctatagatagagttccatttatttgaacgattatcatttcctaagtgtttatatttcatggcacgcatcacatgttcaagtatttaatatttgatccataaattaaattagtaattaaccttccctttttatggctttgttttcttgtgcgtaaatatttatagggttcataataaatatcttattattataattattacttagttgtataactttagtttaattttccattgtgacaatttatagtttggcaagcaaaagcaaccataacatccagcatgatgcaaaaattttaaaaagttcaaaattctagtgattttgattgtcttgaattttcagggtgttacatccactccattgctgtagctagaaggtagctgcaactcaccccgagttcatctcttttgatttcggttgaagcagccctaggcaacgtctcttgccgtcagcccgaggccttgctccgtctcttgccatcagcccgaggccttagcctcgcacaaccctacgtccaggctgttgccatgtgagcgaaatccggtggaagttggagaaaaggggagtgaaactagaaatcgatttctgagatagctattgagctgaatgagtatgaactttaaaaatccataactaattcatatgaactccgaattcagtgaaccaaattcctatagattcataaaaatgaccaacttttgtactggttttcccagtaaaaatataaatagctatatgtctcccttgtgtggtctagctcttaataatttcgtaagaaattattggtaaaagctaaaattgcaaaccaattttgttgagcttatattttagtaatctttgctattgtgaagtttttggtaaaactacctcttaaatcttgtttaggactttatttagcattcccatgattttaacttgtaaaacccatatatgaataatgacaacacatatagctatgaaatattttttcttagaacctgtgagtgatgtactttactctaaaaataatcattattatgaaatcttggtttgaaatgcatgtttcttgtaatgtactaaaggaaacattaatatttacagaactgccattttcagcaccttagagcttgtcattttcatatctcccaaaccataagtgataatcttgtgattctttcatctaaattcaagttaaaatatgatctacccactgtatttatttcataatttattgatcattttgcatgtgcatgtttatttggctcttattcgcatattgcttcttttcggtagattcagagaatacggagagtaacgagccatatccagaggaggatagtgactaccctcagcagcaaggcaagcacctaagcatatagaacctatgctttctctaaaaatgatttgtttgcaatctatacgtatatatatatatatatatgcatgcattgcctagatattaatattgtcggtttatggtgtatgggtagaacctatttatgcatttagttcttgtgatattgctatccttataccctattaccactagtcgggattacttgggatgtcttattcattaatgcttagccatgcttagtgctaatagaactatagggatggacaatgttgttaattgtggtatatagacaacttgcattattgggcataaaacttgagcacttacacaaaataatggttgatgaaatatgttggacttggacgggtgatagggcgatgatgggaggttggtttcccctgatgcaagtagccccgtctaggtcattaaggaccgaacattttgacttctaatcaagcaccctacgtacttaccacatatcttatttgggaccggcttgttcttactagttctactgtgatcatttataccactgtcacatcctgatttttgttttaggatttataaattatttaataaattattattagaatttatattaaatgttcactaatttacaagaagttaaatgtgggaaataaaatttcctaaatataaagcatggctggatttaatttttattaaattctccatggttaattatactctctggaattttcttggatttttcggagctcaattcctaattttaatcttacaaacaacatttcagtaattatccacatattaaattaatcattaaatggtctaattataatcttgttaagtacttcgagtgtccaagtattttcaggatttttcttgaaattatttgagcattggaagtatttttaacaattcaaagatcatttcagtgattaatttaattggaaaagtaattaaaattcctcttttccttttcgggccgaaacaggaaaagttctatctttcttggcccaatctcctcttttcctgaaggtcgtgctcgcgaaccggtccttaattgttatgagtacgatcttcaaaaccatgtgctcacaacccaccattgacaagttttaattatcaattaattatcataacacgattaaccttcgtgagctaccattaaatataaccataaataataatgtagaatgatccatcccattaatgagctaatgtttctaagcatagctaagcaattatatatatatatatatatatatatatatatatatatatatatatatatatatatatatatatatatatatatatagcttttagctgaaccaaactaatatataaggttcaaactaatcaatttgttatccaaggtatcaaggaataggataatcaatgcaaactggccataacaaaggaataggttcacaccacccggtgacattcgaaaaataaatacacagttgaaataaatagagaatttaaatataggatcaacatggtcaaaggattgtgtttgggatctatgtgacttgctttgcaataatcggtcttcaattagtcttcttgaacacttccgacgcactcacgaaccttcgcaacgacgaaaacgacaagctaacacgcaaaacgaggaaaaagactaataaaaaccaaatagatcatgattttagatgaatttagagacttgaacggcctcattccgagttcatctgaattagttacgaattttacaagattaaactgattttagccttatacagaaaaggattaacgatttatttcagaaaagaaaagggctttatgacatcatcaccggaacaaggcactggaccacacggccaccggcgctagaggactcggccggaccaaccgagggcatctacgcgaaggggatgacgagacaaactcaccaaggggcggcacgacgacgaacgacgatggaagacgaccagcgacgagctccgaacggcggcgaagtcgggacgacgacgacggcgactttccggcgacgagcagcggcaacggaggggtggacgggcttctcctcggtgctgcgatgccgagggaggtggcggcacaggttggggacgaggcgactgctaggggcggctggagcggctgccggcggtggacagagaagacgaacgcggcgacgacgctacaagcgacggtggagagaggtagaggtgccagccgaaagaggagagggaggggactctatttatagccatgggagagagatcgatccaacaacgagagaatcggagccgggattttctagggtttggtttggagagataaacacgaatcgagctagattccgcgttgattcttcgggataaagtccgattcttgggggaaaggatagaggaggataagaggaatatttcccctcaactaattttgaaataacacgagagaggagaccggatttggaggggaaatcgacggcaatggcggcatcgggctctgtctccagccggctggaggttgaagatgccactgtagcggcagggaggaaaagtagactctgtagatggtagatgcacgggcgtcatgacagaacacacattttcattgcatgtaccatagaatcgtaatgttggtgttagccttacaaatatatcatattaaaaaatataaacattatgagtaggctaccaaatccaattgttgaggctgtctgaatcttatcgttcttactgatctgttcacagttgtcacggtcttttggaacattgatttcattttggttaacagcggcacgcttgtttgtcaacttggtatcaattagattagttatatcggcaaaaggacctaagggaggtatttgtaaaattaggaggaaaaaatatctcaatcaagcaatgactatgactatgtctgggtggatgaaagtcggacatgatcttttcaacgatcttgaggcggaatccctaccattgttatccattgcaagtaacttcttcatattttaaatgcaactctacaaaaatcaatttttggtatcaattaaatcctcataagctcataacaaattcgacttttcctctctaactataactgaaatatatagattatgatgtggggatcatgacgtgaaagagctaccagaaaggtagatgggtaaactgcacagcagaaaattaagacaaaaacatggtgcatgtactgaaatggatttcttaataccataatatatagaagacactaagcaataacagagaatcaaatcaacttcaccattgcacctatatgcttgaatatatgaatgataaaaccgatcccaaaaataaggaaataagaatcagggtcatgcggagaagagacattttattcagtgcccctattctgtaatgattcttgttcagtgcttctaaacatagctcaatcagctatataggcacacaatactccaagcaaaagagcacatgccaaaaaaaataatttgtcccctgtctacatgagcaatgcaaatttcgaagctgccaccactacagttataaaataaccaagccatttaaggacaccaaagctacatatcaaatttatttgacacaatactatggatcaaaagagagtagtcaagaccttcgatcacaagcggatccaagatacttaggtctgcacaacaccagaaagttagatgtccacacaaatacacacatacagacatgaaaccccaatctcacacaagaaacccgcaagaaaaacagccttcacgcttcaaactctcatgagagatctcattccccgcttgcgctagggacacgagctgtggtttgccttctgcaacagcaaagctgtggtttgtctactgcaacagcaaaaaaataatcaaaacatgcagccacatcctttttaatcagcaaaaaataatacataactgaataaaattgacacaagagaaggtttgcgtaactcaccttggagagactggagagaaggtcgatcatgatggagaacgatggtgatgggcaaggtagaattttgatttgtaataaatttagcacattatctacctaaatgaaatgaaaccaaatcagcgagagagtttaaaaaataaattaccactgacctcctaaatacagtaatcacacttacagcaaaaaaaacttcattcagtttggatgtttcatcagcaacttcacaactcagacactaccataatgagatggttttaatttttcacaaaatgatctcatctacaatgtataggacacctggtcatatgcacgttagtagtacctctcccacaattcaaggcaacaccagaattggacaacgataattaaaaatttatgccttcattggattgactcatagcacatacaaaggttaggccctgcaatttagtaacaattgactgttgatcatagaaagcaatgtcagaacctttttttccagatggtcaatttcagaaagacttcccccttcacaaaatttctttgttcagagatcatagtacaaaagttgagtgcctttaattaattgcacagaaaggtccatctacaacaaaaatgcagaacaagggataaatggtaggatatagtgttatactgaccagatgtatgtatgatatttcgtcacaacctgaccatgtaagtggggtgataattctgcaaccaccattaaatctaattgtcattgtcattaaggtgagtcagtgtaggtgctgtttttacttgctagcagtatggtagagtatgactaacattatggtttttatagcatgattgaaaattgaaataattaaataatggtgaacttttggggctgcatgaatgtctaggctgaactgaatttttgcctaactttttgggggaaaaaaactaaaggcatttgatcgagcactacgggagcaatggcacgaagcaatgtagtacatgtcaagagcgttgggcacagccgtccatggcctgccggcctgctcgacccctgccttgacgtggtgggaggcgacggtgattctctgtggcggcgtgacggagatcacacggcaggaagagtgcgcacgcataggggggcacgcaggagagcagagcggggatcgactgcgtggcgtggatggaggcggtggcgtttgggggagagcgagggggcgggaggcgaggagacaggcggaggtaggtgctggaggccgtcggcaggcgatggcggggcacgacggcgacgagcgtcgacggcaggcgatgcagcgtggagtgcgaggtggagaaacgccggggacggggatgtggggcggcagactggacagcggtggaggtggatatgacgacagcgctcgatccaacgatgggcgcggcgaaggggattcggctacggtggaggacgcgggatcggtggcggtgatctaggaggaggtgcgggacgggagggaggtgtggtgccgccgcggattgcggaggcggaggggattcacgacgagatgatgagccgtggctaatgtgaccatggttactacggatacatccgttgatcacatcatagaagaacaataagatatcaagttcgagtcctccaaatgccagaatccaattcggccatctgctacactgctgacttcaaacggccgccgaatctgcatacgacctccgttttcggcccatgagtacttgatggaaagctctcggagtcctctttccaatggatccaacctcattgccaaattccatctcagtcggcagaaactgaagaaacaagttgctgtgacacctgtaatgggcctatgggcttgtaacttcgtctgggaccccggcccaagtgaggcccatgtggggtgcatcccaaccaggtggaggacgacctagaggacctcccacctccttaaatagctaggtagccctttagagtttcttgggttttgatagattaaagtttagccattgctacttgcttgcagcgcgcgtgtcagctagaccgtccgtctgcttgttcttcggaaccccaacttatcatttgtattaaattcctatttgcaatatcagattgcttttatcttattcttgcttgtttcttcgatttgcttgcaggaatagggttgatctgcaccggcaagatcagcaacccacggagaggtgtatcgatcgctaaggctcaacacaacgtctcatacggttgtagtcagatcgtcaacgtttctcctaaattgtagttatcacaactcaccgaaagatcgggccaacaacagccttgagtgtcgagagtaactcagggttcatcaaacaagtataggatgcctaccaaagatgatcaagtgtaacactagatctaatgtttgtttgactatgcctttatgcaatgaattgttggcggtggtcttgacatcttaaataccaacctttttttttcagatgcaatacaagtttttgttgtttttttttgttctaaaagtttttgttgtttcacagcagaaactggacattttgatgatggtatacacaaatcaaaatttatggtgtgaccagtgacaattgctctttctctattcttgtcttcccgctccatactctatccaattctctatgaccagaaatgcgtagaattggtacctcaggctgatgcactttaaaaccatttgttttgatagtgagactgcgagtataaatcacatcgaagcgcggttgaaggggagcataaagaagtgaaacattgagctttaaattcttgcctgtagcaaccgttgactatgaacatttggtgttctttctaagaaatgataaaagtggacaaggccaaatggttgaagttcagtttgcacaatgaccagtaaaaaaattttaagaaattttcttgtgcaattaattaatcttgaatttatttttacatgttctcatctgaaaaacatggttgacttacgaatccatgtttcaggcgctacgcacattattgaaaataaactcttgaaatgcctaaacaattgagcataaaaagtccaatatttttacttttgttgttctctccacttctcatgtaaaaatgattatatatacatacatttgaggcacaaattttcatttataaatgataattgtgcttatccccgttgcaacgcacaggcactcaactagttaattattcttaaaaatacctaaaagcccgtaagctaatactctttggtcgtaattcaaggtgtctacttgaggattgcatgtatatcataatttaaattcattttaatttttttatcaagacatatcataatttaagttctcaaatttgtaattccaagttttaaaaaataaattaacaaacaaatgttaaacctagaaaaaaaagaccaccaaatgaaacaaaaacataacaaaatatactctcttgggattcaaacatagacaaagcgttctgtcttttataatagggttaattggatccatactattgtagatttgactattcagaaaaataccattataattcgtttatttgtagccgtgccactgaacttttacaaaattaattaaaaccgtgccactaccgtaacattttccatgtattcccttcattttccatcttcttcctcccttctcccgtcttcttccttcctggccgtggcggacagggtgtagttccaaagcaacgcggagatgacggtgagcttggtgctacaaagctggccggtgcagcacactagccgcggcacactagcccgaccggcatgctcaggagctcgccgctggagccgcatggcagcgcgcgtcggcaacagctccggtggcaacaggcaccacgcttgcttttgcgtcggcaacagctccagcaaggagtcccttgttccacctcctgtactagcctatggtggtgttcttttcttctgaaaatgaagatgacgatgaagatgtatcactggattcagcaaccatatgagcataatgatgcctgcctcaccaaggcttgctcgagttcgccgcggactgaggaggagaccgacgctgccagcgaggtggggacgcgcggatcggccgcgggaacgggagagccagcttgctggcgccggcggcagcggagtaggcaaggcgctggtgctagagcccgccagatggaggaggaagaggaggcgaggcggcggccggagctggcaggagtcatcgggagcaaacagctcaccgcggcggtcgggcaccacgccgagcagcttctccatgcagcaccccgcgatggcggcgaaggacccgccgcgcgcgccgccgcggcgacgacgccgccgactacgccgaagcgtgaagccgcgcggatgacgtggttgcgcttgcggctgctgctgctacaccacccacagcttcgtggcagagcccctgaagatggggctctgcgggcaggcacgccgccctaacgacaggaacggcgagcacagcgttgccgctgtggccaacgttgatgccgtcgtcggctgtgccgacgcgtgaagccacgcggacgctgtgctcgccgccgacgtagcagacgcactcaacttcgctgcgggaaaaagaagggagaagacagaagaaggaagaagacgaaaagggaagggaatggataaaaaatgtgatggcaatggtacggttttaattttgtaaaatatcaatggcatggtttcaaacaaacgaattgtaatagtatttttctaaacgcgcaaatttgcaataccatggatcgaattaaccctttataatacgcgcagatcctagataacgtggcaaaccgttgccaccttaaacagggcatcagcacaatgcatgtggcaaactctaccgttgccaccttaattttttcaattagtatttgccagtctattcttaaaaacaagttttccaaaagggtcaatttatcaatttttggtagaaaataggacactctacatttgtagtgtaattatatttgaaaggttttaggagaactttttctgtcaaaactcaaaagtagtcccttctatttgtttggaccagtcacaccccattaggccattaaaccacgcctaccgaaaaccagatacaaattctgctcaaaaggtctcagctttcaagccttagccagttttttattcttttgcccttcttttatttttttaaaacgaagtcatcttcattattcattcgagataaactttttttttctcctgaggaaactactatccgacggtactacaatttgttacaatagaaaattggtaaatcttagtagtcgcctaattttggtgcgcatctgagtttacagatcggtgttacataaccacgtataacaccaacagaggatcatctcatgttgccctctcttaggacatcaatcatatcatataatttcttgttggcaccagattgtatctgcagtaacagtagcaggacagttaacttatttgccactagcacgcctaagaacagagaaatttatatgtcacattccatgaacagtaactggattctgacctttttatggagaaacagggcagcatccacagttccctctgcgtaaattgaacggccacatacattgtgttgaaactcaaatgaaactctgcataaataaggggtatcacctcagtacgttgtgcttgtcaaggctctcaatagaatccagcagacctaggaaaaggtttacttacgtctcatccggtgaagtgagatggtacatgtgaaatgcgtgaccagaaagatgttcttctgggacaccaaccaatgtaagctgttcctgaggatcccggacctgcttaacctacaagaaagacatgtagaccagtgtgagagtttgtgaagaacatctcaaggaggttttggttatgctccaacaaaactacaatgcaagaagctgcttcaacaaaactagatatcagccttaagaccattagcctaataaaagtgtgttcgctgctgatggatgggaacatatcaccccagcacggaaaacggagcagtccattagcgcatgattaattaagtattagctatttttttttcaaaaatagatcaatatgatttttttaagcaactttcttatagaaactttttacaaaaaaaacgcaccgtttagcagtttgaaaagcgtgcacgcggaattcaagggagaggggttgggaacccttgggtccgaacacaccctaagacatattagatccaaacaaaaagcgagattttacagtacatcaagcaccaaccctaaaaggtactgacaggttgtccaacactgaatttgcagtgtgcagcatgttactctgagagacagacattgggacaagtaaactagtactactaattaaatctaagtatctagtatagctcattcttgaaatggaacagaagatgcatgcttagtttcttacataatcgtaaactgatttttacataagagaaagcaaatggcaatcctctaaaactaacaataatctgcgaaagacagatatgacaatgtttcataaaaaacaaattcaacataacgattttctgaccatgtaagcttccagttaacatttacctcgttcaagttaaatgacacacccaacttctgaaagcaagagataacagctttggccgtgccagaaatgtccaattttgtagcttgatgagactccatgacctgccaattttgttatttcaaagaagagtcatgggccactgcaaaatatgaaactaaagtatatgatgtacattcagttataacaatagatggattccaatggagacaaataagataaacctactcacaactggatgtgattccaagagccaaaccagaatgaataccacacagtggagataaataagataaacttactgcctgagttatccttatcgactaaacaaatgaatgcatcctgctggacatttatactaaaatactaactgtactttctagtatgtaaagggtgaaaactctaaatggtttaataagctctaggtctgcgtctgacaagtaataactgtggacccccgactctaaatatgtcaagtactaaatgtgttcctgcgcctataactacatctccctaagtagtaaatgtgttccctgaaactgtaaatgcgcaggggcctggtagcaccgttgacactgaatagtagatatgtattttttatagatcatttagctagtcactatagagttgtcaatccaaatcttctgtgaagtttcaatttgcaagaatctgtgcttcaaagtgaagttccatagagcttaacatctaaatagagtgttgacttgtcaagaggaggcacttttcaagtgtaagtcgtatgtgaggctgattccaaatagcttatgagtctaaccatctcagtcataaattttgcaaagactaaacccctgaaaagttaactttcatgtggcatgtacagttgtacaagcacaggcttacaattctagctccaccactgtggtttaggactgaagcacaaatgcagatagaagataggcatactcagggtgttaacggtagttaattcaaatgattagaacattaatgcatcatacatcataatggttaccaattaacagaaatatcgctgatctttcttccattttcctacgatatagctaatttctgcagttcctaatgtagcatgtaagttccacatggatactgttccagtggtttggttcataagttctctaccacttactagttactccactcacttaaaacttccataccaactgaaattgctgagctaaataccatcatgattctttaataaacttcctaacatcaagttaatatgataaagttttctgtttgcacattattgcaagcaaattactgagcccataatgaatacaagtacacaactcatatcaatcaactgaagcaccaaatttgatgttgaatgaagaacaaagagacagttataatgcttgcaaggaaaaatcaaactatacctctagtttgtaacctgaaaatgcaccggggaattgctctgccatgatttccatggcagcaagaaacgcgacaacctaattggaaggaaaaataggagtaagcagtattaataaggagaagatcattagcttgaccatgcaatggaaatagttatacctgcttccccatctgtggggatatcacagcatacacgtttgcgtcctcaactgttttgtgcaacagttgcctatttccacctgttgtgcccataacaaatggcaatccaagtttacagtaaagctcagcattagctgcacatcaaaaacaccataaatgtcagattagcagcaataatagtgagcaaataatatgaaaataaggaacataaagcatatcagagagtttaatttaattaactaactaataaataaaagttaaaaggctgacataagatgaagagcagtagcggctatcctgccaaacctacttccgatagaatatcaactaaggaagattggattctgtagttaaatattcctgtttctttttgtacagttgcaaacagaacaacagacaaccatacatacataagctaacgggatcattataatcgaacatacaacttaatgattacaacttgctcttctatccattcatcaaaatatacgataattttcaactaggttcagttgtatgcactatgtagaagaagctcgagctgaacatgagatagggatttgtctgatataaacaaccggcagtttttgctgatgcaattacggaatgcttacttttggtagagtttagcatataaggagatcaagcaacagaaaatatttatatgctcaccattaacagcatcaggaacagtgtagtcaacaactatcatatctgggtaatccttagcaatcgaagggagaatactttctccttcagatgggtcacgaatataaatttccctatcacaaatttcaacctttccatcaggaacctcaatagcactgaatgatacaggaactaactgaagaccagcagatacagctgcttcagcaacagccttccccattttcccagtacaactattcacctaaacaggtaaatattggtataataagtgaaatctgagataataaaataatggatctacaggaatgtaaatcatagaagcagttaagcggtgctttaatgaaaattttggaagtaattactaatcttagtaacttcaaactcaagcatcacagtatgatgtggagatgttgcaaggagaaaaattcagtacgtctggatcttaaatttacagaacactcaaacaaagtaaaaaaaaaaaaaaaaaaacaggtcagctcaacacgatatatgattgttgacgtgaaaactaatgaaaaggtaaaacagcagctaccagctttttaatatcgtgtgctaatcatagtaactgaaactaaacaagcaatcgaacctgtcggacttccatttcatggtgctacgcacccatttctatatatgaaattgctttataggatattgtctggaaactgaagtactgaatacaacatattaagtgactcaggcagctaaaaggcaagtttgattgagtttttttcaatgctcttttcaaaagcatattttagaagggaggaactgtgaactctatcttcagtaaagtagtacagcggttagattttccaaactctatatttttgttgtagtataatctcaaactgaacatcttttttatgtgcctaattgagttggtcaaacatcccaaattccattccactaccttcttgtcgagcagaaagcaactaactatcagtacatcctccagctgcaggaaaccaaccatgtgcaagaaatgggataggaagaagatgaacgatctttggcacagctgactcgagccagcctgtcccgattggcaaccccttgcactgaacccgcatcaagaattgagaggaagaaaatgaacaggagagatggaaggagaccaaggaagaagatgagggtaatttgttctaaaaattttagtaaacgcatcaaaagggtatgtagtggtatatttccaatacctaaaaaattataaaggcatggctctaaatagttgaatagtagtggcatatatcaaaactgatgaatttataatggcatggattcaattaaccctaatattattgccaacactaattcataatggctgaattaaggaacagaacaggaaaaaaaaagtaaatagatccctttattgtgttgataatcattttgcagccatttctcctttcctacatttcccagtttcggatggaagataatcataattaaagtaaacactaacaagtactccttaggcaatgccaaaggtacgagttaatggccttggcctgtttggttggcagccaaaggttgcaatgccaaaccttaggcacgctgcatgacacaatttgttagcctagtgcttagttggtcggtataattgtggattgccaaacttcgttagtttttatcaaattgcattttgtgtggcaatgcaacacatctggcaaagtgaggtgtgtggacaccaagcaaaccggccctaattcctaaatccacaacaagggcagagccaaaccaagcaaccttaccagtatcgggaacgagtgcttgggaggcgccgcaggggcactctcgaggctctggctagcgagggcgttcgtgatcgaaagcctcgccattggaaaccgccgcctcagcgtcaccgtgacgatttgggaacagaacggcaggcgccagcggatcggacctcgtcgcctggcggctgcagcggcagcagggtgcgtggcaaaggtggaggcgagcatttgggtaggtttctgggatattggtagccggaggagaggacgtagagcggcggcgaaggaggaggaggaaggtgagccctgcccgagtctagggttttgggcgatttggcgttttctttttcttccttgaacggcccattcaaaacccggcccgaggttaaaaaattcccgaaggcccaaagtctatattttgatttaaacccctaatggtggtgtttgaatctcctggagatgaagattaagtatttcacgcaaaacgatgtgataataacgtgtgattaattgagttttaattattataaacttgaaaaatgtattaatctgatattttagaacaactttcatatagaaagtttttgcacggaacacactgtttagcagtttgaatagcgtgccatgagtatccaaattttaatccactcctttaagaagaaacgaatgggacctatttctgcttattaggatagtaatcttttggaatatgatattatttaactagaaaaggactgtgcgttgcaacggaaaacctaatcgtttaggttcatggcgccttgcatgtgtagtattttgacattatggatcatgatgttgacccacatggcaagctatcgtgtagcgcttgcttcacttgattgcaaaaatctcttcgaactaataaatggtgggtcattgaactgaatatgatttgtcgcgtgaggagaaatatgacagcagttcaaaattcttaatgatagcattagtctggagataacaaggatccacctaggcactgaaaaagccaagccgccagatctgcattcaaattcaatcaggattgcattgtagtcaatcataaatctaatttgatcatacatgtttaaaaagtaatatatgtatatacctttcaaaaattgcattagaattttcatcaaattggaagaatgggtttcctcaacttggtgaacctcgacaaaggaataatataatcaaatggaaatttagcctaatttaattcagctttaccaatttacacgcagataccacacgagtaggccaatggcagacaggattttcatgatgtgtattcaagatttacaccatgacatttagaagaactattctttgtgttatcaataaaaaaaatgctagtttttttaataataaaaagatgataatgtgtagaaaaacatagtagaaaattatatatatattgccgttttaacatgaatttcaccgtgacatttgaaagatattccttatgttatcaataaaaaaaatgcaaagttggtgataaaatgtagaaaaacacagtagaaaattacatatattactggtggtttaataataaggggcaattgtgttcctgcccttactttctagttcaattatgattttatccctactttttagggtttgtgattttgcccctacttttttaaatgaagcaaccgtctacccttggttttgacggtagttaggtgggccccaagtttctgaatcaaatgagggaaaaaacgatattgtaatttgtgaattaccatcatgcccctgatttcactaaatcagtctaccacgtgtgaatcggcatttccccaatcgaaaaacctagatcgaaggcggcgcacgcgaggaagcggcggcagagacgcgcagggaggcgcggcgtcgcacgcgagcaagcggcggcagcctcacgggccagcgcgcaggaggctaggcggtgcggcggcctcgtgggcctagctcgcaatgcggcgggccagcgcgcagggaggcacggcggcctcgcgatccggcgcgcagggacagaggcggcggccggcggcgggagcagcaggcgcaaaggcggcggatgggctcgcgcgcggcccgacggcatgcccgcacgacagcaactgtgttggcaacaacattttgccattgggtgcatctgccgtagaggaaggcgccgagtgcatcgcctcatgcgccgcctccttgatggttcattttgttgattgaattaactggcaagcagctgggataaatcattgagggctctgctatatgtgtggatttgggattttttttttttttggctctggttctcctttccttttcctttttcatgaaaagttgggtaataaattgatttgtttggaaaattggtcgccttcttctttctttttcccttcgtgatgtatatatgtgcaacttatatgttcctgaaaaactggcaataaattgatttgtgtggaggtgccatacaatctcaaagttaaatcttttagtatgcatgccagatccatcgccgcatgcatgacacaacggggcaaaaacactgcatcctcacaaagaatgcaaagggcacacctgtccttctaccactaaattaacaccattaaggggacttgacagagtaggggcaaactgaagcttcggtttgaaaaaacaggagcaaaattacaaaccttgtaaaatcataattgcaactcgaaatagggacaagaacacaattacccctaataataataggaggtaataaagtgtagaaaaacacattaagaaattacatatattgctggtttaatatgaattttcaaacatatgaatgcacttttaaaaaatataatcagcttaggagagaaagaaaaaattggtgaggataagcagcatctacccagttcaacaaatggttttactcattcatcgtgtgacatatccaacaatacaaaatcatttgttgagttgtatccgacgtcacatagcccgccgcgctccctccctctcttcgatctcattcccctgaaatcacgcaaaatcacgcctaactccacaaatgacgccgctgtcgccaccactcagattcggtgcaccaccttgcccgtgagcccatccacacatcggcgccccctcaaccctagcgtcattgttccccttgggctagcggaggcagtggctggttatagctttataggactgttgatgtgaaaaacacacactggcctgagagatttgctttactctagtgcaggtccaaagaattgcttctgatttctaagcgtgccagttggtttgcaaccaacaagaaataaaagagaaacaagaaaacaaagttaaatccgtaaacgatagccgatgacatatcgttcaatattaagccgatgttatttgcattagataggcaatgaagagtaaagcagggtaaagttaaatctactcgatcgggtgtagatattaatgatatataatctatttctaaaaatatgtttaaaccaagtgattgggatagatcggacagtttgccgagacagtataaatcacttatgtttaaaagtactttgagatagagattatatatattcatagcatagccgattaagtaaatctaagatgtatcggctaatactccgataccactctatcttaagatgttaaaacaaacgaaatacactaaatatcaagcttaatatattttaatgcaataagatcttaatataaagggcagatttagcatatcgagtaatcatataaggaacaagatgactaaaccaggtaagatcggctgaaaccccaattctatctctatcgataatcatagaacaagctaaatattatgattctagatattacttagtagatcgaacctaaccgatgcagcataagcataaagagaaacataagatctgaacaagatgatgaaaacctctttgagatggtagatacactatataacctagatcaacgttgatatctaaccttatcgactgccttctgatgatagatgttagccgatttagggttagatagcaatattgatagagattatatagcatatgtgataactcgacgatttacataaacaagattacagtatcataagatgtatgcactaatcccgagaacgtaagctgccatgacaagttttacctcttgctggagatcgaacccgatgcagcccaactcgaaagcaagaactcatcgaaaacaatgaaagtagaaaaggtggcgatccgccgaaagtgttattgaactgtcgttaaattgtttacaaggtcttgggtcatatttatacctaaaatacataatatgtccttgccggacacgactctatctctattataacttaaaatacaaataagtcccttaggtggactcttgccaaacatatctctaagaaaactaccagaatatcctaattaatagatacaattgccttcttagaactcaatccatacgtggcaatacttgtgcagcacatcaatcgatcccgtagatgattctagaaccaccttactaagatcggctacatcggctgttcttcatccgatccaatgtcagccgatgcagacattagccgatgctcctgtagccgatatgcactccgtttctaggaaacgatctctcaccaaatccgcttcgactttagcttcgaatctgatgtataatttaccgaatttggtcgtcaacaaggaccaaggaccaaggtccaaggatgcagcagcggcatatgtaggatggattttgtctggtcaggcgggcggccgtgaagtggcgagactcgagagaaggatgcggcggtcgaaagggaggcgtccagttagcggtgacacgatccaggcaacaaggtaaccttgcctcgaccgcgtccacacccctccgcgcgccggtcgcaatccgtcatgatcacgttgtccccggtgtcctctctctcctacatcatctccgtctcccctccctctcatgcaaccatggtggtggcgagttcttcaagcacggcagcacacaagaactatatgattcaccattatcatcttgtccaagattcatgcttcatgcaggacacggagggagtggaggaagaggtcagaggaggtagtctgttcggcacgaaaatctcaggaagtgcgggcacggagcatggtccctggcgaatccaagtcctttgaggccttaagcagtaacgaaatccatgtactgctataattgcaactattgtttctatattgcagtgtgcaacgcagtgctgtttgtgtatgcacataacaagaatgaaattaaggttggatacaaacaaagtgtggaacctctttcgttctaagctggcatctgctgaaggaaattgtggcctccttttttctgattccttttctattttgtgctctttttttcatgtaggggagcagctctggtgcgacagggaagttggcagcacatacgcatttcattgagcacatcttgagcgttctagatttcttgaatgttttatattgtgatcagaccaataaggtattcaactggcatacagttttctcatttgggctcaagtgattggattggtttcttgtatcttgcaatttgttgtgttaaaaaaatattatagttttattgctaaaagcaatctatcttttctgtcatccagatgaaaacagttacttgtggtatctgtaggcataattatggaagaactggattagcatggataataaatggactacattaattggcgatggtttttggtttagttgagttttctatgcacggtatcttctggtaactatgattgaccttttacattttaaattaagtgaaatgaatcattagggctgctatggacacttgagtacatttgaatgaactagcaaaaagcctgtgctttgaaagttgctgctatggacatccagtgtttattcactcaaatcttgcggacacacgagagtccaatttttcatatatttatttttcttttttttctcgatgtacaaaaattacaattttaataagtaatggggattgaatttgtgtaacccaagaattctccgaaatggcacactgcttgatgagatccacattgtctgaaacttgttttgcgtgatactcagtatgctaatatgaatactaggttttgatagtgtcttggcttaactatttgtttgggtaaatctaaaaccactaaaatatagtaattttgctttgttgatccgtctagggaaataaatgagataggacattacaatgatgccagatacgtatcattgccagaggctatgtataggattcttggtttcccacagttcgatatttattcagctattttgcagctccaatttcatcttcctaacatacattatgtcacgtatgataaggatggtaaaatcgaggatgtttgcaatcgttcatcttcttatatggcattaaacaatctcgatgatggtttaaatttaaatttgttggatgggtagtatgaactgtctatatgccctatccttttgttacatattggaaaaaaaagctatgtgtagagatcagatggacttttcctgtgcgaaactctggattacgattcatgtcaggcatgttttttcaaggataatatcacacatctcttttattttttgccttgtgtttgataaatagtttattttagtatttgtttgtattcatattaaaatggatattccattttaatttcttttatgtatgactcttctaaccaataaatttatttgtctaatgcaaggtagctaactattcaaatttcttagtaccttgtcgggttgtatgatacatctctttatgcgtgtcttgaaaattactttatattatttttatttattttataaataaatgcatttgtaggatattgatgagctaaggcaacaatttttgctacatctactaatgtaccaacaaaatgagtgcaaaagcaacatttctagcgatacatgagaatttcttaaatgtatcctaaatgctaaacattagggtagttatttatctatagggtatattctgtatatgtatcaaatgctttatttttgtacttgtttatacccgtaactaattaatggaatagctctatacttttaacatttttttagaactttaacatatttttaaacgtatatctccctcgtatattgtatattgaagtgattatatgttactaattcttgtcaagatttattctgcccacacaatatcatattattgtaatttgcatgaaatatatttgatatacaacatgaaatgaattaaagctcaattgcacagatcatataaaagtattttttgctaacatgaaattttaaaatttattaaagataaatagaatgcacagtagtgtttagcacgggcatattactagttggtcatagagtgtataaaaacatagtaggaaattgtatatattactggtttaatattaatttcaaacatatggacgcacttttcaaaaaagtttaataagaggttgtgataaagtgtaggaaattacaaacatatgaattacatatattgctggtttaatatgaatttcaaacatatggacgcacagtaggaaattacatatattgctggtttaatatgaatttcaaacatatggatgtacttttttaaaaaatataatcagcttaggagagaaaaagaaaaaattggagaggataagcagcagaaaatgaaggggcaatcagagtcgaactcccaacctatcggccacaagtttcattggctagagaagtttgatggttgtgccatgatgtgctgatacacaatgtgactattcagtggtcagtgaggccacgtccatggtaacaaattggagttgttacacgcacggacgaaaattaatggaaccgatcgctcatgtggataaagtggatgatggacggaattttttaaggaagccttgcatattttttaattaggtatagatgtgtttgaaacctcatatttaacatttccaatcagtatcgaagtaattgatattgtttttgaaatcccttttgccaactactcctaagagctagtacgaagttaaaagtggcctacaccattgtcaaagccataccctctatcctaggagtcatgagatatacggatacggtatatcctcaagtatacggaaagaatttaagttaagaaaatcggtaagttcttatggaaatactcttaaaagagcagggaatatcatagtactactcggaggggataagggttctacttgtagaccaaggtgatctgcgatataaatatatacccccaggaggtaggcaacgaatcttagtgcaagacacgccaccacagaagcaatccggaggacttgaagccaatttgtcgatagatctcgtcaaggttctctcgacaaggatctcgtcggtaatatcaaagttccattgttctcatttgtaccctatggtttcttctatattcccatataaactggattagagctattaccatacgaggggcctgagctagtataattcttgtctttttgtgtacttgatgttgtatcgttgttgacggctgttaaataccaaatttacgtcgtcaatatctgcataaatctgaaagtataaaaacatccaacatagtgatagggtttatttctaacattttccacgagttgtcatggttatggataccacatacctaatagtagttgactaaatctcggcaggatccaccacataccatgtcttatacgaaaattggcctcgagggagttccggataaggaaagacaaccagagttctacatggaaacgacaaggactactcggattgtatccatattggtttccctagttctacttggacaaggggacacctatgggtataaatacaagaccccctaggaggagaggggaaaggaccatggaaaacacccatgacaatcaacacacgcccaccagaagccacaacatacaagcctacatacgccaagacacgccgccggatatcgacttcagggataggcatggctattcccctacggtgtctccggatactgtcaggagatacgaaagcgctatctctgatctcgccgggcacggatccgaggaggaagactacc

SEQ ID NO: 65875 - DNA, 10843 bp, Oryza sativa
acatcttcaaatgtgtagacacccttcaataaatcttcagaatcaactatctacacgagaaatgacagtgcatgattaggaactttttgtgcatgagcatgtacaccgcattgtttgctgcaaattacagaccttcacagactggattgtttcttctggaagtgtctcagaacatagatcaatatcagatgaatttatttggtcatcgcaaggttctgaagtatcaactgaagttgcttctccaggagggggctctttgctataaactaagtcaccttctacagcctgcgaaatgcctgtcaagtacaccagttagcataaggaggaatgggaaaagagaagttcaccatataaaactacaaaaggtaacacgcctgaagaaaaaggtcaaggttagccgttatcagaaaattatcaaactgcatcatgattcaactaaaactgagtagctgtagaaggatgaagtgcactgaccatatttttcaactctggcactggcagcatggttccagaggtaactttggtaactatgaacgtaccttcataaaagaggcaacagcaaataagaaagacgcataagcaaaatatgagaattaataaattggtcaacaaaacagaacagagaaaaagggtaacagaaaagcttgaatatatcaaacggtatgtatattgagcagcagagaacaattttaaaaacaggtacatataacagatctactactgttcatgactaatgtctataataattccaatacaattttgtatattataaaatctacttagcttttgaggtaacagaaattgactaacccatcaatgtaaagaaacatgaaaagacgaagaaagttaaacaacatacatcattcgtaatgttcttggtatactctttaatgcttgcagatagttaccagggcatttcttcaaacattgaagctggaaacaatgcatgaaagaatatcagtttaacttccccaaataatgtgatctacattacataacttgaataaaaactaaaaagccaatgttttaaataattccaggttaagtaatgaaggaaaagaactacacttacaatagccttctcggctacaagatgtcgagggaagttccttagtgccatatcaatatcaccatgctccttgtaatgttcacgcatctcccttatgtcatctctctgttcggagtattaagttatgttgaacaaaagttggcacagctatatatccaagtatgcaactgctgattggataaaataaatcaaggatatctcctttcccttggatcaagaatcaaatttacagaacttctccactctcctctaagcaaagcagctccaccaaggtgagtaggtactgaaccacttccaaaacgctaaccaacaaaaaagatgaacttgatgagcttcaaaagtaaacacgtaccagttaggttttgaagcataacgaaaaggttctggcttcatacctgcaacccatagtagttgataaatccattctttcctaagccctccacagaagcctttattatgtcttctgattctgcaacaacacccctgaagaaatgcaggaaaatatcagctctccatttgtttggttttcttgaaccaagaaaagaagaggtttggtgcatgtgaaatatagtactgtttgtagtgaagtaatatgtagctgcaaatcaggccctccatgagctctaagattagtgcaaatcattttttagagcactagagaacatttttagttttttacattaaactaaaaggagaaataaaaaacaagtacctcagagtaattgtaaatcgatttcccattagttgaccaagaacaagtccctccttcacataactagaaaggaatgcaaaaataattagtatttagaataattacattgcaatgatatcaacaaagaggataatgcattttatcacctacctaaagtttccaactttaattccaaatagtcgattattaagtgcagccaatctgttggctgatatcttgaaaacagtcacctaaccaggggaaaacaatcagaaaagtaaccattgcaagaaaacgtaattacatgcagaggatcacaaccatgaaaaaggagtgagataacataaacaaatctgtcaaatagactaaaaatcactatgcaaaatacagcaacaacaccagcctttaatctcaaccaagctgggtaggctagagatgagaacaaagccaagcaatacaaactaaaggtgaaaagactaaaaactatgaacggtactagttaaagaaaaatgatcttgtagtttcatttcacaaaactcctttgccaagacaatactacatgtagtattccaaaccagagcagcttcacttatctcatctggttgtaacatcataataccataaattatgccttaattaaaattataccagtatttcttgcatacttgtatgcgaacttttaaacaaattgtacaaaaacccgatttatgtaaagaaaattgagtgagatggtatgcacatgaggaataagtacctgttgtgttgtaacagcacgtttatcttttgtccctgcaaacccgaatgaacgtgactgcaaattgcaaaaggtatagaaatcaactaggaatgcgaaggaaggtaaaaaagaagaatcaaagcattcagtagaaacaagaacacaatgttatgagttagcaaccgaggtatacctgaagtcctaacattttcccaattactcctaacgcttcttgtgtgtccttgttctctttgcaaaggtgaaacctggtcagcacaccagaatgacaactccggttataacgctaattaacagcaaaattagacgaagcaaaaacataatatttcttatacaaatttatacacatagattagatgttttttattaagtttagccaagtaaaatacacagcaagtcagatgaacacattcgagtacaaaggccagctaaagataccaggccaatagaaactatcaattcaagctgaattccaccaccttaggaacttcccaacatgatttggccagctagttgatcctctgctatcaaatggcctgtcatctctccaatcagaaccacccatgttcttcctcttccttcccctcccaccaccacttctcccaccggcaccccgccctcccctagctcctgatcccagccgcaccctaatgcatctctgaactccatcattgtgttcgaccgtgtcggtgaccaaaaacttgaagctcctcttgaagaaattatgcacctcctacagccaaaaacacgcccaaatcacaccatttccaccaatctcaaccacataaacaaccagaaactggaactgggggatcaaaccaaccgatcgatgagccttatcggcgtccggcgagagaataaccggcgatacatcagcctcagcccccgcggacgccttctcgaggagccccttcaacgcgtcgcaatccgcatcgccacagagcgcacggaacgactcgagggcctgcgagtggtccgcgtcggcggacggcgcccgcttgtccttctcactcacatccacgcactgcgatacacggcggagctgagctagcgcgatgaaaaaaaatcggggatcccgggagggagccgcggaatcggggtcgagagggctaagcttacctcgtcggggagatcaaaggaggtgaggcgggcgacggacccgtcgcgggcgacctcgtggacgatgaagtcggagtagcggtgcttgaggacgccgcggaagcccgggagggaggaggcgaagcaggtgatccccgcctccgcctcggtgagggaggtcgagcgcgccatgggaggtggccgcgcgtgggattagggtttgcgagaagagcagagtgtggaggagacgagggttttgcgagggaatggggagaggtttaggaggggaaagctgatggcggaaagacaaggagatatttgcaggtaggtccaaataataacgcgtaatattcaaaatggtccctgagagaaagcaccgaaattagtttagccgtttagggggtggttttgatacagggtcgtaaattttggcgtgttatatcgggtagtacatagagtgtcgcatggggtgttcgggtattaataaaaaaactaattacagaatctatcaggaaaccgcgagacgaatttattaagcctaattaatccgtcattagcaaatgtttatcgtagcaccacattatctaatcatggagcaattagacttaaaagattcatctcacaaattagtcgcaatctgtgtaattagttattttttagcctatatttaatactttatgcaggtgttcaaacgttcaatgtgacggggtaacaaatttttgggtgggatttaaacatggccttagctgtttaggtcgtattcttttttttgtttacgagtaatggattacgaggagacgcttccaagtttttaaacgctataattttttttaaaaaaatcttcatcaacatatattagaacttcatttttaaaatacaactttcaaccctgtaatatttaattcatcggttcatgttcttgaataattgtcatacacttaatccatcatccgagcagacaaagaacaggccctaaccttttctagagtaacttagttggagaagaatgtaatgttcatgatcaaatcatgaacggctgctaaaagatcaaacagctagattagcaatgtaacacgcgatgatgtcgtgctttaatgggcactcatcactaatcagaagctgaaaaggaatgcccaaaaagagaatgtccaagagttttatctttgccgaaagacgaatacaaatctttttaccactgccgcctcatgtcagctgacaaaataacatatcgtcattatcaatgtaccatttctctgatggtgcaaaaggagagaaaaaagatgcgggcagaggtaaacaaaacaagatcaaaatacaaacaacacatcgccttgctttgttccagtttccacaccatataatcatagtgtggcccaacttatttgtgtgcctgtaattcaaagcaaacctagcaagcatctagatccctgcacggaggaggtttcggctcaccgtgcaaggtggtattccctccagcagggccacagtttttccgctctgggtgttgtgtgccgcgctgcaaaaatcatcacaatcatcaaaatcagttcgcaacctaaaccaatggtggggcttgatatctataacatcaaactgagtaaaacttgtcgctagaaatatcaaaagaattatttcgttcaagagcaaagcttacaggaggggtttctccttttttcagcatctcgacgatctcaacaactcgtttaggagtgaggtcctcctgaaaaggggaaatggaaatgctcagttacagtacacaaataagtcttttcttcctctctcagcaaaaggcaggcaggttttgttaagttttatccactcgtcttttgttactctgttggcattagtgctttcagtgccacagtactgctatagcatggaagtttagcaaaaaaatgtagctatgttagcattatttctccaaagacgcctgctaagaagtatagaaacccaggggcccagcatcctataacatgcaagtttatattcttcagttgacaatgtttcattttgtgcataaacatgaactaacacgagtgggcaccagctgctaattcttactaatgctgtgatgtttctactaaaatttccaccgcgtgtactagcataagtcatcaacaatagataatcggatgcatcaatgtgtatacttacataatagttgtatgtgtaaccctctgaacctttagaataatcggccacagcaatcatgggagcattcacacagcagccctgtgaacatataacagaaagctgaataaaaagttgccttgtacttatgttttttcattagagtactgaatcattcactgacaaaatcctacagaccattcctattggctatagttaaacacttaactcaactagaacacctatttgcaagcatccaaaatgacagaaaattatagatctcgaagttaccatgcactccatttctccaacagaaaataaaccatcactggtcacctctgcaaatgaaagaaaaatgttaatgctatcacagagatagcaagagaaacacatgctcgaagaccgtttgtggtaacaaatcaggaagtgttattcttagttgataggataagttatgtgaataatacaaaccattccgtttaactccaagatgttctaacaaggcttcttcaatttcacgtgaaccacgaatcatgcaaggtgtggttccacacaccaaaaggtgatatttacccacctacatggcaaaatagggtgaaaagatgctagtggagggattaacaagtacaaaatactaagtcatgcaaagataccttagtccggttaaacattgtgtaaaatgtagcaacttcatatactctgattggtgcaacttcaacgatcttagcaatctgaaagtccaagacatgaaaatagtattgtcagaaatgctttttgtgagcacagtggtggtggaatggtggttgggtctatgtacaaaatatctaaaatgtaacataagctataacactcccagtagcaatgttattgtaatagtcctagtcctgaggagattaactcaattgtaattataattatataaatatgtcaactgatatgctgacaagaactttttcttttgtgattgccaacccccattctccaatgcctcttactattaaggctcctaatttcctagtgtcacccatcttcagtaggacgaagaagtgaacagaaacaaggccagtgcaataaggttttgatttatgaatgtctgctaagcaagtccaatataactatagctaacgtgggttgtaacaactaacaaatgttgaggtacatcactttctgaaaattgaagtattgaaaacaggatatagcacattaaaggcggaaaacagttgatcatcgaaagctcataaaaaagggacttacagcattcattgctgcaactggcacccatccaccatgctgctgctgggcaagatcaagcattggaataataccagactgcttgtagttgcttggatagtgagacaatatctcattaacctgaattagttattgaaatagagattttaggccagataaccaaaatagctgatacaattgatataaaccgtattcacaaaacctaaatcccatgtcaaaggaatagaacactataccccacgtctctattacatttggacatttgcagatttgcacatttctaaaggttttacatgacagataacgtttccccttctcaaataaccagcaaccagttccaacgtaagattatattattatctaatagtcctgaataaaatggtaccctaacagccatttctgaacatccgaaaacaaaactgaacaaattctgccacaactactccaaaaccagccactgttccaatccaaaacataaatcacagggaaatgaatgaacgagacgaacaacagcaccttcttcatgttggcctccgtgaactcccacggcatgtcggggttgttttccggcgaatcgaggtgctgcacaacaagcaaacccacaaatccgactcattatcatcctcagacaaaacagacagatcagggaagagggtagggggtggatccgagggaagggggaggcgcctcacgtacgtagttaagcgccgtggagaacagcctggaggagcagcccgcggcggcgtaggagatctgcaacgagacgttgcccccggagggagagatcaggacggcaaagctccgccgacgaacagcgaggagatacagaggcatttggaggagggggaggggggcactgaccggagaacgggacaagcgtcgcgccgcggccgattccgaggcggaggaggtcgcgagccctaagaggcggcgggccgcgaggcgggcggccggcggcagcatggttggcccgcggtgggggaggcgactcgactcaggcgaagaggggggaggggagcgaagttgtggccgctcgcggaggtaagtagctcggcgtgacgtcagcagcaccggcccagtgggctctcatgggcttattgacccaatcggcccaatagtaataattccttcgtgtactggcaattataacgatctttttttttttggttgggcaattataacgatctactgtccggatttcgtaccaataggattctgatatatcatacttcatactggattgtttattttagtacggaggaaatataccggtagatcaccaatcttcaagcaaaatgaatcgtcctatatattataggccgagtttagttccaaactttcaacttttccatcacatcaaaactttcctacacacaaactttcaacttttccgtcacattattccaattttgtggagattatggataccccataccaacacggcatttataatccgactgggtatggggtgccatgtatagatagaatatctttaaagggacttgggttaaattccaaacttgtatgttaaggaaatacccgggatcttagtcggttaagattgaatcttatctgtaactacctattccgttagggatatggactgtattttataatacggaccccttcccctatataaggaggggtccaggtgcctcttagggcacgatctgctcccagatcatacgatcaataatacactcggcaaatcaatccccggacaggagtagggtattacttcttgttaagaaggcctgaaccagtataaaattctttgtttctcaacccatccacttttccagcttgatagccacccccttttagtattgccaaaatcttgtttcgacaattggcgcgccagataggggtagcgtcaagttcttcgccgattagtgcgatgggtttcgtctccggcatcgacgacttcgtcttccctcccgggcaggcgttccggttcggcagcctcaacttcttcaccaacgacttcggcaagatttctcttcttgactcggattcgaaccagtcgggaagagaccaggtttccgccccgttcgtaccccaaacttggccgagatctaccccaagatcatctcaaccgagttggccccaaaccactcggacgagatccaatctactccaacacgacccgatgaagacaatagagcctatccgccaatcctgatgaaactcctcaacgatttggctgtcgttttcaccacaagagcgtcatctccccgtaggtctaggcgggatccgccctggccccgatccagtctagctctagggaagtcggtgtcatactccagcctctcggcacggtttcgacgaaacagttggacggctacctcagctcccccggtgtcgactcacgaccaacggagatcgtagagtacgacgacttcggctaccgctacgactaccgcaacctcgacgacttcgacgaaggctatgaagataactacacgccccctctacttcggcattttcatggccgacaacgagacggaaaaacagcgtcaagcccgagaagaagaagaacaacgcgtgcgacaggaagccaaacgtcgccgactggaggaggagcgccaagcacaagagcgagaacggctgcagcgtgagcaacaggagcgcgagcgagctgcaaaggaggcttggaggccgggcgacgagcacgagaactcatcgggcaacaagatgtcgaggggacggcggtttttcgcaccccccaacagaacgtggttgcagcgatcaccctcctcgacaccctcctcaaggaagacgcactcaatcaggccaatcacgtcgtcaacatcttgaaccagaccaagaccatgatcgcagcttcggtcccggttaactccgcgagtgtccgcacgccaactggcagccgagttccgcctcttcaatctcaagactatcaccaaccgagcctcagcgtcgtcggcgccggaaccagtcgtaggagcagggatcacgacgagcaatccgttcactcgcctcctgaccgacacagggagcgtcgagctgaatgtccccgctccccacatcgcaggcgtcccatcgatcttcgcgaaactatcaatcagcgccgtgcggcaagaggctacatcccccaccattcaccagatcgttacgacgacgacgtggatggagttgctgccttcacaagcgacctgcgtcgagtggattggccagccggcttcaagccgactggaatcgagaagtatgacggcaccactaaccctgagacttggctcaccgtctacagtctcgcaattcgcgcagcaggaggagacatcaaagctatggcaaactatctgcccgtggccctagcggattctgcccggtcctggcttcacgggctaccccgtggcacgatcggatcttgggcggaacttcgcgaccacttcattgccaattttcaaggcacctttgaacgccctggcacccagttcgatctttacaacattgtccagaagtccggagaatcccttcgagattacatccgacgtttttccgagcaacgcaacaagatctccgatatcaccgacgacgtcatcatcgccgccttcaccaagggcattcaccatgatctcttagttggcaagtttggacgcaagcctcccaggacagtcaagcagatgttcgagaaagccaatgagtacgcaaaagccgaagatgccgtcaccgcatctaagcagtcgggcaccacttggaagccgaagaaagatacgccgaccacaggagggagtggaagtaccaatcacaaggatcgcaagcgtaagcccgaggaacttgtggcaaccactacaccatcctcccgacaatgttcgcgcgtcaacactttcga

SEQ ID NO: 65876 - DNA, 5074 bp, Oryza sativa
ggggtgttgtagaattcgagctcggtacccttaacccgtccaacaccgtggtgtttgcgacggccaaggcctgcagaaggggctctgcgctcagtggggcaacggaaggcgtggggaagagccgcctcggtgaaaatgccgggcggctcggcccgccgatggacgtgccggactcggggatgtcccccggacctggttggtcctgagcgtcgcctgagggagtgggcccaagcgatgcgcccgcggcctcgtcgcgagctgcctcggaagtcgtcgccgcctcggcctggcggagtctggcctcctcctaagcggcttcttcagcttggtgagctcggacggccgcctgggcagcttcctcggcttcccgaaggcgatccgcggcctcttgccggtcagtttcacgggtcgcctcggaggatgtcgtcgcctcggcctggcggagtccggcctcctcccgagcggcttcctcggcctagcgagcccgggcggcctcccgagcggcctcctcggcttcccgtaggcgatccgcggcttctcgccggtcagaatcccgcctccgagcctctgcggccgccggatcctcggcctcagactggccggacttggaatggcgggagggacgcgacgggatctcgctgaaacagaagaaagaccagaagacgaacaagatgggtgagtgaaaactcgcgttgagagaaggaatacagccacgatgggcgtgggacgaacctgcgagggggtcggttaaacgaccaccttggaggggaaataaggtttccccgggatggttctgtcccccccatcttgcggagccgcttcttctttcgctccccctcgggctgcgacgtcggcgtggccccctccgggcgcctgctgctggcacgcgccgccccgccccctcggggaggagatgggggaggggttcctccctgcttcctcttcccccgggcgtcggcagggcggctgctccccgggcccccgtcgcggggcccaaaagcacgaccccctcccggggtagattgttcccccctgcggctcctgcccgcgccatcgtggcctcgaggagcccgctcctccgacgccccgaccgcctgcatgatggtcaggatggaagcgcggtctggatcgctgcagagggggaggactccttggggaatgagggatgcctccacggagctgagattcagcacccgttggaccactatcttgaagtcctcaggagcccagtcccatctgactccctggtgggtcctcatgtagtcttcggacccggtgtactcccaggcgccccgggcgcgccgctggagcggcgcaatacggcgacgaaggtagtcgccgtacaccatggcccctgtgagcccctgggatcgcaggcccgccaggcggtcaagaacggcatcatagccatctcccagatctaccggcgaccggccagatgaaggcttgcgccgggggatggctaggaagtcgtaggcgcgctttgtcggcgagggaagtgtagaaccagtggcttttccagtcatcccacttcttcgggaggacgcaggggatgtagcggttcagcaccggcccccgcggctggaagtagcagccaccaaccaccgacggcggttacaccgactgtacggtgaagaaccaccggaacagcagaagggatgggcgcactccgatgaacatctcgcacaggtgcgcgaagatggccaatgtcattaccgcgttgggggtgagatgcgccatctggagatcgtaaaactccagaacatccatgaagaaagaagaaaatggcggaaccagccctgccattgcaaaagggaggaagaagacggaccgccccgggtagcatggcgccgggcgtccctcgcccagcgtgactatctcccggccggtggcaggttccggcatgaagcggcgcggcagcccggcctgcctctcgctcacgatgcgggaaggcggcagcacgctaccatcgagcagagcggagccccgtgccatgacgccggaagaagaaatgtttgagagcgagcgcgtgtggcgaaggtagggcacaggaaagaaggagttagggcgcaagcggcgaagacaaggggaataatggcgaaaggaaggaagcaaatctcttcctcggtatctttatacccttgccaacgctgtgcccggctcctcgcttctcgcgcccactatttcgctccctcgtttctcgcgcccacgcttccactaatcccatacgcccgcttgcggcgcatgaggtggatatgcggctgaggcagtcgagatggaacatatcgtgcgtgcgttaattacgctcgccgaccgaagcgccatcaccatatctccaggcaaaacgaaccggctcatcccgattcatgtgctactcgagtaatgtggcagccttgaagaggccgctcattattgacagtcgagttaccgttgccggagtgcgtgatttgcgaccgttgggtttctgcccaactgtggagaccggtcccacctgtcaccaggctttgggaagtggcgtcacgcccgaccgcttctctcgaggagggcgatcgccctggcataacgccgggggctactgtcggtgacatgggaccgggagtatcatgactaggggcttgggcaggagcaatcacccacgaggcctgaccccctcgggggagtcgggcccgagggtgacgtggccgccccccctcttcgtctccccgaggggtcggaccactcccgcttcggccccgagggctgaggcgccccgaccccttgtgggtttggcgccgcgtgtatgggttgggtgagcacaacggggctcacctaaccgcatttattgcggtttagacgagcgcgtcacgccgcatgtaacgcagtgcagcgcgctcgtttatccggtctgtgaccagtcacagaccgatcggatcgtgggttaggtggcgacaggcggtctaacacacgcctcgccccatcccgtcaggatgagagcctccaagcactcgtccctagccggagccggcgtgttacctcctggagatggcacgttggtcccggtcagatatatgccaggcttcatcctaaccattacaagcaagacattgtatgaagaagggcgaatatgcagattgctaaactgacacgtggtggacaagaatgaccgatttgtgaccggtctgacactggtcatgtcgacggcagacagccatgttcccacgtcgcgcctgcttccggcggaagtggaggtaggtatgggccgtcccatcagaaggtcattcggacggcagccatacaaatctccgtccatttatgaagagaagtcaagccaagtttgggggaagagagaataagtccccacacaaaaaagaagagatggtgcatgtggtatccccttgagatataaaaggaggaccttgcccacttagaaaggggattcggatccagaacgatcaaggctggattgagaaccagaggagagggtttctagagtaaaagctctctgaccctccagctctttgtagtttttcatacacagatccaccagaacacaggagtagggtattacgcttctcagcggcccgaacctgtatacatcgcccgtgtcttgtgtgcttcttccattttcgcgaaccttccacagaccaagagcttagaatctcacccagggtccccggccgaaccggcaaaggggggcctgcgcggtctcccggtgaggagccccacgctccgtcagtaccctattgcataactcatttcctgctaaactgagagtataatgtacactaaaatgccacattttcattgaacccagtacatccatccattcactgcaacttgcccattccaattgaacagaacctactcacttcaactgcaaataaccatccaatattccaaacaaatttccattccagattcgacaacaacaagatgacagcaccacaaatgacaaatgacagcatcaccaatttcaattccaacccgatacagatgacagcatgacaacaacaagataagataacattcatttcctacccatcaacatggtaaaaacaacaacaacaagacctagaactaccaacaacatcacaaatatctctaactccaacctattattcctatccttcatcatccctacaatagcttccttctcaccaacagcattccttgatgtggccaattcctttctagctaaatccagctctgattccacagatcttccttcttgaacagcagccaatagctatgccttctccctcctgagcttccacacttcgtcccacaaatcgtttagcacttctctcaagaagctgctagtcggaccatcaacccaagcaaaaaaatcgcaacctccactctgcaacagtaaataaatgaaaccctagaactcagccaaaaaaattgaaaaccatatcaaaactcacccttgcgtctgcacatttgaagtagcggcggccgggattgtccgggctccacaaaatccacctcgccgccttgctaccgcacctgcatgccaccgccggctgatactccagaggcccaacccgatacgggatgggggatggagatgtgcgcctagaggacgccgacgagccctcactcctcgagcttgccattcgtcgacactcgtcgctgtcgccgcttcgccgccgtaaccctcaccgtcgtatccctctccgccgccgcttgtagtagggatggggaacgagcgagagagtagataggcgagagagcacgcgctatttattcccaactaccaccgacacgtcagcgatgttgaccgggtccaactgccacgtcagcgaaaaccgctcgcaaaactgccatgggagtcgggttgcccaggatttcaaagtttaggggtcaagatatctggttttgcggtttagggtcatgaattagattccgatcacttttgagggtcatgaagtgaacttattcaaactggtcatcccccgcccaggcaggccgcgtccgtgacgtaccactcttggcgcctgcgctcacgcaggccgacgcggcagtcgttctccatgtatggagtacgggaccctcatcccgctaggccggcggatgcggccgcctcctcgtc

SEQ ID NO: 65877 - DNA, 4194 bp, Oryza sativa
ccactctggcgccccaaaaagaactatttctgggataagttttttcagaggtctatttgcgaaataagttttttaaaaggacaaaaatgtgaaaaatccagatgtttattactactccgtattacggatatctgagatcttaattttatagggtgtttgccagttatagtaggtactttattgttcaaatctatcgatcacaatcaaaggtacttaagaattgacagaggtacttaaatgaaggaagggtaaaaacttttgcatgcatgctaacataagcaataaattaaatacagaacagaaaaatatctttgcaatatgaatatataggtacttgtcggtgacatgggaccgggagtatcatgacttagagacttgaggcagacacgatcacccacgtggcctaaccccctcggggggggggggggggtcgggcccgagggtgatacggccgcccttctctttgtctccccgaggggtcggaccgctcccgtctcggccccgagggccgaggcgccccgaccccttatgggttttgcgccgcgtatatggggtaggttagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctggcgcacgcctcgccccatcccgtcaggacgagagcctccaagcactcgtccctagccggagcaggcgtgttagctcctggagatggcacgttggttccagtcagatgtatgtcaggcttcatcctaaccattacaggcaagatattgtatgaagaagggcgaacatgcagattgttaaactgacacgtggtggacaagaatgaccgatttgtgaccggtctgacaatggtcatgtcgtcagcagatagccatgttcccacgtcgcgcctgcttccggcggaagtggaggtaggtatgggtcgtcccatcagaaggtcattgggacggcagccatacaaatctctgtccattaatgaagagaagtcaagttggagggaagagaggatgagtccccacacaaaagaaagagagggagagatggtgcatgtggtatccccttgagatataaaaggaggaccttgcccacttagagagaagaaaaaaaggaaacgatcccagaacgatcgggggctggctcgcactttgtagcttcttcatacacagatccaccaaaacacaggagtagggtattacgcttctcagcggcccgaacctgtatacatcgcccgtgtcttgtgtgtttccactctcgcgaactttccacagaccaagagcttagaacctcacccagggcccccggccgaaccggcaaagggaggcctgcgcggtctcccggtgaggagccccaagctccgtcatctggcgcgccaggtagggggctctgcgagtgtttttctaagctctcgcactctttcgtgtgcgccaagcttttcctgttcagcccaatggctgaacaagcaaaggtgcacaacctctctccgagtgttagcggtgacgacggggagccaaacccacgccgtcgagctcgtactccaccgccccctccacaccaaagtcctaggagggaggaggtgctcgagaggatcgaaggatccgcgacttcgacatccacgggtgatggagaagggcgccgagatggggagcgtcgcctcctcgtctacggcgacggcagcacgccccagggcgcgctccaagctgcgggcgcgctcctgcgtcacccgcctgtcgtccctgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttctggcccaccatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcatatatccgcgcccaggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaactgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgacgagggtcatgtcctcgccgtcgagggcgcttcgcgggccacccgaaaggggaggcctgcgggcgacaaaaagaaggaggccggcgctctgggagcgcccaaccggcaagtggtgcatcgtccacaacacttcccttcacgacctcgcggactgccgcgcagtcaaaagtttggctgagcggacgaggaaatgggaggaggagaggaggcaggagcgccgagagggcaagtccccggcggttccttccggcaatcggcgaagtgaggccaaacagaaggcccccgccgaggacatcgatgacggcgatgatgacctaggtttccaagagcctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggaggtttcccccactttttgcaacgtgaagctggggcgtgtcctcattgatgggggagcagccctcaacatcctttcccccgcagcctttgacgctatcaaggccccggggatggtgctccggccgtcccagccgattatcggtgtgacgccggatcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggtaggccccggaacgtcaagccttcatccgcgaggaggtggcgcgacttctggaggccggattcatccgcgaggtcatccatccggagtggctg

SEQ ID NO: 65878 - DNA, 3059 bp, Oryza sativa
attggtaactctataaaaaaaattaattatcatgacataatagacattaactctgaacatattaaattatcatgacatccccacgatgtgcaacagaatttaacttgatataaaaaaaagtgatgttacattgttttctaatttgcattcagtaatgcctatgatattttacaaatgtaactgacttgtccttcagatgcttctcatgttctacattggatgcatccagtttttattgcagctcactttgaatcttctacctaatgcttctaatatttatgcccttttttatttaatatgtgatgattaggtaatgcttagactagcatataaaagattggcttgattagggttctaaaattgaagttttctttgaaacgactaatgttattatttgctcttgccatagaagtggtttttcaggactcttgataatataactattggtttgggatgataaagcttcagtttaggacgatgagtgctgccctgtaggttaaaatcccattttaactaagttatgtattatttgactagcttgcactttcaccctcttcctttaaacatactgatagtatctgctcataaaattattgtgcttgctatgatttaggtattaaaatcacataccttttataatctatgtaaaagatgtacaaccagaaaccaataggttaacttgacagaattgacctttacaatcctacaataccgtccattccaactttctttgctaaataaatatgctgctgtgtgcattatttggttcacatacctgattattagaaaattactgaaaacagtttggattgtttacctgtttgtttttttagtatggataaatcattactttgcttttggttggtacctttttgtgccccccccccccctgctatttgagatgtttaattaatttcctcatattgggctaaatttgtacctgctggtggtccttcagttaattcattcacagattacttgacatcggcaattgcttctttgattcttacaatctgaatatataccaaaaaacaactatgttaacttgcttttttcacattcagaaaaagaacattactaggaaacaaggatgcttaattgttctaatattgttgagtagttcaatgccataagattattgactgccagtattgataaaaaaaattgtatttttgcatcacttctcaggcagctatgtacacgggggaagcaattcatcatagcaaaacatattgcacttccatttgcacatcaacaaaagggcccctgtgtgaattcggtgaaggcatccaaaccatattagtagaatttagccatgtgtaatatagttttatagtcctatactcctatgtgctcatctagcagaactgtttcaatgctaccactataaaactactatgtactgtctatcctgccatcaaacatgtggcacattttgctatttaggactgtccacaatctgcatatatgttgtgattagcttttagcctctataacaactttcaatataaatgctcacgtcacaaaacttcattttttgcactacactaaacctaaatctcacaccatgtcgttagcctatacttgaccttcacagaccttgcaaatagcatttgtttcagttacctaccagaaccaacagatgtaatcaatgattttcctctcctggcaccactggtgcaacgcgcgaagcgcgcgttcacctctagttgtctttatagtactaccatattggcattagcaccatatgctacacaaaagtatacttgtggctaacttgtagccggtcggattaagcgaaacgccacgcagcgatggcgatgatacaaatcaggacagcgacgaagggagtggcaaaggcttggaggatgttgaagctggagcgaagttgttgaagctgggcctccaattcctcgttgcggttagctaggttagcgaaatgcgtcacggtacctgcaacggactggacgcgggatatttaagtaatgtgcatgtatggagcaaacgccaatgaggaaatagtttagttatagattgtaatgaagtaatgccaagaaactaaaaagatcataaaacatcgtactgttcaattcctagatgcaattgaaattgaaaagtgaacagtacatgcaagaaaagaacaggataacaaacacatcaaaggtaggctatctatatatgaagaagggaaattaattcatatcttgcaacaattccaatggtatgtatcacctcaacttgaatttcatccctttccattgaaatatatgattgtaacaattgtaatttattttgatctttgcatggacagattctttctattcagaaattaacatttcaactttcagaaattgttttagcatcgtaacacatacttatataacatcgatctactcatggtaaacatgagttgttaagcccctcgacgaatcactagaacttgttaagtatacagtggcgagctgcactgtagtttaggcctaagcccatttaccttcccttcttcagcaacaagtaagaaacacacaccacttcactttacccatcagatccagagttccagacgcgtcccacccgtatcacctcatctccgccgctagcgccgttgttctgagtcgcaacgctaccgcgtcgtccccttggcttccctccacctcttggtccatctgccatggccaatttcgtcggagcgggcagcttgaaccacccaccaccccagcgcaaagggaaaggtgctctccagagcaccgaccaggtgttgccgttctccacatcacgcaacaacggcaaggagggaaaagctcgcaagagagtggaggaggtatattcagaaattagcatttaaactttcaaacatccctacacccatgcagaagcatcccaaaccagtttccaagcagaagcacatttaacaaaataggttcgtagttccacgacaactaagtgcacatagtgaaccgtgattccttcactatctcaacatatgcctcccattcggtctctccattcaactgggtaccgagctcgaattcgccctatagtaatcgtagcatcactcg

SEQ ID NO: 65879 - DNA, 2487 bp, Oryza sativa
tccagaagaatggcatcaagcccatgaccaacacagttaaacggcgggctgcagcacagatcaatggggtgtagcccaaggctaagcttaagaagaagcagcgtgagatcacacgccggaccaagctcacgaacgcccatctgcctgagctgttccagaacctcaacacttgattgctctacgcttattcgacgtcaagtggagatatttatttctgtcctcactctacctactgcaatgctttatatacctgctacccttattgtgtatgttataaatgtaattccggcctccgggagcataatctgagacggtcagctttgtaaaacataaatcaattcaagagcttgagatggcataccttcgcctgtcaatgcgttcttcaaattttcgtactgtaatgcccaaacgcaatgtgtttcttgttttcttttcttacgtttcaatgggatcctaggtgagttttggatccataacaactgttctattggcaatcgctagtacatggcaaaatcagccacagcagtgcagctgtaatgtgcaaaaggtgagtcacaatcttcagatcggattaatggaagaaaagagaggcgcactcattatgtttatggtacctggaaatctctcgtactgcaagccgcaccatctaaaagggagctcaaatgttttctttttctcgttttcaatctgcaagttgtttcttttgaatgttgaagtatctaaaagaaagatcaaatgatttccttgtttcaatctgcaacatttcataattgaaggaatcaaatgctacggatgcaatttgtttgctggtagttctcgttcagattataagtaagacgttttgagctgaatgttattatattcaaatgttcaggatttgttaagaactattcaatttcctttttttttcttaagatgaatgaactattcaattgttgaggtctgggtatagtaatggagcatgatttaatcaatcctaatctctccattcatatgaccctatagttaccttagtggaagaatgggccgtatctaccacaacatctcatggttatatggcaatgtgtctacggccgttagatttggacttacctccaaatcggcgcccgatcctctaaagaaaatcggttggtcaaaagttacggttgaccaccagtgaaacattaagttatatatggtaaaacaaaaataatcagtcactggagcatttaaaaaatttgtgaaacacggtgaaacatgttactatcgcttatgaaatattgagtattaacggactgaaacatatgttgttgtgaagttttaattataacaaatacaacagtgctatcttgttgtgaagttttaattataacaaatacaacagtgctatcttgttgtgaagttttaattataacaaatacaacagtgctatcggatcgtagattagataagtagtttatgggaaaaaaatcattttgaaggttgctaaatacatgcatgcatggttagagagtaggggcaaggagttaaataaattttgtgaaacacagtgaattcacactttgaaatatgtcgctatcacatatgaaacattaaattttaacggtctgaaccatatatattttttttatcaaaatataatcatgtgatatcttattgtaaagatttaatcgcaacaaattcaatggtacgatcggatcgtaaatcggatataagcagtctaggagaaaaaaaatttaaagtgatgagaaaaaagaaaaagaaactagttggtactcattttgcatgcatgcagcagtagcaaggaggccgattttttctcttcaaatcaagctactgagcatgaggattctcgtttagattttgccaccataaaaccaatctccacaatgaagaaaccctccaactggaggacctaaatacatactctctccgtacttgtaaatgaaatcgttttggacagcgacacggtctccaaaacacaactttgacttcttgtttctgtaaaaatatttattaaaaagtgatatatgtatacttttatgaaagtatttttcaagacaaatctattcatataatttttatattttcaaactcaacaaattgagacttattcatgatttatattttcaaggtttgacttaaacattgtcctaaacgacttcttttacgaatacggagggagtacttgggtgtagttctttctcaatcccacattcacacgggtaaaagtgcacatgatgggtaacctagagccccagatccacaaaaagcaagacaaaatgccggtgtgccaagtaacattttactgtatatgaaataagggttatttattgggttggttacaggtgtaggtcctacaaaaccatacccacacccgtttatgcacttggtgctattgttttctcgttaacaggtaaatgggtgggtggattaatcaatccccatttcctgatggggtaattattcactaagttcctgggtagccacttgtcctgctaggggaag

SEQ ID NO: 65880 - DNA, 10707 bp, Oryza sativa
ttatattattcacaaaaatcacatttctctcatctgggttatgaacatcaacacatatatgtcaattttgtaaacattggtactatcactttatcggatgaagaagtgaccaaaataaaagttgtagatcttgatatgttgtacaactttgctatttatggctttcccatttgaaatcagttagtatttacaaatgctgtttacatttgtcatattgtcaaaatcaatttcaagctgttggaaacaaagttatatagacaaatgaccaaaagaaaagttgtagatcttgatgagaggatcaactttgttgttgaccatattaccatttgaaataatttagtatttacaaatgttgtttagatttgaaattttatcaaaaacaattttaagctgttggaaacaaagttatgtacacaaatgaccaagataaaagttgtagatcttggtaatctctacaattttgttgttcaccatatttcgatttgaaatcatttagtatctgaaaatatattatgactaataaaatgaattattatacagcagctatatattttgtacgcataaatataaagacttgtttggaaaaatggaaaaataatcatcggtgacgggccttagttaaagcccgatagagattaatctatctctatcgggcattatcttagggcccgtcacagatgagtcatccgtgacgggcctaaatgtcatctcaatcaggcattagtatggagcccgtcaccgatgagtcatctgtgacgggccctacggcaaagcccgatagagatgactcatcactctactataactagggtttctcagatcggatcgaaaattttttctaagtcccgctacagtttcccgcctccttagaaccctagcgccgccgccaactcctacttcgccgccgtcgtcctccctcgccgccaccgccactgagaccgccaccgccgccaccgagcccgccgccgccgccaccgagcctctacaccaactggcgtcggccttcctcatcgtcctcaccgacgcccgacgccgcccgcctgacgctgacctccaccgagcccggcgccgccgccgcgaactcctccttcgccgagcccgccgccgccgccaccgagcccgccgccgcctccaccgaccggcgacgccctccaccgagcccggtgctgccgccgcgaactcctccttcgccgagcccggcgccgccgccaccgagcccggcgccgccaccaccgagcccccccggccgacctcaggtgagtcctccatcgcgccaccctctgctacctgcatgtggtgactgatgaaatgtggatgttgggatgaatttagtgatagatgattttagttgattgatgacatgacgatgaatagatgaaatgtggtgcattaatgaatttagtgatagatgattttagtgatagatgttttttgggattgatgatatgtggtgaacgaatgattttttttgattgatgacatgttgatgaatagatggaatgtggtgcattaatgaatttagtgatagatgcatgatatgtggatgaatagatggtatgaggtgaatttatgattttaggatttgatgatatgtttaatttatttatatgtgacattcaattcattctattactgtgagatgtgcaatttagtttatttatatgcttcatttatttataagtgacattcaattcattgtaatagattgtatcactgaattgtgtatttttgttattttgaaaaaaagtagacgatgtctcagcaaggcgaaccaatgtcgacgacaactagtgggtcctcaagggcacgtactcctaggactgggaacaaaatccctaaggaacggttccgcataacagcggtggatgccgtagggttgccggcatctccaaagaaaatattgagccgatttaggtctatctgcggagtcatagggaggcagaaattcaatattctgcaagatgacatcaagctcgtgccggccgcagagaaggacattgcttggctaacgttcaaggagagcttcgattatcctgcggagcatgaggaccgtctcaggtgggctgcattcaaggttatgggcaatgcttggaagaacttcaagactaagctagttggcgagttcgtctacaacccggcgaatctagatccaagagagaaatttccttggatcacagaacaggtctgggaggaattccatacgaagaagtcgacccccgagtccagatctagtagcgaggcatatcgtttgctccagaccaagaaccagcatccacatcggcttggcactgccggatatgccggtaaggaagaggaatggcagcgtgaggatgaagaagcggaggaatcaaacacgccgctcgtgtttggcgatatcccacaccctcgggctaggaactgggccagagccaggtaccagaagaaggatgatggcacaatcttcatgccaaatccagaagatcaacgagtgtacgaagctatagtaagtgtctagtcaaactagatgttcgcattgtttccgatcatgcagtttatttaaccccactaaattgtaatgcagaaggagttggttgctgagcaacaagcctcgcaagaggcctgctctcaaagatatgaggatgacctcctcacgaaagtgttgggcaacaaggaacaccgtggacggacacggggcgttgggtcttctattccctggaagtatggatttccagactacgcgtggcagtacaagaagtggacttccaacaaggcggagaaagatgcacgccttgaagccaagatccgggcgttgataagagctgagctgacatctgaattcgacgaaaagctcgagtcgatgagggccaagattaggcaagagatccgagaagagcaacagaacccccaggctgccgccgctggtgcgcacgaagagttaggaagtcccacccaaaaacgtagcagttgcacatcaactgaggtggcggaaaatccaacatcggtcgacagcgccatcgaccacataacggtaaaagtttcatccacaatgcatgaaagacttaacgaatccatatgatatataatattctaaaaaaattgattaatctatcgcaggaaccaacgagctgcaccctcacagttagggtgatgccgaccttcacggttccagcagccgagggacttgcgtacaagccgaccccagagacaagagtgcatggagcgcaactcaggagcgactgtgcaaaagttcaagtcgactcggtgaagctggaatatgagctattcccactaaagtatccaccgaatgacgaggtcctctcactaggaaatgcccgtggtaccttcatccaatggcccaaggacctcattgagatcaggattacagtgaggccaaccactgcaccaggcggtcgtccaccaaagagacccgcctctgctccttcagtccctcctgctcctgctcaagatcgtcatgcataatcttacgatatgcagttgcagtacgacacggatttttgggaggaccgaacggaggccgacagcaaggcgattcatgaacccccaccgatgaagaagagcaggaaggcacactcttcccctcagagaattactctcgataaacccgaagcaaaggggagaggaaggggaggaaaggtgcagtcctcgcttctagctccaaggaagctagatctgggcaagggccaggaagaggctaagggcaaagaggtcaagaagaaatacgtcgctccacaggagttccaactaggcatgccattggttggagatgacgtgcttgccgcaatgggcaccgcttgcaaggaccttcacgcatactacatggagaaatctaacgccaggaagccgaataaagctaccaatatccttggagagcacgatggaaagccattccttggtccaacaaattatatcgttgtcgacttcaaggatctattcgacctctacaggctccgagcggtggacacaagcctccttaagtgctactccttgtaagtattgtcgcacaacttaatctggtaataacaatcggattaactcgctaacaagatcgtttatcctgtgtgtaggttaagttggcaatggtgtcagaagaatgcaccggaagttgccttccttgatccataagtggtcactgtcacaaatctccagaatgaccgtcaaggaatggtcaactacatctacgacaccttgtggtcccaccgagataaggagtacattatgtgcgcctataatcaatagtaagtgtgttatctaaatatacacaacagcatgaaacattccttcagtacttaattaactttcactatattaatgccgcagtacccattggatccttctggtcataacacctaagtggagtacatgtcactacctgaactctagaattgataagaacgcatatgattggaccccaattcaactagcgatagatgaagcgtgggtccaatacgtgcaaagaggaggcctcaggaagacaggacatgacacccttatccacaaaaaagacttcccggtgaaacaacaaataggtgaccagtgcggattccatgtgtgccacaatatgcgccttctgtacagagaaaaggtgaagactttggcagagtttgaggtcggtggtctcaattgtgatagactaactacattttagtacttatatatgatcgatcaattaatctggaattatgacaatgtagggcacaataaccaagtctctgcctaccagctttgaggaggttcgcgaggagatagccagcttcatcctccgcgaaataattaaccccaaaggaatgtttaggcttaaactaaaatgatgaacaatgttgaacttttatgtttaggcaatgattaacacttattatgcaactgtgatgatgtaactgtgatgcttatatttatgtatatatttcatatgtttatgttaagacttgctaaataaatatttgatccaattaactcagttttgcaggtgaaatatgataaatatttgaatggatgtgaaatatgtgaatggatgtgaaatatgagatggctgtgaatgtgtggttgtgtgaaatatattgatgtatgtgtatgtgaatgcatatgtatatgaatgggtgatgctggggggctggggatattggatatctgtgtttgtttctgtcatttctgcagcgggcatagctagcaaaggcctgaggctagccaaaaaacaaattttatttttttgtggattatagtcatctgtgacgggccatagctaaatgcccgattgagatgatagtcatctgtgatgggctctagtttaggcccgattgaggtcagtagtcatctgtgacgggctctagtttaggcccgattgaggtcagcagtcatctgtgacgggctctagtttaggcccgattgagatgagtatcatctgtgacgggctctagtttaggcccgataaaggttagtagtcatctgtgacgggcgctaattgtggcccgattgagattggtcatctgtaatgggctatagtttgactgatcgtctaggtcaaagctatcggtgacgggctttacttagggcccgattgagatagattcatccgtgacgaccgtttgcccgattgagataactcttcacattagtgacttctagcctgtgacggacgctgtgcccgattgagatgagggtatccgttctagtgataggcccagcttttataaaatggcacaaccgtaaattcttgtttggggttggaccaccttacaagtttgggcatagccacaaatttctaccaagaaaggactaacagttcagcaaaccctctagacaactctaaacatcacaggtttaggcgaactattcggcggggcggcggtcacagggcttcccgcacgcggtggcccctccctggcgacgcaagcggcggtcgcagagcttcccgcgtgcggtggccgtacctattcgaggcaagcggcggccaagtgcggcgaagggaggcgatggacgcgttgccgggggcgcagcatggcaggcggcggccgcagtccttgcatggccaaggcaggcggcgaccgcgtcgagggctagcgggagagagcacggtgctgcgggcacgctcctacggctgcatccgggtgttcctcatcctgtccctgctgctgctcgccgtcaaggtagccgcctacctccaggggtggcacctcgaggaggtggtgtcgctcttcgccatcgacggcctcttcgccgcctcctacgcctggtggatgcggctccgcctcgactacctcgcgtcgccgctgcagttcctcaccaacgcctgcgtcgtcctcttcatggtccagagcatcgaccatgaaggctagtatttctgaattttggtcaaattttgtaattgcctagtatttgtgatttttttaaagtacaaaaacatcacaagagatgctcatatttggtcgaaatgctcatcacacaagctgaaatcacaaaatagaggtaaaatcacacaaagctgaaaaaatggggcacaaatgcaataaccaccaagggtataaatgtcattttttctacaactaacaccgttaataccagctgttagaagtgggggtacactactgattcagatttaaaaagtaggagtaaaactgtaaaccctaaaaagtggaggtaaaacagcaattcgaaagtaggggcatagatgcaattgtccctatatatattgtgaaagaaagtaggagagtagtatataaataaacaatgtaatgaggtgctggggatggcagattcactcgcatcaacatgtccatttcaaaggaatatatttgtgtgaaaaatttgaaagcatttctcgaaagatcaaatgaaaccatttcttaatccaatgatcaaaccatttatgtgcagtttaattttcttcgtccattggacgtttgaagctttatatttgttagctagtgacggagtaacaaaaaattggtgactatatacatacatccttgtttgtttggacattatattgcacttgcaatcttcagaatgctgcatgttgctttctgcatcaacgtatctcacagcaagcgtaaacagttgatgaagcgccactcgaataagcatgagggggcccatctgacagtgagtgcttgccagaagctttctactcctaaccacatctagtagaatattatcttctcctttttacgccttatcctttgagagaattcctttggatggtcggtataagagatagcaagaaggcaagctaaaacaaaccagctaagcataaggtgaagggtagataaaatacaacggtgaagttaaaagagaaacagagatgaacaagcgaaggttctctacacactcccttatcttggtgactgtgctagcagttctaattgttcttgctatgccaacagctttgctggggctcagtataggtacagttgagatccttatccccacatatatattttttttcctcttcaatttcaggttagaaacaaaattttctttggccggccgtaacgtcccatgatacggcaaagacgggagatgtaaaccatttccactatcttgaaaaaaaaaagagcaaatttttcttcgagagtcgcctcatctggccttctaaaaataaacttgagttaactgacaattgttaatttaaagcatcttatatgatcgagcagataatgagcatctcatctgtagattattttgtgctcacatgaatttttccaccagggaggcgtgctttgggtgatccacatggagttcaatccacagctgccatgcaacaagatgctcaggccgtaggtcctgcgtgcaacacaaacgatccgaatgttccatctccatgcccacctccactatcacctctctcgccatgaaacctgggcaaaaacaaagctatgctcaaggccttcgcttcctttgctccagcaggggattttgagccatatatggttacactattaggtgataaagctatacgtttgtaccacgagaactatgacaagtaaacgtatagattaaccaacatctgaattgtgacgagaattcgtacgttctttcagagaatgttgtaccttgtgttatatggtgcatgtacctctatatagttgtgtttgaataaaacgaagacatgaatttggcgagccgacaggagtcatcttgttatttgttttctgtactacgaagtatgcaggctgtaccatataatttgggagaagttttaccatgtttgcgaggtacatagaggtattgagaagtttagctatgtagacaattgatcgagagaggggtaaggtatgggaatgaattattgtaaccgatagcagtggagtaaatagctaataaaaaatatgcatcgattggaattggatcagattacaccactcacaaagccaaatcgctctactccatcgtatcaccggcgtcaacaccatgcacgttcgatcaccgatataagctgcatattcgatttgtgggttttgcttgtatgccggcaccgaggaggatggcaagattggcaaggacgagcttgcagaacacgggaagctgccacgcgaggtcggacagcatgccaaacaatctaaatcttctcaaccattgtatacatgcaaataccagccgataaatagacctcaatcaggaggttgtttccaaatttatgtgcagaaagatggcaagatggttttattaaggattaaagccaggtcttgctgtccaacactaaaatattcatatttcagtttattaattgtggtttcgtccagaagtgattttatcaagatttcacgttttttggataaaatttaaatcttcaaacaatcatacaaacattcagtggtattttaatcgatttgtgtttcttatgagcaaaatgtaaatataagagaaaccatgcaaataacgtaaaacagaattagagatagagataaactacctacacggtacatatctaacctacaactaacactaaagacaattctatatttttacatctcctagcaatatatttaccctctctaccaacctaactacctatacctttgagatggtaccttttattatgaaccgttggatttttattatttttgaaatgcaaacaccgtacaatcccgaagtaggaatcaatcgagtctgcattctagtaacgttaaagcacaaaatttgacacttttatttcgaaatcgatgtaccacagtttgatttggcataaataatcaagaattttaaaaaccacaggactacgcgctgtgaaagtactttatctgtctaaaaaatgtccaatcctgatgattaatctagacaagcaaattcagattcatcgttagaatttgacttctttttagacaagcagtaaattttagtgatgccatcaagtgataagtcagtcagtggtcaaagtgtaaccttataaggtctacatggcactgagtgcttagagcaggtacaataacaggctattagccagctgtaaatatattttagtaagataaacgatgagagataaaagcagcgggctacagatctgtagccagctacagcgcggactccaagactcaatatgtgtatggcaggtgggaccatatattaatagtatagtaagcaactattgtatgaattggctattagattggctatagatgaattggagctagtagtgggctgtactattaaatttgctctcttataaggtctacatggtggtgagtgcttaccggaagttcctatacctgagaccctgaccaaatatagtagaagtttttccttttttatcttttgacactatgggggtgtttagattcaggggcgtaaagttttagcgtgttacatcggatattatatcgggcactaataaaaaactaattacagaatctgtcagtaaaccgcgagatgaatttattaagcctaattaatcaatcattagaaaatgattagtgtagcgccacattgtcaaatcatgaagcaattaggcttaaaagattcgtttcacaaattagtcgcaatctgtgcaattaattttttagcctatatttaatacttcatgcagatattcaaacgttcgatgtgacagagtataaaattttggggttggatctaaaccgggcctatatctatccagaaagcttcttgaagggttaatataagagagagcaagataaggctatccaagatacaaaggtgaaattaaggactggtttatttcccaaaattttttcccaaaaatattacatcgaatctttaacacatgtatgaagtattaaatatagattaaaaaaactaattgcacagttagaacggaaatcgcgagacgaatcttttgagcttaattagtccatgattagctataagtgctacagtaacccacatatgctaatgacggattaattaggctcaaaagattcgtctcgtggtttccaggtgagttttgaaattagttttttcattcgtgtccgaaaacctctttcaacatccggtcaaacatctgatatgatacctaaaaattttcttttcgcgaactaaacatgccctaagaaaaatagggatgaacaaagccaagagctagcctctgctcactctctcctcttggtgactgtgctagtggttctaattgctgttgccatgccaactacttcgctgggacatggtgcaggtaagtttgtcatggcactccccttttttatctcctttagtttcaagtgagaaaatgaatttccctcatacaaattgcttgtttgtgtc

SEQ ID NO: 65881 - DNA, 2569 bp, Oryza sativa
cgtcacagataagtgtcatccgtgacgggttttagttttatgccgatataccatggctgtgcgaccatatctcaatcgggcgaaacttcggcccgattgagattacttccttgtgacggcccgcaaattccagtcttgttatgggccgccacaaatggaaggatttgtgtatggccttcaaacataatctttaatattttttgaaacacaataaatacgcaggcgcgcatatatatacacaagggcactcaccctatgaacaaaattaacttagtatcatattgcgttcacttcttaattttttgttaattactctctctgtttgaaaatataagggattctatgatttttgtaaatcaaattatcctatggttgaccaaaattattaataaactaatattttcgatatcaaataagcattagatatgttatgatatatgttttcatagtttacttctttgacatggtagatgttatacgcttctctacataatttggtcaaacttagaataatttgacttgggacaactaagatcccttttgttttaggaaggagggagtagattgtttgctagataaaattaatatataataacaagaaaaaggcttgtaaaactcggtacagattacatgcttccaacttccaagttcgaacaatttccgcaataacagcctcgcagctcctgataaaacaaacccgaagaggcttcccagctcaccaaattcatctcttaattatttaacacatacacatagatgagcttgaagtacagtatagcattacatgtttatttcacttgagtgaaattagtattactcacatacttgtgtcaattagcaggcagcatttagcatgactagcattaacctagctagctggtgtaaacttcaaactagacttgtaaactttaagtattaacctagctatttgttctttgtcagaaacttccaattgcataggcactccatcatggtgatggaggcggcggtggtggtggacatggtattttagcacagattacaattgaacccatgcattcccggcgattgggctttggacgaatcacctaaaacccgccttcctgattaaaacgcacaccacacaacacaattttagaagtagcatatgaaccttatttgttggattagcttgaaaataaactggtccaagcctacctgctagaaatgctgcccaaaagtactatacacttgtttaaaataaatctttcgatagaaacaaaatgtaattcttcctaggaagttagaattattgaagcataaaagaaaaaattcatttcataacttgaaatgaaacatagagaaaataggctaatggcccttacagacatatatacctgcaccaagtcccagcaaagcagttggcatagcaagaaccactagaaatactagcacaatcaccaaaagaagagactgagcagatggccttagctttctcatctctttgtttcttacttccacagttgtattctagaatcctgataaaccttcaccttatctcttagtaataactggtgttgcattgcatattgctctctctcttatatgaacagtccagggatctttttggatatccaattaaaaaaggaaaataaaaattatcttatactatatgtggttaggggcctgttcactttgatgaaaaaaaaccttaccaaattttgccattgccgaaattttgtcaattgtgctaaattttggcaacttgccaaattttggcaggatttcttatatagttatcaaaatttgacagcaaactaaatatagttatttttttggcaactttaacaaaatttggtaagcttgaaaatagcataaaagtgaaggcataggagttggaacttcccgaaagcactcactatcgcatgggccctctgaggttacactttgatcattgactgatttgtcattttaccaccaaaaatctaccgtcccgttcctttaaaaaaatctactgtcctagcgcctagcgtattcatgtgattctaggcggatcttcccctagcaggacaagtggctacccaggaacttagtgaataattaccccatcaggaaatggggattgattaatccacccacccatttacctgttaacgagaaaacaatagcaccaagtgcataaacgggtgtgggtatggttttgtaggacctacacctgtaaccaacccaataaataacccttatttcatatacagtaaaatgttacttggcacaccggcattttgtcttgctttttgtggatctggggctctaggttacccatcatgtgcacttttacccgtgtgaatgtgggattgagaaagaactacacccaagtactccctccgtattctaaaagaagtcgtttaggacaatgtttaagtcaaaccttgaaaatataaatcatgaataagtctcaatttgttgagtttgaaaatataaaaattatatgaatagatttgtcttgaaaaatactttcataaaagtatacatatatcactttttaataaatatttttacagaaacaagaagccaaagttgtgttttggagaccgtgtcgctgtccaaaacg

SEQ ID NO: 65882 - DNA, 18820 bp, Oryza sativa
caattgggactaaagatcgatctttagtcccgggtatttgaaccgggactaaagataacgatctttagtcccggattggtagtcccggtttaaaaaccgggactacaggggggttacgaaccgggactaaaaagcacttctccaccagtgtccgcatcatgatgtcctcctcctcgctcaccaccaaactcgatggcactgtctctaccctttcccctctggtcgttgcctgtctcccagcttggaaagagatggggaagtgaggggagagggaagaatagaggaacatgggttggtttgtgacatgtgggcgcatacgagtcccatgctgactcgtcgtgttgactagagttaaatcgctacgtcaatcaaaaccaggcactatactgctatggaatcttaggtacaccggtttttcaggttaagaaaaatgttgtatctggtgttgcgattttttaggatataattcaaacttgacgtcaagatgagggatctacaaggaaattattcctttgcaaatagcaatctccttggggcaagggatgcataggatatccaagcaagagtagtataactgggcttggtttatgtagaatgactggtgcagtgacgctgaacaaatggtcctgatttattttttactgtcagttacctatatttatgcaagatatgtacataaggtgtataagcataaacttacatgatatggaaatacaatactaaatgtacaacgaatttaaatgcattgtattggaatcggtctagattgataaaataattgataagtaaaaaagaacaactgacaaatacataaccatgtaaaaaagtagtaggacgatccagttgcgtaactacatctactattaatttggtcatggacaatcaaagtacgccaattaatagtcggcaatagtcctgaacaatcgaagtacatcaattaatagtcgacaaattagattcactgtacctatgatattcccttcaagcttttttttaataggaaaaagaaacgctgaaaacaatacgtgttgttctatcagaagaaatgtgatggcgacctgaggccactgctaaggggaaacaaactccaaaaacataaactgatataaacactaccagtagtaacagatatttagatttgtagccccaaaatatatcactaggggtgtgtttaattttcacaaaattagaagtttgatttaaattggaacgatgcgatggaaaagttggaagtttatatgtgtagaaaagttttgatcagggccggccctggccctatgcagccgaggcgaccgtcgggggcccatgatggtggggggcccatgatagtggggggaccaatacctaatactagtagtctagtatctgtctatggcctatctggaagcagaaacgccgaaacgagaggagttggagtgttgtcgccttatcgcccaatctgagacactattgatcttaataccgttattgatggttttgcatcaagaaatgcccgaagaagtatcttttcatgagaagcaatggatatgatggggttcttttcttcattaaggtgatgattagttccaaggtataaatatattgttgttttggttgactttatttctcgataattaccagacatattaaatttaatatatgaaagtatttattttcgttttgcaaataaaattagcgtctatatatatcataaaattttatatatatagcttatagggcccatcgcgataagttcgcctagggccctcaaaatcataggaccggctctgttttgatgtgatggaaaagttgaaagtttgaagaaaaacatttagatatgctcttgtctatatttattgtatcaggaaacgtcacaactttttatgggcggaggggtagctagctaaccgatagtgtttttattttaattgtcatataattggttgatatcaataaaactattcctacattagtatatttgtatattgtaattgtaagtttgtaaccggacagagcatctgaccgaaggcatcgatccgggcaccccacactggctgtggcagcctaacaattggtggagaatttgtgtctgaaattacgatcatgtccctgcgtgatgagacgacgatgcaaagcagcaaaggtgcaggccgccgaggaggcgacaaagcacgcaggcacgtggaccaccgcacactggagaatcagcggctgcacgatctgaatctgagatccagccaaactgtcagtctccatctcaaatctcatctcgtgatccatcgtgcgatcataattaagtacgttaatctaatctatcaatacattactccattatacatatgctcccagctggcctagctcttggccttttttatacaagtcaggtgcaaagcgcgcgctcactcagcacatatcattcatgggtagagtagtagtcaatgtctacacgtctacactgatgaacacatgacaaagtttggttttgctctaaaacacttaaaatattttgtttttctttgttgatggacacttataacataagaacaatgtttttgaactcacaaggagaaatgaaaaatagccattgctgagggagctagttcacggtcgcggcgcagtagactcgcatgagaccggtagagcggtctcggagtaggcatgctctaggtgacgaagcaagtgtgagaaacaacaagatggataaccccttagcatgtgttttgttcaagagtttggatagatcgggttagctaggttaaatccatttatcagaatgttaggtttggggatatgcaagataagcgttggaggattaccctttatcgggtgctgaagatgatgttgctggggttactcagaactgcacgatacagctctgtgttcatgaaaagaaaaggatagcatcaatatattctgcagtgctacatacaatccatctccttcttatatatactactgatcctcatattttatcccaagaaatatatacaaaatccggatgaacagggttctaagaaaaaactctgccaacttagcttgggtcttgttttgatcgcctgacacccatggatttgtttaccccattttcgacactgtgcagatcagatcccaacaaatgcatgccattcaggagtacgatctctacttaaacaaaaggaaaaaatcaggatcggagctgtattgctgtccgggtttgtctgtttctctgatgctgcgttcgatcggctcgcgtggatagaaattttcagcccattcaaaacgagagtactcactagcgcataattaattaaatattaataattataaaactgaaaaacgatctatttaaattttttaaacaacttgtacataattttttttaaaaaaatatatcatttaacaatttaaaaagcgtaatggaaaatgagaaatttgaattttggatttggagtaaagaactgggcctagtataattcgtttatagctctatgagttcaggtcagctattgggttaccgttcattcaaacctggaagacattttgatctcttcaggaaatttataatcttcctatctaatctgaattagcatcacactcaacttggttgcatttgatgcggtctttgccttctgaacagggtacacggtaagcactaggctttggctttggatggtgcccacctggcccagcccacttgtaccaccggatctaaatccaacggaccagattggattggattggattggaccagtagggtacagtacttaactgaaatgtgggggtgaaagtggttaagacagatcaccagatcctccggtccatgctggtggggcctaggaagcaggcgtgtgtatcgagctgactgagctgtgggccccatggcttagatgctattgctgcaaggtgataaacccataagcacagtcaacttcgcttaagttaagggaggctaaagcaacaagagatacgctaactcggcattttctgatgaaacccaaatatctatggcagtgtttggcaaatagaaaagggaaataatttttcatccatctttaaattctaagcatcaattattccattttcatttaatcctaaccttttattcatttcctaatcccaattccgccccccatttcccattatccaaacacacctcatataatcaaaagaaaaaaaaacatattgcctactccatctcaatttgaagctgcctactccatcttaatttggagctatgttaaaaaaaagagagatagatttgtagggagaattatccctccaaacattttttaagaagaaattatgagcatgttgagaattgaacacatgacgttagaattaaaaccacataccccttaccaccgcactatcaaatgcatctatagaaacattccatgtccatatatatccacaaaatctacgaacaaattggtaaggtctactcatagaacatttcacatttacaactttagtcattgattgttgcagtcaacatcctgccatacgggcagtgacttgaggcagggtagagatagggcttgcgcaccaacaaacctcaacactatatttgccactgcatgctcttcagttatgactggtagttcgttttggttaggatcaaaacttgtcatgaccaggaaactagggaggatatatcgtagcaggattgtgttcctatatatataagacccgtccgatctcgttaaatcatatgaaactcttacataggatcgggatattaccgaaattaaaataaatactaggatcaatatcgttccttgtttgctacgaaaatactacgatacatatcatacatatcaaagatactgacaaccttaagattgaggacagagctcttgcaacgccccctactcgtgcaatctacatcccttctggtagaggcggagccagctctcggacaagtcaggtagtcgcccaggcttgtccgcttgtgtctttactacagataaccatcaatgtctgagagaattggttgatcgtcaaaaaacggtacccccctcgttcgaaaatataagcatttttagcatagtgcaaagtcaatttttttaactttaactgttaataacaaaaaaacaaacaagatcaataatgtaaaatcgatgttactagatttatcgttaaacaagctatcataatatgcaacattttttatttaaaatattttatttttatagatatgttggtcaaataagcatctcgaagactgtgttgaattctttaaaaaatggttatattttagaacggatggagtattatggcttgtttggatcctccgagctattaaatagccctctggatccaaacaggcctatatagcgcatctgtgcttcgggatcctgctggctcatccactgccttccggcgaacttcggcaggcgacggagctacggagtagctagctagcagctgccgctctccggccggccgggcggcgacagaacacgcatgcacgtggaactataaataaagccggcgacgatctgaatctgagatccagacaaatggatgaacaggcatcacctcgtctcacgtctcgtgcagatccgtcgctgagatcaatatacgttgcctagctagtggctaatatttaatttaatctagtgtctaatactccctccgtttcaaattgtttgacgccgttgactttttagcatatgtttgaccgtttgccttattcaaaaaatttaagtaattattaattctttttctatcatttgattcattgttaaatatatttttatgtaggtatataattttacatattttataaaagtttttgaataagacgaacggtcaaacatgtactaaaaagtcaacggtgtcaaacatttcgaaacggagggagtatttaatttaatcagtgattgtaatttagtcagtatgatcgatcaggcatgttatcttatctgtccggactttgtcaggtattattttggtttcctaataaaataaatgtattattggttcaggtaattcgatgatctcatcccctccgtccaggcaggagatgattatacacgcgtgcatgtctagaatatctcgccattttattatatatatttctcatccgcacgtaaaatgggcaaaatgttttttttgtgcatgtgtgatgtgaaatatgtagttgttggacatcattattgttaattaaaacgatcaaaacataaagcagaaacattttagtagttgagatgagatatttggagtcatcaaaaagagaaaaaaaaacgtgatgcatgtattggttcgataatttaactattttgattctcttatttataatcgtcgtttagcaatttgttctataatcctattattgttatcagtcttgttaatgtgatcattaaaaaaatttctaatcctctctttcatctccagttctccactggagcaaagcatataaataatatcccctgatcgggccactgtcttctgtctcaccatccgcccttcatatggtaggtagttgatcatgcatggggtaaggtgagttgaccacattcaccattagagcaagtttaatagtatagtcaactataagttccaaatcccatctatagtcaattcatatagtagttatctataaatatatactacactattaatacatggtcccacatatcatacatacatggtgtctgagagtctatgctgtagctggctgtaaatctgtagccctctcatcttctctctcctcttttatattttcgatatgagtttatagctgacttatagtagggtcatcaccacatgataatatttttcatcttgtcagtaaaaaaactaaatttgccgcgaaaccatgcattagcaatgaccttgcacttaggcttgcgatctccgaagccacccattgtgcttcttatatggcttaacttctttcttgaattttgttcggttaatcccgccctcaaagggattgagggcttatttcgcggtagtctttctccaattagacttcccaaataaaactctccaaacacccatatagctagctctataattggtttcgcaagccaaacttgttgctcactccaacaaactgttcctctactttctctactctgaatttatgacactaaggccttgttcgatcttccattttagagatagattgttgatacacgcaaaacgagaaacctcattagcatatgattaattaagtattaactattataaattaaaaaaaatagatttatttttttagcaacttttttaaaaaacacaccatttaactagttgaaagaaaaacgacgaaattgtagtttggagttgaagaatagaacagggcctaagacccatatgttagcctctaccctctcccccctctttctcctctttctccctctctccctcttctctcactggggccatcccagagctcctcccggcccactccctctccgcagcgatgatgtccgtgcgaaggtggatggtggtggaggatccttgagtgcgaggtaggggtggctgacgccgaagaaagggaggtcgtcgcccgtgctatggcagcatcattggggcgacaatgagcgggaggccacggcggtgaggaggcacgtggaggctgtggctacggagtcaagggagaggccactgtgacagagtcgagagagaggcgctctcgacggtgccggttccgccgctcaccttcccgagttgcaacctttaacattgctctcgaatggaggaagaaagtgaatatgaggtagtgggacccacagaaggtgtgtggattgtaagtggagtaagttggccaagtttgacgagttaaggagtttggccggccgaatagtttggagagtgtgatggagagactatatgaatgcgattttttttatccacaagtgctaatttttgtcttttaaagtgggatgaagatgctctaacttaaaaatacatttttgcgagacaaatcgataaagctttttttaaaaaaattttgacgaagggagtatattacttatggcacatttcaaatttaacgaaaatggagaacaaacttccgctgcgcacaaaatgtgcttctcttagttcatgaccaacaatatccctaaatgaaacccaattctaaaattgaggtttattttgtgaaaagcttactcaacaactcccctagagatgtatcaaaaaattagaatcctcttctcctcctttctcgctctccacaagtcgagagatactctcgctccaaatttccgcatggcgaaaggagtgggtgacaagtggagagatcgtgtgcgtgggaggcgatgggcagagcaattttttttcgtatctgttggtagttagggggtggttccattttttattattagaagttagtttacaccttaaaatcaaactagaaattcaaaaacataattttagagataaatttttaggtatatcttgggcatattaaatatttaggtatatcttgggcatattctttggtactccctctgtcatattttaagtgcagccatgattttccgtgcacaactttaactgtccgtcttatttatttttttaaaaaaaattaaaatcataagtgacgtaaaagtactattcatatttgggtgaatagctaattaagtccctcaagtttcaccgaaggctcaatttggtccttcacgtttcattttatccacatagctcctctaaatatttgttttggcttgacatcatacttgggcccacttaatatgccatatggctatttttaagtcaatatttctattagaaaatatcccttttgcccttaatttatatacaactatatactaaaagggagaaaaccaagatgaataaacaacattgcatatatacttcccattatttcaatatgtgcacatgaaacttaagcaattactatcgtatacacttgctagtacataatttattttcgttttacataatttactaaacattatcttaaaaaaataaagcatacaaattttctcttatatatgtgaatgatgggggtataagtgtcatttatcaagagagttgttggtttaaggataagtttgaactaaaataaaaacttgaatgagtaatatggatagactgaaacattaagaactaaactgagctttggatgaaacttggaggaccactttagctattcacccttcatattttatcatcttataataataaaaatactaattataaaaaaatttaaataaaacggacgataaaaattagacgcaaaaacttataactgcacttgaagacaggggagtaccggagtgccatttaaaattgggaaaacggaaaagtgaaatattgagctgaatttccgggcgctggggagtaggggggtcaaaagagtcatttccgcgtatttctcgcccgttcgccatctcttgtcgtgtagtaccgccgaaaaggaatttccctttccgcccctgcgctgtgcgctccactccactacttgagtcccccatccccagactccgccaccaccacctccggctccccaccccgaccagcggcgccagagcagaggcagtgaggccgagctcctcgcctcgcctcgccgtctccgcccgcgcggcgctgccgccgagccgccgccggcctcctcctcctcctccttcccggttcggatcgggcccaaggtatatgccactcgtcttctctccctcctccccgccgcttcatgagccaccggagattgccttgaggggatttcttcccgctcggatcgacggatccagtcccgtttcttccgggttcttgcggtgtagagtcgtagtcgtagtggtagtgttggtagcggcttgtttttcgagggagggatttgggggggtttggttggttcgggttcttggggagggtttagctgaacccgtgaggtttctgaggtccccgcctgaacagatctgtggtgtctccgtgtgggagcatgttttgctgcgtgcgtgcgtgcgtgcatgctagccatggattggtgctcacgccgcatgcgtgagctttggggggggggggggggttcagttgttgttggattatgtgagcgagaacgcatgatacgatgcaatgccgcggtcctttttgttgtgatgggcagcctcacagcatgcgtgctgcggcattcacatggacgtcgacaccgtgtcgattctttttgtgtctcttgttgtgttgtgaaatttttcatgaatggtgcaaggtggcggttggtcttggatgtggatgttgagctgggaggatcagttatcctacaaattgcatcttagtagtacatatgttgacatggcattactgattcaccctcctttttttgcttctgcatgtcattgccctgttaccccttaaaataggttctattatggtatacctatccagtgtgcaagaatgatatgcctttgacattgttgcgtcatctttacttggtactttagatggtaaaatggaagtgtgatggatgtaactgtgtcaatacagcggagaagatattaatcaataatcatgtacatttgttgtttttggcatcttctcatgtaaaatcttttgggtctgttcttgttatgtgcttcactttcacttttactgttttttttttaattttcaagaaacatacagcttcagtgtggtgattgataaaaatcattactctaactaattctgttttctcctcgaactgttctgttcctagagccggactgcagccatggcagatctgcaggagcccctcgttcgtccgaagaggaagaaggttttggtggactacttggtaaagttccgatggattctggtgatctttgtggtgctccccatttccgctctgatctacttcaatatctatttgggcgatgtctggtctgccatgaaatctgagaaacgtcgccagaaggaacatgatgacaatgtgcaaaaagttgtgaagcggctcaagcagaggaacccaaagaaggatggccttgtttgcacagctaggaagccctggattgctgttggcatgcgcaatgtagactacaagcgtgctaggcattttgaggttgacctttccgccttcaggaacattcttgagattgacagagagagaatggttgccaaggttgagcctcttgtcaacatgggccagataaccagagctacatgcccaatgaaccttgcccttgcagttgttgctgagcttgatgaccttactgttgggggactgatcaatgggtatggtattgaagggagctctcacctctatggtcttttctctgacactgttgtcgccgtggaagttgttcttgcagacggtcgagttgttagagccactaaggataatgagtactctgaccttttctatggcattccctggtcccagggaacacttgggtttcttgtttccgctgagatcaaactcattcccatcaaggaatacatgaggctcacatatactccagttaaagggtcactgaaggagatagcacaaggttattgtgattcgtttgcaccacgagatggtgatcctgcaaaggtcccagacttcgttgagggaatggtgtacacagaaaatgagggtgtcatgatgactggtgtttatgcttccaaagaagaggcaaagaagaagggcaataagatcaactgtgtcgggtggtggttcaagccttggttttaccaacatgctcagacagcactcaagaagggtgagtttgtggagtacattccaacaagagagtactaccaccgtcacacccggtgtctgtactgggaggggaagctgatcttgccattcggcgaccaattctggttcaggttcctcttgggctggctgatgccaccaaaggtgtctctgctcaaggccacacagggtgaatctatcaggaattactaccatgacaaccatgtgattcaagacatgctggttcccttgtacaaagttggagatgctcttgagtttgttcacaaggaaatggaggtgtgtttcacttcggatcgaatatttgatgtttaagtatcaaatatgcatttaaaacgaggcttttcaattatataactacttctagaaatgaatattccatgccataaattgttatgcttgcacatgcattctattacttatatctttgggcttgatgtaagttcacctaactattcttgtgcctgtaccaactattttagtgtactgcaatctactgctgcttacagttcactaataatttctgttattaggtttatccactgtggctgtgcccgcaccggctctacaagctccctgtgaaaaccatggtgtacccagagcctggctttgagcaccaccacaggcaaggtgacactagctatgcccagatgttcaccgatgttggtgtgtactatgctcctggtgctgtcctgaggggcgaggagttcaatggcgctctagctgtccacaggctggagcagtggctgattgagaaccacagctaccagccacagtacgctgtatctgagctcaacgagaaggacttctggaggatgtttgatgcttctcactacgagcattgccgccaaaagtatggtgccgtcggtacctttatgagcgtctactacaagtccaagaagggaaggaagactgagaaggaggtgcaggaagccgaggccgccatcctcgagccagcctacgctgatgaggcgtaatttcgttgagacctttgatggtttagtcgtccgggttttctccccattccaaatgggatttttcatctgaactatccttttgcttagaacttgatgtgcagtgtttgtagcactttgtaatcctgtcatcgtcgtccgtctgctcttggtacttctttcacccttgatcaagttgctgaacttagtcaggacttaagtggtatttaacccaagatctgaataattttgtggctactggactagttaatttcctcagctattaatttgagctgtagcatcagatgaggtgaactttagcaattgagctgctgtttctggtgtgtcattattcgtcaagaaccttttctgttcattttaatatacttgaactgatcaccagtcactatcgcactatcgatattgatcatgaaaagcaagatcttgaggaaaattgagtgatggggttggggccaaaattgtgggtcgttgcaaaggagtactgtttgatccacaagaggataagagatgatttgagggaaacaggagaacagtgttgcagacgtgaatgggatgcatgtgctaccggttatgttctgttacatagaagatggtacatgtaccaccgctttgaggctcttttcttccccttgtaattcgtggtggggttgaattgattcctgtagaaaataaacgctgctcaccctttcgtttaattctcccaccaagtggattgaacgggatttgaagagaaataataacacacatcttcctcaattctctccaatctctttcttacgacaatgccttatgagatacaatggcgttctcttttgaaacaaggggatttctgattcatgtgacgaggtctctgtatcggagtcctaaccattggtgatggaagggacaagaaataattcttcatatatataagaaaaaaagagaatataagtggttccttttctttatatatgaaattcgattatttcatttgtgttcgcgtttgagattttagttgtgacttgtgagagaggccccagtcatctccattccttaggggttccccaattacacatcaaccacagctcattccttttctccaatcataaataaactataatctctatatttttctttcatccccattctcttctttctaattaaaatagaaacggcttgaaccatactcttagtatttttaaagttctacattcaattagggaggtagagcttggatatggatttttcagaacttccgcttggaggaaatggacgcttgattgcataatttgattgcatccaacaaattttagtaggccatgagtaccttttctttataggaaaagctctccttttgccattccttgaataccgtattatctctttcaccatcattttcttaacttctttctttcgccactattaagtggctattcagttctcttttgcgaccacaacctaaaaaattcctttctttcctttcttttttttttcagaatattatctttggtcaaagtcagttgaccattgcatatatttctcctaaaagaccattatgttctcatgtaactaaaaattataaggatattctacaaatcaaggaaaacatgattattaatttagtttttaatggatgagtaaacactttatgatatgaaaatttttagttagtttgcaatgtctccattcatagcttaaatgaaatatttcagatgaaaatatctcgtatatccacatatatgtattgcagaactatgaataataacaatgaaatagcaactataaattattttatgaaatatttaaaaccaaaaaatttccatgttgcttttttttaaagttaatcccaattagtttttctaaaaaaacatatttcaagtgcccaaaatttgtttccttgatatttttgtggcattcgctaaagtttcaagcgttattttgttttggaacatctttaaaagaaaaatggtcttccaaaaaaaaaggcagcctaggaggagatgtgacctcacagtcaggtgtcatcgacaagacgaagataacaaaacaaaagcgcactaccggaagaagagtaaaagagaaaaaatgacgacattaatttgagagaatatggtttcaaccgaaccacgaaaattgaaaaaagaaaaaaaattctcttctttgtatcgtgtggacaattataaccttatagcatttttgattggactccaactttaaattttaacttaagagtttagatttagagtgaaattgtgaagcagactaaacccagttttatttctgcagttcattttatgagagcattcttgctagctccacttctattttacgtgaaatcgaaacattttggctgaaaaaaagaaattgtttggctgtgggctctacctcaggagagatgtgtagcttagagctcggaggtcggcgtgccagccaaacaggaccttgaaaccaaaattattaaaatccggtgtaatacgccctctcgcaaatcccatccgttgctccgtaaacggacggccaggattcaaccacggcaaacgaagcctcgcctttatgaaacgagagaacgcaccacccatctctctccacctcctcctcctccctctttctccgcgagagagaggccgagcagcgaccgcggcggcgctctcccccctcccgccgcctccacccaccccgtgctcgccggcggggcgaagcctccggtgacaatccccgatccgatcgccgcgctcctctcctctacccccatcccctcctcctccgacgcctccgcccgcccgccgccgtacccgtaccaaccggaaagcgcagctgatccggtacgaaaccctagctgatccccgatctggtgcgcgcgcgagcgcgcgagatcttctggtgggtttgcggttggtgattggcctctctctctcttttaccctagtcgatctccccgttcgtccccttgacctcgagttcgaccgccgcgcgccgatctccaatcccgcgcgagcagcgggcgtctgtgcttccgcgcggaatcctcccgcgccggtgaccatccgtacgaaatcgcacgtccttctcatccctaggcacgcttttcggtcacctcgaatttgcgttaaccctggcttctcttgtagatctggaagctttttctatatgcctttaccatactagtaacaacagacactttgttccctcacaaaattcatagctagtgctggcttactgcaagacgtacccatattatgagattgtttccaaaaatccaaattactgtgattgcaataatgtaaataaggagccatatcagaaattttcatcgaaactgactggccatttcggacgcgaattcgagggcctatagctgcttctgccttgcaacggggaggagcatacgattgattggaaattgatgtggttgcgagaacgtaaatgagtaaccatgtgggaagtttttactgaaaatgtttgagcataagtatattttggctgcgtggtgtctcttggtggcagtcttgagcttatctgcagtagcttatcctttgaagctgaattgttgtcaatatgttaagataccagctgattaatttgttgttgtcaaaacctgctttggtccattcacaccatgtgctttaaccttttatctcataggttttactgagaaggccaaagtaaacagtgtgcattttcctgttcagctgtttctattcatcgtttgttcttattcctatcacttaccaaacatgtcaattttagatggatctcaaggatagcctctccaaatttaagcagcagcaagagaggtgccaatcatctttggccagcatagctgcatcgacctcaaaaccaaagcacagggcccaaccggttaatgctccatccgctccagcaaggccactacaacctattaagttttcaaatgatacagaaaggctacaacacatcaattcagttaggaaatctcctattggagcacagatcaaacttgtcattgaattgctgtacaaggtaaatctcactaagctacaaccttgtttcattttcctttccataatagtataaacaggaatgttcccccagttctggtatgtaatgtcttccaatgatcctgcaagtcaccatgttgattgagtttatatgccagtaaatgccaatggttctgtataatctgttaccatattagaatattatgcccttgattagtacttctttttttttttggatcaatggagcctgaattgttaacatattatatgagagtgcataagacgtttaccttttgctttgttctgttatttatcattgtttcacaccccttggtgcatgcaagatactcagccagcaaattcagatatgcaaaatttggtgccttgctgcttattctgtgttcaacaatgatgtgcatgttgatatctggttaaagatacaaggatgcattgacaataactattataagcaatatgtgaagtacacatttaatttgtattaatgctgcatacagtggtgcagccaggattatatgctcaggaagaaaatttgtaagggacaacccatacaacttgtagctacaaaagttgttaaaagtaacttatgtaatttatagaatcacagtattaaagagcactatgatgatttccgcgctggtccattttctgcattttagttatagttgtcaaaatggtttaccaatgtcttcatgaatgatagcaaaacaaatgttttgtgaacttccttataaatagcaatgctgtattgcgtattgttgttgtaactgagatgtcttcaaaatctgcagacaagacaagcttttactgcggagcaaataaatgaaacaacttatgttgatatccatgggaataagtctgtctttgacagtctgaggaacaatcctaaagtacattatgatgggagacgtttctcttacaaggtaaagaagtttgttattccagtaactactagtcttgctaacatcaatacttgtttcattggtatatttacccaattgtctatccttcctacctgaaataatattaatggctctcatcctatgttccccactaaacataattaattcagaagtattgcttaatgccttaatatcatattgcatttcgactattaatcactggtgtggcaagctaaacctgtcatgaccatggaatttgtaattgataatgaaatgtttttctttaatgcttgtttcggggaaaatgatataatgatgacaattatttatgggagaacatcagaaatgtttagtcttaagtttacataggcttcccatcttgtttgaagttgatttacttctacggtttcacgcgttaatcattgttgataaacgtgcagtccaagcatgatttgaagggaaaagatcaactacttgttttggtaagaaagtatccggagggtcttgctgtggtggaagtcaaggatgcgtacccaactgtaatggaagatttgcaggtgagccaaatttcttacattatgctttgaggcgatgtcttagatattactgttcttcaacgctcaccattttagtttttaattggatccttttttgtcctccctaagatgctgaatacttttctcctttcctcccctgagtttctggaatatcacactgagggtgtgctcatttcagtagttaggatgggctgattaaccgcacgtaaaacgagaaatgtgattaacatatgattaattaagtattaatatataaatttttgatgaataaatttgttggatttttttaaacaacttctttatagaaagttttcgcacgaaatagaccgtttagtagtttgaaaagcgtgctaacggaaaacgaggagaatctaatcctataagctgaaacgagcgcatcctgagtacagttaatggtagtacaagactggatttatctgccaattattgctttacgtccattcttttggtaaaattcaattggcatgatacagttgaaatatacttacgccccttacagaaagttattttaggtcctatgtcttttcaatgtgtatccatcatgaaaatgatgtctgtgtgaactccagaaatttccttgcaatagtaaaacagaaatgtataatattgggagttcagccctgcaagatctttgtccataaagctgtccatagatgcatttttaaaaacatttcttgtactcttcatttgtgccattattagatacttttggccttatttgcactatgtaggcgtattgtcccgacacagattagagccatgcaaatctagtagtcaaaatgtgcgt

SEQ ID NO: 65883 - DNA, 31340 bp, Oryza sativa
catgtgggcacacaaacgagcaattggatgcaaaagttatttaatcctgcacagatatgcaatgatactatttatttctacatgaataaactaatagaacatcttagatgataatcaatttgagaaaatcttaaaaaccttatgagatgattgggatggagagagtaattggcttaggggtgacaattttcatgttggagcaggggacgggtaagaatttttatctgcatctgagtggggactgggggcctcgcaaatatgcagggacggggatgggggaggggtttgacccgctggtcacccgcagggccccgggatagcctatttcaaggcccagccgacccattaagggaaggagtatataactatgccctaatttcctccacaccattcaatcgccaacttcccaccccagccaacgagccgttggagcgctgctccaggagggaatgggggattcgggtctagccagggcatgcgcacctcgcccagagctcggctgccccggcagccccgtcgccgcccctagccatcgttaattcgtcacctccccacagctgttgcaggccctctccacctctagcacgtctttcatcgtctcctttcctaacgtcgtcgccctccacctacgctcgggtagaatgcatgtgcttccttcctgcggtgccactctcctccgtcggcctctggatctggatcaccactgctaggggctatcaccgtcacggccaccgccccacctccatctccaccacccagccctgctgttcaccgcccttctccgcgcaaccgcgcctctctctgaattgctatcagaagcaatttgaggtctatttttgtgatttataattatgttggcaatgcggggccatgctcacccgccgggtcctgtgcgggggtggaggtgggtgatgtttttcactcattgcctttgtgagggtgggggcgttccagcctagttcgcccgccccgttgccacccctaaattggcttgtttacatagactcaaaaacaaaaaaaattatataagtaggagcatctactttatgttaggttctatggctaagtaggaatgatataattttttttataaaactccaactaaatcttatatgcagttactcttagagaaacatattagctttgattttgggcaaatctacaaatgagtgatgaggagaaggaatccatgcctaaatttagaaattacaattatgcaaattttcgccgactttggatgcctattttctaataggattgttgtttgaataagttatatcacttcttttggtggagttgttatttgtcttccatttcattttatggtagctaagtttcggggctttaagccaataattatgtaataattggttgtagcttttgttgaattgaaggcagactttcgtccattatcttaagaaaattgaagcgttcgagtcaaaagtcacgcctaatttaaagtctagtagtttggaattcaagaattgtgcacaaaacacatgggttgattctctacttttttttaaaaaaaagaaaacatgggttaattctagtaatgcaaaattcatttgtttggcatgcaatacttatatcttatatgttcaataaatgaataaatgaataaaaaaataattaggtatatagaaaattatatttatggaatttaaaataaagtgatgggcgaactacgggagttgaacccacacatggatgattcacaatccactaccgagatcccggcaaaggattttctcttctattttttctgatgaatggacaagtttattagataaatagttgaaagcatgcagtctgttgcgagaatcactagctgttttgtaaaggatgatgcgttgcctcttcgccagcaagtattaattctcttagcaaacaatatattaacacaaaattaacatgataaggctgagtacgagagtgcacgtttcgaacccatcttattgacgtggaaaacgaggtaagtattgttttaaaacttaaaatagattaatattatattttaaagtaactttcctatattttttttcaaaacccatcatttagcagcttagcattgcgtggaagaaaaagatagaacttgggaaagatttgttccaaacaaagcctaggtctctaagttaattgtgtcatagtagagtgatgagccaccaaccatattaaaatcttaatgctcgtgattacacacagacggatgagtgttcaataggaatttaatgaggtctaaggatttatcattggattgccaatttgccatctcttgagcgtgtgagggcgaagtactacaagcctctacatgtatataggattatacgatgaggtgaaggagagaagttaggagaaagagaatgagccacatctcgtgcaaggggcaacctccacacaatctctaagaaaagtgaaagaagatgtgagagtaaattaatattggggtttgggtattagttgtgatatattgtacactactacgaaaaccatctttcgtggtggccattttgggttttcgttagcggaatttggagacaccacaaagcaaaggcaagtgaaaaacaagatcttcgctggcggttatcgactgctagcgataattcaatttcactagtagccgtcttaagccatccgccagcaaggcagcaaagatccattttcactggcggatgtcttacaccgactgccagcgataattcatttttgctggcggcatcaaccgccagcgaaaatctattttgggccaagaaaaaaagacccaatgcagctgccctagccaccagcaaagaggaaatttgaaatacaaatcatttacacagatcaaacatcatttacacaaatcaaacatgaaatacaaatcacaacataggcatcatctggaacaacatgcacaaaaaaaatcacatctagcaatggaaccctagccaccatcggccccgtcccctcccgcgacatagccaccgccaccatcggccccgtcaccgcggtcgcggtcatcgtcgtcagctccaccgccgcccgcctgccatcggtgccgcgggggccaccaccccctccattcggctagatctgggagaaggagagggaggggagggaaggggaggcgagaagccgccagatccggcagcgtcgtcgtcgtcagctccgccgctgcccgcctgccgtcgccgccgcggcggccgctgcccctccctccggctagatctaggagagggagaggaaagggaggggaggggatgggaggagctgctagatccggcagcgtcgtcgtcagctccattgctgccgcggcggccgccaacccctctgtcacgcccagaaattcccgaataggattccaagcagaatgtgcattaaaacccccgtccaggaccggccggggtacacaaacgacaaaattgacatacagatccacgtcttacaaacatcataaagccttacataaatgcaacggaaaattaaaagataactggagctaagccatgacttggaccgcagcgggatcaccactccacaagcatccttgacggcacggacgaagcctactcctcggagaagccaccatctaacgcatactcaaactctggggtttggggaaaatagagcaagactgagtactacccactgtactcagcaagtcataccggaataggggtatgatgcagggaattatcaagggatagttatagaggttcatttgcataaagcgagcatttataaacagtagttggaagcagtaaaacaattataataattaatcaatattaatcatccactgtccaacgctataccatgttgcaacaggcccaaccatccacctatactattcaattccattagactagactagggtgaatctaatcacggtgaatctggttgaccgcccataaccgcgggcacggctattcgaatagttttactcttatcagaggtgtacaactgtacacacaagacacagccccacgatacgttttcgtgcgccgacatgccaccacgacataccggatagaggccgtgataggacccttcgcataaccccctctaaccaagcacactacacctcaggtttcacccccactcctcgcaaggcagcgagcagtcccctctcgtgcctaggtgaatccggaagccgcataggccgtcgcagggcccatccaaactccatcacgcccacccttgcctggatgcgtcagctagaggaaagctacactacaagcccagccgttgcccacgctggcttgtggtaagtacgaggaattcttccagggtttcccgcgaactggtccttaagtgccatgggcgcgactagcaaaaccatgcacccacagcccaccatttaacatattttaatgaagcgacaccaggacggtggctctaacccaacatcaacactagaacctgaagtctatccattaatatgatttcccccattgtgtgctagttgaactaagcatggctaagcaatccctagtccaatatctaatcatgttatatcccaagctaacaaaggaacatggtacaaaatagcatggctataacagtaggtaaacatcccatggtaacagtataaaacaatgcagtatttgaaggaaaacaatggagcatttccaatataggatcaacatgttcaagtgacaagcatgacttgccttgctctgctactggaggaacctcggcgactatttcaaagtacaccggagcgtcgggagagccggaatctagacgacatagaaagcaaacaatacaaacaggctacaagactactgaaacagagaacaaaaccatttttaatggattctatacatttttcttgattactgagacttgaatgggcttaaacggagctcggatgaattagatatgattttagaagattcactgtatttttactataacagaaaaaaatccttaatttatttattgcgcaataaataaatcccgggagagagagagagaggcgacgccgacatgcgggccccacatggcagtggctgcgggcgctggtccatggtggatcgggtccatggaccggggaaaaggggcggtgcaccacgtggtgcacacgtggcgcgcacgtggcggcctcatggcagccacgcgggcgacgggatcggatggccccgatctaccgctcggtagatcagacggcggatgcggctcgcggccggcgtgcacgggcacggctcaagccagcccggcggccatggcccgcggcggcgcgaggcggcgaccggccgacggcagagggcggcggcgcagcgactaagcggtgcgggagagagggagaaaggggaggaggggcctcaccgacgacgatcgacgacggcgagcgacagagggtgatggcgacggcgagacgagctccgggaccacctaagggatcaaaagggatagtaatttgcccgtgctaccgctacggtgacatttaataacataattcaagcaacctgctaacgctatagtgacatttaataacacaattcaaacaaccaaaaatatatacaagactatattgcatagttataagatcaagcaaaaattaaaaaaactatcactatataaataagtcaatctgttctgtacaatctgttgtacgcacataaataagtccaaagtaggtagttctgtacaatatataaatactgtgcaggtaataactatcactatctttgaccagtagtgaaacacatattgtttgctacagatcaataacaaggcaacatattgcatacacaccatcacagttcgatcatcatcgatccattaaagcagtcatggtcagtgcaaggctagttttctgtaactcaagacattttgatcttcagaatatgtttgcacggcctcataaataaaggagaaggcatattcacaaatcttggaatacaaaggaggtaaacgaaatttaatttgttctatgacaataatctgaaatctataacactctaagtatgacatccaacaattatacgagaaggtagtcacaacttaaaccttgaagccggaacccttcattttgcttgtcatcgtccaatgatatgaagagattccttttgcttgtcatgttatcctgcgaaggaagtgaaaaacatgtttgctccattgtacccgatgcacagagaacaattttggatcatagcaactacagttatgtttgctccaagtttatccttgtcaatgcaaacatagtgtatttacttaccaacaaacattgtttcttctttgatttcatattgacaaacagatcccttgaaagcttgctatttgaagaggatatacgcctcggtccattcttaaacagtgaataaatcgtaagggtaacatatataaaaggctataaatttgtcataattttattcttttctctctatatgattcatgaatttgaagatatgattatccattgcactatccaatactctgtgaattgcatttgacgatccaatactcatgtgttcccagttgagtaaacacatgatagttctgtatatacaggcatgttaggcctcaatgcatggtaggtctgaaattagtataacggcagaaaaaatgacaaaacattagtttgacaattagcctataaatacgacttctctaacccaacaattaagagttactacaaagcttttgttgaggtaaatatcctctgcatgaaatgactgacaagtagtacttgcattatacacataacataatttgaacataattccgttcaacagccaagatgtggaggcggcatcaggctctccttcgccgcatctcaccgcttaagcatccagcgggctggcctgctagggggatcggatgctactacgccaccgagccggagggcaggaagccaaagacggctcctttgcaggtaatttctggaatatgttatctctaggctaggctcggtgcttgctatcatggcaaatccctcccttttgagtaatgaatgcaggtcattgccgaaatacgtgtctcttaccttgagagttttggcgacgagttgtatatttgtacgaaatatcagtcaggataaagacagtgagaacagtgagaacaacggactgaacacattatttaccactgcagctcaacagcataataagaatttctcataagcaagctatcgttttgtctgaattactactttcctacacacattccatagagatgctttgattttcagtggattttaacttttttttaatcgtcccaactacacttgtgggaaataacaaacttgcattatgtaaaagtttgacaatcggaatatactgaaaggcacccattctttggggtttcaagaaatccatgtcatcagacggatatagtaagaaacatccatactgaaatttgcagtcaaggggcatggtggataggttccatttgcgtgccaaaggtggtgatggcggcaatggctgcatcagtcttcctcgctccaggtcaggatcgccaaggcaagcctgatggtttaacgactcccctgctgcacagcccatggaattgtcacatggtgctagcagtaatctttttgtgtatttttttgtggtgtaataatgcctggtcgtgatcaacattagcctagatcttagtgaaaaggagtaagatctaggctaacttccttccccatctcacagattgttaattgcttacaaaataaaattcagcagcagcacctaagtagagtaaactatcagatgccctgtttttctacataatgcataacattaaatttatttctttctgaatagtctccagatcacaatgaatgcattggaaaatatgtcggtatttaatcaatctaaatattagttggccctaacacattgacctaacttaacacttacctatgatgagatcggataacgagtgattgacgacgacctgatggctgcgcggtggagacaggacggcgagcgatccgatggcggaacgcggtcagcgcgagggtgcgccggcggcatcaatctggaggcgggaatcgacggcggcgcaatggcgaccggatggagaacggacggcgatgggatcgagaaatccggatggacaacggacggcgatggagagaggggcggcacgcggcggggagagaggggcggctggggtcggcggcgacgtgaatcgcggcaggggcggcgtgatggtggagatcggtggcgggctggcgttgcatgagagggagagaagagagattagggctggggaggcgtgggctgggatgggggagggggcgcagttgagaggtgcgaggtggagaggatctgagcgttggattttacacagagatgatccgaaccgttccacgaggaatgaaagaatgagtgatgagtgataagtgaaaccatttgttcaactatagggtagaagatagatgagttagagagggagagggaaaccatggatgggtagggcggcgaccgaaggcgccggccatggcgaagctcaccggcgcgtggcacgggcggggttctagcggcggattactacggaggaggggtggacgggacggctcgcacgacggcgaacgcgacgacgtcgacggtgcggctcggcacggcggctagtggcgaccggagcggcggcggcagcggcggcggcggagaggaggacgacggcgctaaggcggtggagtgcacgggagcgggcgattgcaaaaataaaaagagagaggagggaacgtgtcacgcccagaaatttaacccaaatttccagactattttgcgtattaaatccctgtccaggaccagccagggtacacaaaacgacaagtaatatacagttccaaacgtaaataaagcgtaaaatacttacaaaagaggcacttagtcctcgcaccgaaacgaaagcagcagcagcggtaaaaggcgatcctagcggggcttcagctccactccacaggcaaaactcaactggggtctgagccttggtcctctaacttcgtcttcagctcaaaagcactacacttctgaaaaaaggggaataatagcaagactgagtacaaccaccgtactcagcaagccacaccaacgatgcagatgtgcaaggggatacaaggatggtttgtggctatttgcataaaggcggttgtaaaacattttattgagcaaaaccgtaaaactgttgagtaactaaagtaacattaaatctccactgatcaacgctacaccacgttgaacaggcccaaccaacccacctgtactacagtgcattgggtcgatttattaagatgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagaccctccgcataaccctcccctaaccatccacaccacgctaaggtttcacccccacccctcaaaaggcagtgggcggtcccctcttgcgccgaggtgaatccggcaactggacaaccggacaccccggccgacccaactccatcacgcccaccctcgccaccgatgcctaggaaagggtcgagctatacttcagatcaagcagttacccactcccgcttgtggtaagcactgtaagtcttccagggtttcccgtgaaccggtccttaattgccatgggtgcgactcgcaaaaccatgcacccacagcccaccattcagtcacattttagttggataattacgaccatagaacttggccagatgtctcgagcacgcagctcaacaagatactagaatgtctaatactgcaattatcccatcgactgagctagtggtaattaagcatggctaagcatatagttctagctaggtcatcaaagtaacacaagctaggcgatttattacccacggttgacaaaggacagatatcaagtaaacatggcacaagcgagcagataggtaaaccctgatcccatgtaattagcaaaacatgcatatttatttgtaaccggtaaaacatttataaattgggatcaacatgctcaaggggaatgtgtgacttgccttgcttcttcaaaacaatcttccggactcttttcctcgcgactgcggacttccgaaacgacggattctacacgctagcacgcaaaacaaggaaaaactctaataaaaaccaaggaaacagtacataaaaagtaaacaaacatgtagagctcaattttagatgaattttgcaagttgaatggctcaattcggagtttgaatgaattagatatgaattttagaagttttgagacatttaaatgaatttctagaattattaacgaattatgacgcaattattatttatttttccaaaggaaaagagggttgctgacgtcatcaaaggggaggggcggctccggcaagcgggccccaccggtcagcggcacaagggcgccggtccaccgtggaccgggaccaccgaggcggtccaccgccggtccacgggaaccgacggtccggatcggcccaagccgatcaggctgccaggggcggcgcggctggggcacagcacggcacaaagtcggctggccaaacgacggcgcgcggcggcgcggccacccgcggcgacggccggcgacagctcccgcgggcgaaagcggcgcacgcgagagcagcggcgcggcgcggcaagggggaggcggcaaccgtctgcccggcaccaccggcaacggcgcgggcacggagcgcggagcgcggcggcagcgacccggtcggacggccaccgatggtggcagcgcgtcgcgaggacgacctggaggcggctgacgaaggggaggaaaagagagagggaggggagtgctcaccgagatgcacgacggcgaaggggcggccgacggcaaggaacggtggcggcggggctcctcaggaagacgacgcgacggagctccggcgacgggcgtcgctcgggatggggcggacgggctcggcctcgatcggcgaccgaggaaggaggagctctgtcacacccagaaattcccgaatagaattccaagcagaatgtgcattaaattccccgtccaggacaggtcggggtacacaaacgacaatgttgacattcaggtccacgtcttacaaacatcataaaagtcttacataaatgcagcggaaaaacggaagacaacaggagctaagccttgactagaactgcagcgggaacaccactccacaggcatcctcgacggcatggacgaagcctactcctcggagaaaccttcatctgacccatactcgtgctctggggttgggaaaaatagagcaagactgagtactacccactgtactcagcaagtcacaccggaataggggtatgatgcagggaattatcaaaggagagctagagtagttcatatgcataaagcgagcattaataaacagaagttgacagatttaaacagttgtaacaattaattactattaatcatctgctgtccaacgctatcccacgttgcgacaggcccaaccatccacctaaactatccaaattcaaaagattatactagggtgagactaatcacggtgaatctggttgaccgcccataaccgcgggcacggctattcgaatagttttactctgatcagaggtgtacaactgtacccacaagacatagccccacgacacgtttccgtgcgccgacatgtcaccacgacatttccaatataggatcaacatgttcaagtgacaagcatgacttgccttgctctgctgctggaggaacctcggcgactatttcgaagtacaccggagcgtcggaggaaccagaatctagcgacatacaaagcaaacattgcaaacaggctataagactactaaaacagggaacaaaaccatttttaatggattctacacatttttcttgatttactgagacttgaattggcttaaacggaactcggatgaattagttatgaattttagaagattcactgtgtttattactataacaaaaagtccttaaataatttattgcgcaataattcccagggctgacgtcatcaaggcggggcgcggcgccggcaaacgggccccaccggtcagtggctcgggagagggaggaaggggcggcctggctgggcctcggcctgcggccggcccagcagggaggagggggagaaaacggagagaatgggccggcggcccattcggaaggggaagggaaaaagaaaaagaaaaaaagaaaaggattttcctggaattaaaatattgcttgctcaattttaattggttaaaattatttctagggctctgaaaattccactaaaaatcctgttagtggatttcgacatgtagaactcaagaaaaaattccacatgccacttccgattattatttgcattgatttaaaagggtttactcttgctttgcactggtattttcttagggtcgcttataaattaaactttaggcttgggaggagaactttggggtgtgacaaacctatcccccttaaacggaatctcgaccccgagattcggaggagctggcgaagaggtgcggatgggcggctttcaactcatcttccctttcccaggttgcttcctcctctgaatggtgactccactgaactcggcaaaacctggtgaccttgtttctggttcttctttcgctggtatcaagtatacgaaccggcttctccacgtaggtcagatcctcctagagatcgatgtgctccgaaaaggcctgttcttcgggtacccttaagcacttctttaattgggacacgtggaacacgtcatggatgccgatcatattggatggaagttctagctgataagcaacttctccccttcgttccaagattttgtagggtcccacgaaacgtgctgccaacttgcctttggtttgaaaacggtgcactccccggagcggagtgacacgaagatacacgtaatcccctgcttcaaaagtgagctcccttcggcggttgtccgcgtagctcttctgtcgagactgggcaatcctcaacctttccctgataattctgactttctcttctgcttccgctaatacctctgtcccgaacagttgacgctcgcctgtctgatcccagaagagaggtgtgcggcacttccggccgtataatgcttcgaacggtgccatctgtagactggcctggtagctgttgttgtaagagaattccgcatatggcaagtttttgtcccaagctccaccaaaatcaagagcgcaagctctcaacatatcttccaagatttgattgactcgctcggtctgaccatcagtttgcgggtgataggccgtgctgaaatttaaacgggtccccaattcttcctgcagcttctgccaaaattttgaggtgaactgactccctcggtcagatacaatctttttgggtactccatgtagacacatgattctcgagaggtagagctctgccaaccttttgctcgtatacgtggtatgtactggtatgaagtgagcaaccttagtgagtcgatccacgactacccagattgaatcgtgacccgatgatgtccggggcaatcctgttataaagtccattccgatctcctcccatttccattccgggatttgaagaggttggagtaaacctgctggtctttggtgctctaccttcactcgttggcaaacatcgcagagtgcgacgaattcagctatttctctcctcatgctgacccaccaaaacttttctttgaggtcttaatacattttggtgctgcctggatgaatggagtactgggtctgatgagcctcggtgagtatcagatccttcagttccttgtcgtcaggtacacacaatctttctcccaaccagattgtgccgtgttcatcctcaaggaaatcccgagcctttccgactctcatgttctttttcagctctgctatttcggcatcattcacttgagcggctctaacttgatcgacgagcgtaggccgtgcttccagagcggctacgaacccgtgttcaacaattcccacgttgagacgctccaactcctgctgcaatttctcacacatgccctcgatgcatagggcagtgcagtaacttttcctgcttaatgcatctgccaccacattggctttacccgggtggtagtgaatgttcatgtcatagtctttgattagttccaaccatcttcgttgtcggagatttaggtccggttgggtgaagatgtatttcaaactcttatggtccgtatatacttcgcagcggttgccaatcagatagtgcctccagatcttcaaagcatgaaccactgctgccaattccaggtcatgggttggataattcccttcgtgtggacgcaactgccgcgaggcatacgcaaccactctgccctcttgcatcaggacacatccaagtccgtgacgggatgcatcgcaatagacttggaagtctttcatctggtcgggcagaatcaaaactggtgcggatactaatttcttcttgagctcctcaaaactcttatcgcactcagctgtccatttaaacttctcatctttcttaagcaactgagtcataggacgggcgatcctggagaagttttcaatgaatcggcggtaataacccgcaagtccaagaaaactccgaatctgcgacatggtcttaggtggggtccatttggtaactgactccacgttcgatggatcaactgccacaccctgagctgtaatgacatgccccagaaacttgacttccgtcaaccagaagtcacacttgctgaacttagcatatagctggtgctccttcaacttctcgagtaccagacggagatgttgctcatgttcttcttcggactttgaatagataagtatgtcgtcgatgaataccacaacaaacttgtccagaaattccatgaacactttgttcatcagattcatgaaaaatgcaggtgcgttggtaagtccgaaagacataaccgtgcactcatatagcccgtaccgagtggtgaaggccgtctttggaatatcctcttcccgaattctcaactggtggtagcctgatcgcaggtctatcttagaaaacactttagctcctttcagttgatcaaacaaatcatcgattcgcggcaaaggatatttgttcttgattgtgacttcgttgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctctgctagttcgttggccgccattctgtacggtctcttgtaaattggagcggttcccggtgccaagtcaatccggaattcaatctctctcttgggtggcatggtagtgaggtcttcggggaacacttctggatactcgcagactatggggatatcttccaatttcctcaaattcttttccacggtgaccactgggatttccgcttcaatctgattcaaggagaccccttgctttggtgagtctggtgatttgtacactactgtttctcccttctcgttggtcaaggtgactgtgcgattcgcacaatcaatgactcccttgaactgggttaaccaatccatcccaagaatgacatctaggtctttggatttgagaagaatgaggttggctagaaatggtgatctttggatttctattagcactgaagggctaaaactgactgaggttgaactatttcccggggcatgaaccctcattggtgtgctaagctcttctttccttaacccatgcatcccgacaaacttctttgaaatgaacaaatgcgttgcaccagaatcaaaaagtactgttgcagggattgagttaacaggaaacgtacccagtacaacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgctccagtctccttcttggcttgcgcggacaggcctgactgtgccggtgccgttggtgggcgtggagctgcaccgcggttgggctgacctccatggtggttctgactgccactggcgccctggggaaaattgctagggttgaacgggcggtactggcggacgatcatggtggtaggtccaccctgctgcccgggagcgaagcgcggcctctggtgacttccctgaggtgccctgaactgagcggccttcctcttcctgtccatcttgttgcgttgatcctcctgacggattgccttgtccaccagcctttcgaaattggcgtaatctccagatatcaactggttggttagctcatcatccagacctgctaggaatttttcctgcttctcggcgtcagtacggacatcctccggtgcatatcgcgcgaggcgattgaactcatggagatactccgtcacagtcatgttaccctgatggagtgctcggaattctctcttcttttgtgccacgaccccgtctggcacctacgccttcctgaagctacgacagaactctgcccaagtgacttcagtgcctggcgggcgggtggccatgtgattgtcccaccaagctgacgcaggaccttgaagctggtgtgtggcgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaacagctgatgctgctgttcagcgtgctgcagcatccgctggtgcatctgctggtgctgctgctgcatctgctgcatcatggctgccatcatctgagtctgatgtgccatcacttgggctagcgtcggattctcgggaagtggtggcggaccattgccggaattgctgttgggatgcacaccctcagtgcgctcttcgccgttgttgccctcgcctgttgcgcggctaccattcctggtgtagaccatcttgaggaagagcatacgggggaaaagaagaaaaacagatgctcaggaactaagctttattataaaggaatttaaactgcaattgttctgatctgaattaaaacacttaaaaagcaagcaaaaatccttattaagacagccatatcataggcacatgatatcgaccgtcgactgaccccaagcaagcaacctaaacacacaaactaacaagcagaagctagcaagtcgataaactaatggaaaacgggcctaatgctcggaacggctcctgcggtcggtggagtcgaaggcgtcctcctgctcgtcaccaggtccctctgagcgactcctggagcctggcagataagtctcgccgctgcccgactctgagccactggagctactgctgctgagatcgcggctgccactgggagtagcggacaaccaacctccgttgccactggctggacccctggcggctgatgctagagcgaaggagagagcggacgcgggagctgacacgtgaacgggagctggagctggtgctggagctgcaggaactgccggagctgcgggcggaactggaggtgcgggaactgcgggcggaggtgggttcctgggcgcaagctggatgcgcacgggtgcagtcgtcttcttgcggggcgtagtgcggatccggactcctcctggcgcgggaagaccctttaactgagcattctccctcttcaggcgcgctatcgcgtccttcagagcgacgatcctcatgagcttcccatcattcaaggccttggacgccttgtgcaggtccgagtgcatcctatccaatcccctcatcacagcacacatgtgaccaaaagtagtgtcgttctcgccggctgtcggacggaaagtactgacatcatcaccgctggctcgacgagggtgaaatcggtacgccgtgtcgtggaagatgtagttgtggcgctcccgtagtctggccatcatcaggtatgctgcctcctgacaggcgtgatctgctgtgcctccggatgcctcaaccaccatattagctaggcaggtacccacgtagccgtggacctccaggcgaacacggtgaggaagctcgccactgagcggtggaacagtcgtgtactctggcgcgttggggtagcccaccaccagcgtcatacgtgccaactctgccacaaagtcaatcatgccttctccgcggtggttgggtgggtggccggccatctagagaagacaaaggagtagggtcaatgcatgctcaaatccaaatttaaataaagcaataaaagactcaaataagagaatcgaataagagcgaaattttatgcatagatcattttgcatgagagcgaataaagaagacagactcacataatgataaaataaatgggaaattagatacatactaataataacaataagagcataaataccttgcaacccatgttcctgagctaggacctaatgcatttcacccatcaaatcccaactgactgacgaataaatctcaatagttttactaaaaccctagactgacttgttttgacaaatctcacttaaacgagcgaccaagatttttccccttgaaccacaagaacagatcccaattttcccagaacaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaattccccgtccaggaccggccggggtacacaaacgacaatgttgacattcaggtccacgtcttacaaacatcataaaagtcttacataaatgcagcggaaaaacggaagacaacaggagctaagccttgactagaactgcagcgggaacaccactccacaggcatcctcgacggcacggacgaagcctactcctcagagaaaccttcatctgacccatactcgtgctctggggttgggaaaaatagagcaagactgagtactacccactgtactcagcaagtcacaccggaataggggtatgatgtagggaattatcaaaggagagctagagtggttcatttgcataaagcgagcattaataaacagaagttgacagatttaaacagttgtaacaattaattactattaatcatccgctgtccaacgctatcccacgttgtgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgctaagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccaacagtctaaacattaataggattttccccattgtgcactagttgaactaagcatggctaagcaatccctagtccaatctctagtcatgttataacccccaagctgacaaagggacatggtacaacaatagcatggctatgacaattggtaaacaccccatagtaacattataaaaccatgcaatatttgaagaaaaacaatagagcatttgcaatataggttcaacatgttcaagtgacaagcatgacttgccttgctctgctgctggaggaacctcggcgactatttcgaagtacaccggagcgtcggaggaaccggaatctagcgacatacaaagcaaacattgcaacggcgcgggtcggcgtcgaccgaagcggcggcgcgacgcggctggagtcggcggcggcggcggagagaggtggttcgcgtggctacggcgctacggaggtggaggggggaaatggagcggtggccgagcttgcccggccggtggcaaagctggcggtggcggcggagcagtgtggcggcgaccctagtgacgggaaacggcggccggagttcgccgaagtgtggcggcgcgcgggagcggcgtggggagagcgagggagagagtgccgggttcgggaaacaaggggaaatggacgaggggagcacgggggtgctttttatgggctcgggaaggcgggatcgaggccggacgtggcggaatcggccggcgaagtggggcgccgacgtggggtggtggaggggttaaccggcgccgattttcgcggggagagtggggggaaaggtggaggaggtgaaggggatcgttttcacgcactcatggggcggggtggggcgcgggagccgcggcgtcgtggggcgaatccggcggccatggcggcggttggggcgacgggaggttggggaagaagatgacaggtggggcctcgggtcccacctgtcggggagagagagaggggaaaacgggcgagggaggtaaagcagacttgagggagagagagagccgagcgggccgagggagaaggccggcccgagagggagagaaaagggggattgggctgaaaggggcccaaagagaggaaggaggattttatttgtttttctttttttattttaattgatgtaatgatctttgtgctattaaaactatttctcgagctccgaaaattcacggaaaattccggagagtacattagggcacaaagaatattacaaaatattcccgaccaatgatttttaaaggaaaatttcaaattctcccattattttacttgattaaattgatttaacttttatttaatttctagaaaatgtattattaaatgattttaaaacccgaacgaaaatcggggcgttacagaacggtggtgctttatatagacccacgagggtcgatcgtggccaggagaccgcgatttcgttggcggagtggggagaggtggggaggagagagaggcgggattcaaaaattgaatcccggccgtctcgagcgcgggcgcgggcgggagagagggggagtgggcgcgggggacgcgggcgcgagggcgacgtggcccggaagtcacgggagcggggcgcggcggcggttgcggggcacggcggcgccggctggaggtgggagacgggcccgacaggtgggccccagggctcgggcggctggctgggccgtggccttcggccagcctagcggggagggggagagaagagagaatgggccggcggcccattcgaaagagaagaagggaaaaagaaaaaaaagaaggaaatgaattttcctgggattaaatattgcttgtgctcaattttaattggttaaaattatttctagagctctaaaaattccactaaaaatctatgaccagaccactaaaaattatttctcgtaagggtctggtcataaagatttgagagaacttttaaaattctgaccattaataatttctcaaatacttagttttaatacaaaggaaatcaaatttggcttgaaaagttctatatatcacgatatcatcaattcgttagatatatttcataaacttttctaaaacaaaattgttattcggaagggtcaattgcatatttgccactggattgaacaggtatcgtggatctgcaactaaaaaaactataattgtaaatttgccataaaaaacagtttgaacataatgtaactgacactgaactcaagcttagactaacaccgttatatggctggttttcatgaaaattaggacaagaatgcccttcctcaataaaacaccatttaaggcaacaagcaagaacatagtcaacaagcatcattttccttgtacagaatctagagtgagcgcagccaatttacaaatggtgttgatctgaggatgatattaatgaagacgaacttttcctgtataaaatctagagtgagcagccaattcacaaatgaaaagaaaaaaaaaggatgacaagtaccttttgctagctataggtcctccctgacatgtctttgcaaagtggccaccatagccaccatgccgcttgaagcagtcgacgctgacagccgtcgcagcggcgtgccgcggcctgacgccgcccgacggagacgcccactacagctgttgccccaggccgccgcaagtgctgcagtagacgtcgacacccgctgcagtcgcgcgctgcaaacctgacgccgcccgctgcagccatcgcccaaagccgccacttgccttgcctaatcgccgaaataaatctgcacctcttctattggcatctaatactctaaagtaacatattgttggttgatttgctcctgatttgaaagaaggatgagaggatctgaggtttagggtttgtcgtgggagaggagaggaggagttcgagtggatgtttctgatgtggtagacttcgggaagaacagggataaggttgaatctggcatgggcaacatggtattatcgcgttgcctttttttaaaattcaatttcatgaattttttttatctgtgaattggaacggcgatggcatacggaatctgcgcacactgttttcagtggtaaatttgtaattcgtgactttataatggttatttagagttaaggggtgaaagtagtggcaaatatgcaattctccctattcggaaacttataactttctatgaatcatgccatatatgtcaaatatctagataaacatataaaaatgcatcttgtttaatctagtaaacaaaaaacaaaatttacactgatttataccaaaattgcagtttttcgtattgtgcaagtttagcatattcattgttcaagtttagtcgattgatgggtaagaaaaaaaatcaagtgactgataaataccaacaatttctattgatacacactcgttgcccttgataaaataactcttgataatagaaacgtgtatacttatgtgtttgcatgtgttatctcctgtggggggataccactcagagtgacctcgagcttatcggcggcagctacgacaatgacggatgacctcgatcagtgacgagtgatcgaagccgatcagcggccgcatctactacggcggcggcatcctcatcagcgagtggcaacgactacaacattatcgactgcaacgagatgaactcggcgggcgtagatgacaagcacatctgtggcggcacgtgttggaattaatagataggccttagccaattcaaagattaattctttagaaaatcataaaagcccacttcataggatggtagacatggggactttagtaccactttatctatttcaggagatagatacctcattataaggtgggatgctctcctagccacttgaggcatatgacgtagagagaacaggggggcatagcccttttgcagttttgttttgctgcgggaaattcggatttgtttgttttggaaacactccgaataatccggtgcgtgaaacggcatggagtctggataagttacgcatgacttgtccggttctcggttttgtagctttgttttgctgtggaaaatttggatttgtttgttttggaaacactccgaataatccggtgcatgaaatggcatggagtccggataagttacgcgtgacttatccggttctcgattatgcggagcggagatcgtgcaggcgtcctgatcaagcatcctgatatctctatataagttgagtcgccacctccacgtaacatacgtaaaatcaatctagggtttgcctcctcctcctctgtactgcgccttcgcttgtagtctactccatcccactcgtcagcgtgcaccggtgatcgggagaataggtttccggaacattcgcctttaacgtcctgcagtgggagaaggcggcaaataaggtttttggaacgtcgcacgactgctccctgttcgaccacaacggctcgtcttcctcttcgctcgcgtgctgcgcatcgtcgtcaacccccgcaatcgcgagtacttcctgctgtgcaactggttttccggtaccctcggtacgtattcagcatgttgtgcatattcgatctgttcatattttattatcagtttacatgtgtagatcttatgatacatttatgttagtttacatatgcagtgtcaggatttatttatgaaataaattaaatcattatctgcttataaaccctcgccgtagatgatggagtggtcggcgagccaccgatcgaattcgtctacaagctcgggccttggccggcagcccagtgagctcatcaaccctatgcgaaggcacgacgagctcatcagccccatccaaaggcagtgctggcttagccacctctccacagttcatagaccggtgttgaatgcacgatttgcgccaaggctgtctaaccgggtgaaccagccatttggagttcattttttttaaaaaaaagaaaatgctgggacatttcattctcgaaggacaatttcatcaatgggaattgagcatctgaaattggttacttttgatattggtacggtaagaactgataatgatgggttgctatcatgtggtgttgatcttgtttaaattggggctgaaccaaatcaattcatgtgcaagctacaattcaccaaccgataaatatggttcacacaatcaatctctcatcttgtcatgtactttaagaataactagtaatcgtgcacatacaaggtacgttcttcacaatacatattctaagatagccatatgtcagcctcgatcctccttttttttttcaaagtccccgagtccctccaaattgctgaagccaaaagtccaatgcagtgcagatacaagttcagcccgccactttgttgcattctaactgcgatgcccatagcacctgattgttacaatagctggtgagaaaggaaaatgattgaggccgagtatagtttcaaactttttcttcaaactttcaacttttctatcacatcaaaactttcctacacacataaactttcaacttttccatcacaccgttccaatttcaaccaaacttccaattttggcgtgagctaaacacaccctgaattatacctcaccatcggcatctagctaaaaaatcacaatcaacaggtcgttattagtggatgacattcacgtttgcacaatttaatttctgaatttaaattattctccactggacatgaaaatgtccagactatatatcaaaaagtgccaacttaagttgtgatcactatttgctcctaaaatttgtgaaaatagaataattccaattataagatgtaaatgaataagtagagcatgctcacctttcctagaaaacaaagagcccatgcgatacctcaagccctcaacatgcagaagaaagaatagaaataacagtgaacggatcttctaacttttgtaaaaggatcttctaacttttgtaaaagggaaatgctattgtcttgcaaaaccaatgaacagtgtaaaatgttagcaaatattattaattcagtaagctgcaagctgaaccagaggaatggaatgtgctgatcataataccctgctttgcgctaaatctagtgtatccatagctttatgctgatgtaaagttaatctactgaatcattttatcaagcatttgttgaatacaataatcaagtggaacttcgctcctcattccaatgagcatggatatttatcagtggatgagactctactaatgtttatgcaatttaatttctaaagtttaattgcagctcataggttccctaaattcgtgcgtatttatagaatcaggttaggaagcaaactatagacataccttttgcttgctctaccacttcaaaattgtagtttcttttcctttcccacattacaaaccagatattacccaaaaaaaaaaagaaacccatgccaaaaaaaatacagggacattagttgagattaactgcataaaaaaatcaagattagaatataaaaaacattaagactattttaagtttcaccacgttgctcatggataccatgtttttatctacataaatctttgacaaagttgtaaaagtacgacatgtgtttttcagtaaccataaggtattacaaggtcatgtactaagacactgaataattctaggaaagccgaattatgtaaagatgaaagttaccccacacagccatctatttttattcaagaaacagtttcaatgtatcttcagcatttcagcaatcaacaaaggtccttgttggactcaaaatccttgtcatcagtcattagcgtaggcaaaaaatcttgatgaaaataatgccctgagatgctgagaaaaaaaaataaagttggctgttgcagatgtaatttcctaagaatcatatacatgttcatcaggtattttagttgatgcattgacacatggaacatctattactcaccaagatatatgcatatacggcctgaaaagtagtagagcaaaagattagtttaggattctcctaaatatatggtttttctcttcaagaagttgggtattctctagggatcaaagacaaatgttatatatttctcagtaactacttacaagaatagtaggatggcttcatagtgattagtggtaatcatctggattacaagcaaatttaaatcctccagtgatctcaaaacatcacattacctccaaacaacgaaaaataataatagaaccagccaaaattttcctcctataataggctttgatttgacaacttttgccgctgcaaaattaagtcatttggaagctgaaattatataagtctgctagattaaagattttccgtaaaacacgaatccttgttgtgtactttacgcaatccttgttgtaaaatgggatctaaaatctaagaaaccacctgagtgtgatgtgataatacctgaggtgcagtactcaacttctcatatgtaagcataattttatctgctcctaaccaagagatgagcagactaaaacaagataattatactgctgacaccagccacgctgtcggctgaacatgacatgaaatcagcattagtaaagttcggaagaaagaatggatgcaaatcaattgataggggctgcacagtttcaatagacatacctcaagtcctcaacatacagcgctggtatatattatctcgactcacttagccccaaaacatgcttcctcgtttaacctctcctatccttagctttggtaaattgaccatgttgttctagacaaatggccctccaataattgttttattccgtagcaattatggtactaaactatgtgccatgttagaagtctaaacctggacatcacatttgtctggtgacaatgtacttgaaattgtaaccttgaatgtttacttaaagaaaaatgaagttacatactgcgattttttttggcagagatagttgttttgctgcgaactttaggaccaagaataatatccatatccaatcaaagaatatattttttttgcctatcttgttgagcgacaaatcaacttcttctagattactaaaagcatgaacgcacctgatgtggattgagaagagacaagggcacaacaattgtgaagatatagaagaccatctgcgcgaaaaaacaaattggagcagcatcaccaattaaaacaacaagcatgactattagatcagcacacagccatggtacctgagctgcctcgtcctgctctccacctcggaaatccctattttgcgaacaaaagaacagaatgggagcacctcacgtcctcaccaacacggcatctctgaaattgtgcaaggaaactactgatgagagatcgattgttgcttcagatttaatttaatttggcacatgatccttctatggcagcgcttgccagtatttcctctcgagtagctcatgtgtttcgctcgtcagcatgtaattcaggtcatccaaccatatgatcatgcaattaaatcatgcagacatgaaacaatgcattatgaactaagggacataaagaaattcagtcttatgaaacaaagacattaatggtgatgtgaaacaacaaaaaccttgccttactcaagctctaagatggtctctgaagaaggcatcatcacctgcacgtagtatcttcaggatctcgattagggtctccgtgggctgaaattgaagctccctgggagagtaaataaataatttacttccatagtagtcacattttgaagatttcatttgcaacagcagcatcatacatttgcttccatagtaaataaataatttacagcaaccgttgttagaaattttattcaaaagttcacaaaagaagatcacctcaatgtaatgtaattatttgattgttcactaaattcaacaaaaaaggaaaatcatggtcacttgttttcagatcgtgttttcaatgttttcaactaccaaatgctacaggccaatgctcaaggaagaagattaaaatttccacacgtatggagaagattagggattagggaaagagacaggatttgagggacttacttgattacttgatgaggggccgatgcctgctccggtggcggctccaagtgagagtccgacggatctccggcagacttctggcagagctccggcgaggatgcggccaacgggacacgatgatttacatggaaaacctcattgatgtgaggagtaaaaaaccatgggactaacggtccactccaaacttccactataatcagcaaataggtacaaatggagtcttctctagaacatctagaggcacatcacaacatcagctataacatcaagttacacacttggtatcacaacatcaaccatcaaaactaacaagaggtatatcaataaacaattagagaaatagtatatttttgtcctctttggttctcagacgagatatcccaaaccatgtatgcaaattgtatgaggcagaaacgatggtctatgagtcccttccaagctgtccaaaaacagcccatttggacaccgtttgacccctcgaactgacattctactaaatgttgtacaaactgtaactgcagtaactcgacctgataaactactattcaaatctggtgctcttctcaaccaatcctcacataaactaactagattgaagtgctcaaagtgaggaaccaatccaaccacatatgaacctccaatcgctaatttaatgaagatcgggtaagagccaccaagcttaacaaactgcaaatcttcttctccactctcctctcatttctcttgtgtttttctagtttcttctcctcctcaatagccgctactctctactctttcaatggaggctcacatttgttggacttttgggttgcaatgggctgagagcaaaagctccatgtggagaaaaatttagcccaacagttcattcgtttgagagaggacgcatcaactagattattttttcccgtatggacgaaaatccgacggaatttatttcgttggtaattttggtaaccgaaaaatacggtttgcttgcttttagacactaaatttcgctgtaattttggtaaccgaaaaataaggtttgcttgcttttagacactacgtgatatctcatctcctcttggacactaaaatcgtaccattattcatgttctagttagcagcaaatcaacatgcttactcaatctggcactaattccgagattatggaaaaaaagttttatcctctgccagcaatcagcaattcaagaggttcatccttgctcaaatacaaggttcatcttgctcggttgcaccggtaaaggttgagcagttgcacgtgtaaaggattttggcctggtttagtccctaatttttttttaaaaacatcacatcaaatctttagacatatccatggagcattaaatatagattaaaaaaaacaaattgtacagttaaagggaaaatcgcgagatgaatcttttgagcctaattagtccatgattagacataaatgctatagtaacccgcatatattaatgacgaattaattatgctcaaaagattcatctcgtggtttacatagctataatgatcgaatatgctagtaagaaattaaagaggatggaggggatatcccaattaagctaacgctggattctactcccatactgacaggtggacccccacaggggctaatttggtaggcgtctacctaccattaacggcgggaagtcaaacctacgccatcacgtagctgaccgccccgaccacttgctcactgacaggtgggcccgggtgggtacaggattgcgcaaacacaccgggaaacagcacacccccgtgagggacaccgtgggcccaccctgtccctcccctgtctcgtgcgcgtctctcggcggtcaaagcgcacgtcagggcaacccaggcacacgacgagcgagctgtaccaatcctacccacccaatgacatgtggggccccagtaaaatcgttcccacatgtctgtgacgccacggaaaataaatcgaagcaacgcgcaccgacctgacgcgcgcaacatctctaacgccgctgacagatggaccccacgccgtctcgccgacccccctggccctctcatcccgtgggcccgcgaacagcacggccccacctgtcattggccgcgggtactcgaagagtcacgtagaaacgggacgagatgagcaaatgcagtgcacccacgagaaccccgccacgtatcactgatacgtgggcccagtaaccggatggccccacctgtcggcggtcagatccgcccgcgatacaaaagggccgcgccttcccatttccacggcccgaacagtctctctcttctctctctctctctcttctccccgagagctcgcgaggcgaagccgcggccaccggcgctcgcgcagcgcgcagatccgcgcagcccgcgcggccgttggcgagagcggctgtacggacgcggagagcctccccgcgcctcgcgcgctgagccggaggcgggcgccctctacccccacgcgcgcgcggagccgccccgattcggacaaatccggtggaaattcggcggcaatcgggggatttcggtcggtggtgagtggcggcgtggtgtggtggggtggggtggggtggggtgg

SEQ ID NO: 65884 - DNA, 20585 bp, Oryza sativa
tcaagatcaataatccattatacaacaaggagttacaaagtagtcaagaatacaatcacatagaaaatgtagctaactactcaccccattttcttttatatgacgttggttaatttaaaattaaataaacatagggagtaatttgaattcagagtcgttaaaacaattgaatgtactaagaatatttatagataaagaaagaagggaaatcgtctgtcataatataatttgtgcaattgtacaagctttgtcaatagtatggattagaatcttgaagataaaataaatttgtttccacatttgcctaaaagattttcttctaatcttgtgactattcgcttgattatcttcatctcaaaagttctgatatgctaacctactaaatgaaactctaatgaacataatatgtcattctccatatatttgttcctaacacaatatatacaattgttatacttagagactaaataaatttagaagcaatcatgtgtaagcaaacacaatgtgctaaggagtaagggctttaaattgaaaatcaatttattccatacattagcccaaacatctagtttcaaaacacctattccactagcaacacttcatctaacaaatctaacattcaaaaacatatggctccaccatttgagatctatgtatttgcaagcatttcataacatttgccataagaaagaattgcacaagaaagaatagacaagaatatttgaataaaagaccataaattctgcaatccacatggttggaaagatatttatattagcattagagtatgaacaaacttccatatattttatgatgaatataaccatagattgaacaccttatgatatgttgaaatagtccttgtagacaccaagaagtttatggtcataacaaccaaaacaaaatccatgaattaaaattagatcccattagatgcaccaagatactcaaacaagaatatttgttcaccctaggtacttgcaggagcaaagtccacaaaaaatagaaagatcagaaagaaatagaaacctatgagaggaatggatatccccttgttcttcttgaaatccttctgtcggtccgcctccttcgttgtctcctatggctgcaagatcatcatcttcttatagataaagccaggtgtgtgtggtattggttcatgcaatgtttatgacacaaaatgacaaaagaggttagcaacagatagatcatcccacatcagtttccttgagtcatctgggttgtaaaatcgtgtcttgggttgcatcattagctgccctttttttggttttagtgaaggacttcaaatacaaccctaacataattgttatttatatagtcattttaatacaccctccgtactcgtaaaggaagtcgtttaggacaatgtttaagtcaaaccatgggaatataaatcatgaataactctcaagttgttgagtttgaaaatgtaaaaattatatgaatagatttgtcttgaaaaatactttcataaaagtatacatatatcactttttaataaatatttttatagaaataagaagtcaaagttgtgttttggagaccgtgtcgctgtcctaaacgacttcctttacgagtacggagggagtatgacactatgtattacagtttttgcttcaggctttgggaatgggaatcattattgacatatgtgttttcttagaatggagtatgttattgtgttcagtgcattattaacaatggagtgccgtatgtgctcttttacaatgaacgagtacgtgtattattttttacaaggatgcacaatgattaaacaaagcctactatggctaaagatgctacaagaacttgagatcagtgatgatgtgtctatagtcaacttgtacattattgcatccgaacacttcccaatgttagtttaaatcagtgaaaatagagcaaaattgtgtatcccatgagttaacataaatagcgaagtgtcctaaccattgtgttgtgtggtgtgcatcttttccttcttgtgttgagcatattataattcatttttccctacgttcatgtctacaatgtttgaacatcgaaacattgagatttgtgctaacatgactctaaaaaataattggatgatctaataattatataagaaatgttcagtgtccttttcctaaagagaaaaggttgcagtagcaaccagcacatagagaaaaatccaaattcaaaacatgcaacagacatctacatttgtctagttgttcttattggaacgctccagctaatcggtcgagtggacatgcaacgtgtaaagttagtgtgtgaatcattttatttatttccttcttggttgtactaccttttctaccacacattgtaggggacgattgcacaagtcacgaatactcacattatagcttaggggacaactgcacaagtcacgaatgctcgtgcgagttagaaatatttcgttgatgcaagtgcctatccgaaaagtagatttcaagagataaaacaccatatctttaaaagcaagaatgacttcgtgatccaattaaagcagcatgttccatttgaccagatcaatagacgatgaacaactaacgaaatatattttttttgtttcatttggtcaatcacaaaaaaaaaatagtgatcatacttcaaaatattttattcaaatgttgttaataaactagtagaggttcatggagtgacgtcgcaaaataatttcattctacgcctaattgacatccatttcaaaaatatatggacaaatgtgccataggatttaatttcatctgtaactagcaatctgtaatatttttcatattgagccgatagaactttatgtaatgatatgacttgacagatcggactcgtaccagtggaacattgtgttgaaattataagcacgtaataatttaatatattcatgaacagatcaaatatacgcaacatgtcgaacatgtatcgaggttgcggaaagaccagttgctcagcaggaattactcgcggttgcaggcgtcgatgaaggcgcgcatcacgcaagcggagaggaagacgagccatcatggacgaacaaggagcagtcgcgcaaagcgcttcccaaaaaccttattgccgccttctcccagtgcaggacgtcgaaggtagaggttccggagacctactctcccgatcgccggtgcacgccggcgagcgggatggagtagtctacgaggtacggcgcagcatagagtaggaggcaaatgattgatttcgcgtgtgttgcgtgaaggcggcggctcggtttatgtagagataggtcgcttgatcagggcgtccgcacgatctccactccacgtaaccaaaccggataagtcgcgcataatttatccggacttcacgccattttcacgcaccggatttttcggaatgtttccaaaacgaaacaaaaccgaatttcccgcagcaaaacaaaactgcgaggcgagcacatgcatgtgttccccccacttctctccaccacacatgcttcaagtggctaggagggcatcctcccttttaaggaggtccccctctcctagaataagtaaggtggtactaaaatctccaagcatgccatctcatgaagtgggcttttgtgattttccaaataattaatcttcaaatgaggtaaggcccatctattaattccaacacattgttatattacaccaagcatagttgcattatcatctcaaaactccagctgttacaatcccatagttcgaaagttacaactaaaactttttaagaccatcatcagtacaaactttacaattctttagtaagatgagggatcgctttatctccaaagctcaataagtctaggaattttccggtatcattaatagaaaaatgatttttcacaacacctaggattgacttattttttcaagcggactataaaattcacgcttaaaaaacaactagaggcaccatagttctagccccgccagtggaaaaagaattttacaggcgacatcctatatgtaccgcttgtggtaacagcggaccaacgtgacacagttgataaccataaaatattctaaacccgatacgagccatccccctatcactcattcaattttatcctccccctttccctctcctcgccctatcggtggcgcggaagtaggactgtcaacgagccgagctcgaacgagctcgtctgcttaaagctcgagctcgagccaagcctataaaatattcgagctaagtaaaacaatatatatttcaaatataatctttaaaaaacaattaatttctagttcatcatattaatataagagaaaaaaagaataaaataaatatatgatgttaatataaggcatacaaataatatattttatcttctaatttattaaataacaacaaaaatcatatattactagactcgttggaagctcgagctcggctcgacaaagctcgcgagcttagggagaggctcgggctcggctcgtctagagctcgagacgagctcgaatcgagcctaggacgagccgagctcgagcagctcgcaagcctcgagcttttttgacagccctgcgcggaagcctatattggtgatgggggaggggcagtgatggctcggcgaaagagcgacggcaggcttgatggtgaccgtggcgagggcaggagctcgggaaggcaacagcaagggcgactgctcaggggctgcagatcggtggcacggccccagatccgcgggtggaccccgttgatttttatttttatccttgtcattgacatgtgggtcccacaagctgactcagttagttaacagggtcaaagatgccacgtgggacaatctgcctccaaaaccgctcggggagtcaatttgtaacagttttgggagttggagggtggttttacccggttttgcagttgggggatgcgattcagccagggtcaagagttgagggataacaaataaacttattccatccaaacagctaccgtgatcagattacgttggcccagtattaaaatttatatgggcttttcggggctgtaaatgaattaggcccaaaattagaattgacacaaaccggataagactcccatctcagcgtccgtgagctaagctacctactaatgccacgtggcggccgtcaagcgggcacctaatcctcatctcgtataaataaattcatttacccccctcgggatccgagaaatttccctcctctttccacttgtcaccgccgttcgccttcccaaccacgagacgaccctgccctcgccggagatgctgccgtcggcgaccggggacatcgccggcgacgtccactcggcgcgagagatgctccatcccatcctcctttgacttcttgccgccgcgggagcttgactggatctgagctagctggattggtgggtgggcgcgtcaagaaggggatgagctttggcgccgttgacgtcgacgatggcggcgccgcggcgacggcggcggcgagtgggggtgaggaggtgagagctatgccggccgaggtgagctgggagatgcttgacaagtcgcggttctttctgctcggcgccgcgctcttctccggcgtctcggcggcgctgtacccggcggtggtcctcaagacgcacctccaggtctcgccgccgcctgcggcggcggcgtctaccacggcggcggcgatcctccgccgtcacggtcctcggggattctaccgcggcttcggcgcgtccctcgccgggacggtgcccgcgcgcgccgtctacatggccgcgctcgaggccaccaagagcgccgtgggctccgccgcgtccgcctcggcgtcgcggagccggccgcgtccgccgcggcctcggccgcgggcggcgtgtccgccgccgtcgcggcgcaggtcgtgtggacccccgtcgacgtcgtcagccagcgcctgatggtccagaccgccgccgccggccccccgtaccgcggcggcgccgacgcgctccgcaggatcctccgcgccgacggcgtgcgcggcctgtaccgcggcttcggcgtctccgtcctcacctacgcgccctccagcgccgcgtggtgggcgtcctacgccacggcgcagcgcctcatctggcgcgccctcggccccgcccaccacgacagccgcgcgtccgtggtcgccgtgcagggcgccagcgccgcggcggcgggcggcgccgccgcgctggtgaccatgccgctcgacaccgtcaagacgcggctccaggtcatggacggcggcggcgcgtcgctggcgtccgaggcgcgcgcgctggtgcgggagggcgggtggggcgcctgctaccgcggcctggggccgaggtgggcgtccatgtcgctctccgcggccaccatggtcaccgcctacgagttcttgaagcggctctcgaccaaggacacctcactctgatagaggcatcgtagctgtaaccagagcaaaccagcttgtgatttgtaaactgatagtaaatcgtatgcacatgtacatatctaaagcatctgcgtttcacattgatctcctctacgacattaggatgcaaaggctagattttgttggatttttgaagctctctttgtaagttgtgacgatgatgatgaaaaagtttggtgaaacgaagaacatgtatatttgcatttgatcaaaatgttatttggtggtttatgtgattcaactggatgattgttgcatgaccaaatgctgctgtgtccatcactgttggggattgcaatgttacagttaggcgtcactactgggacagctgattgttgcaccttgagattttattttatttttttacgatgaaaaatttgatgaaacgaagaacatacatatttgcatctgataaaaaatgttgttggtggtttatgtgatacaactggaagattgtttgcatgatcaaatgctgctgtgtccatcactaattcactgttaggtcattcacaatgctcctatgtggcgttcggcctggacaaagaaaaccgaatattcggtggcacatcctcaaccagcggtgcaaagccaagaacgtgtagccaaactttgccaccctttctgtttttgggaccacactagtactccgtgccgccaagaaagagaaagggagagagatgtgtcgtcgtcgtcgtggtgctccacaccgccgagctcgtcacccaaggaaggaggacgatcgggcgccgtcctcgtcggagaagcttgtcggctcgatggggaaagcgacagagaaggagaggccacggccgaggtcgatcagtgaaaggggacggccgcggtggaggtcgatatggcccccggagctcgatccgccgctcgacccggctccacgaggaagtcgaggtccgcatcgaccgccgccgaggagctcaacgtgacggcagcccctcactctgttcttgtccgccgacaatgcccgacgccagatccggtgaggtcaaggtcgaggctgcgctcttggtcgatccgcggcaccggaggaggaggaggaggaggagtggtgtgctggcgagcgccaggccccaccgccgttgccgctccgcccgctcggctcgacgccgtctctagccggctctctgtggtggggattggggaaaactgggaaaggaagaggggagagagagagagggggaaggggaaaagtgaaaagtaaagtagtactggtgggacctactatgagtggtttgcgccgtggaactcacatgttcttagtctaagtggcatacgaggtacaccaaaactttgtaattgcaatgttacagttagacgtcactactggaaatttgggaactgaaagtgcattgtgtgtgccaaatttgtcacggtgttgcttgtaggagcaagacactgacgaaacagttgatatgtccgaaattctgggagtagaatcgttgctgccctgctggaaaggcagcttgagatattttccacatgatgaccgtaattttcgttgaaaccgaacacttctactactcctgaagtcctgatgtcttactaagtccgagtttagttccaaaatttttctttaaacttttaacttttccatcacatcaaaatttttctacacacacaaacttccaattttttcgtcacatcgttccaatttcaaccaaactttcaattttagcgtgaactaaacacaccctaaagacagcaattttttttttacactaggtaggcagagagaagaagatttgatcaggtatatatgactctgcaacttgactcaaaacagtattgtgataagataagccagctagctaccggttgaaattctaataactgagttaatcaaaccactaaacacagtatcgtcatcagaagataaggcgagaaagtaaaccctatcgctttcctgccgtgtgggcccataccgatgtgcagtctgaggcgtcgtccgagtcatcaattcatcgtatcccttccgggtttaggctggtggttggacgcatctcatcatctacttcgccgacctcgacctctcaacaatggcgatccgggaccggggagacagttggtgaacaccaacccctgccgttaccaaggcaacaaacttcgcattcctccattaatctcttcatcgatctagttcgttttgctttgtttgcggattcaaagaaaccggtcttattgctacgagtctacgactagttgaactagtgtgcataagttttttgacaatgaacaaatttgatgtttgctcgtagttggggagtaaggataagcttagctccctagataacttatttcaaattaattacagggcaaacttttgaaaaattggaaggtaaagattaaattatgtgatttaagtttcagaagcatcaatgttctttatcaaattattggaaactacagatttacaattttgtatataaaattgtagatttttcgcttaagtagccgcaaaactatgggttttttaatctccaccgtagccttaaacactatttgacaagtaggtcccacctgtaattctttaaaaaaaatgtaggattttattgcagtacatgtttttgcatgtgggatccattagtcaagtaaatctgcatgcgaaaatggagcctaaagtttgtagttttcaataacgtaagcgtataatttgtaattctcaatacaaactttaaattcgtagtatcaccatgatttatgtgaagtatatgtagctttccaaaaaaaaaaaaaaagcgccagccccgttctaggctttcccattcgtaatgttcattgcctgaaagattggtcttaggaggggacggtttgagcaaaaacaatttcttctttttttcagaagtaaaaagatatcggaacaaccaatttggagcgattcatctgggactttatccatcaaaacatacatatcatcatctactagtaggactcaaataaattgttaatcatatcaagaaaatgatgacacatttggcctgagatcccaatgcttcgtgcagctactatgcaggggtgccgtcgttggttccaatgcgctgccggctatgaacacagccggcaaaacagtttcacctcatccttctgggttttggcacacacgaaatgcaaagcttgtaaggtgagcgtaactcaattggttactccgtttatttatattcaagttttagatgtgatatggatatatccgtattgtattaactttttattagtggtagacaacttacctgtcggtaccgatgtgcctcaatcgtacttacagagatagtgggatagggtgctggttcatttaggtgagtgcttgagtgcttcgtctttgctgtctttcaaaaaaaagattatatatagattttttttcttattgaactcttactaacaacatttagattttttttataccttctgttaatttaaatcaaacggttgagctcattagtaagaaaatattagtacgtgatgaagtagtgccctttgaaaaataatgcaaagctctgtcatctaaaaacaaatgcaatgcgttgatctgcaggcaggaacggcccatcagaacaagcacttgggctacgggcttatggcccactttgcgatgaacctgttggcctgtaagctgggcccactcgtccacagataagcgcagcagcaaagccacccggacaggttggcgacgcgacggcgacggcggcggcggccatcgctggcgctggccgccgatccgatgcgatccggcacggaactcggcgagcacccgctgcttttggttggatcgatggatggatggatcggcgacgaggaaaggcgagcgcccaccccgcgcgcgggagttcccaaatattccccctcctcctcctttcttcttttgatccgccgtgatcggctatctcgggatcgccgccggcgctgccgccgtcgcgcttttccttccccccaatcgatcgatcgatcgatcaggcgtgtggattctccaagaaagagagagagagggagggagcgaaagaaaggcgaaaacgcgaggccgagtctttgttggctttcgtcttttgtcacattctcccctaacctttcgctttccggtctttcgagatgaaaacaaatttgaaattactacatccgtcccaaaataagtaacgtccgtcttattaaaaaattttatgaaaaattttaaaaaaagttagtcacacataaagtattattcatattttatcatctaatatcaataaaaatagtaatcataaaaaaaatttaaataaaataaatggttaaatgttgaacatgaatagtgtaaaactgcacttatattgggacgaagggagtactacgcaacggatgcagcccggccaggcagccagccatcgacctgtccattcgcagtcgcaggctcgcagcttaccattgcagtcactaaattcagtgttactactaccaactaattacctcctcttgtactaatccgctcttcgagttgacatgttttttttcataatgaaattcattctcacctttactaaaccaactacaatcaattattatagatttatagggtttgctccctcaaaaaaaatattataaaattaaaaactactcaaaatatcatttcggagacaaagatggataatttccaccaatagttggcgtcttggtgagacgtaaccattatttctttttagggcctattcggtttgaagaaatttcatggaatgtttgaacaaattaaactatatccttgtaaaaattatgtgaaattcctacatttcgacattttgaagaagcccttaatggcttacatgtagagcatccccaggagttacaccatctagtactccatctgaaatatggcgcatgtgagcaaaaaagggcctccaacagatatgtcatcgagccatccataaatagcgcatgccaaaatgaagatagaaatgccacatatagagcatctctctcatcgtatcatatcacaacagccacagatcccgccaccttctgaagttccgcgacctcccccccctccccctcatcggcggtcggaaggagagggaggaaaggggaggcaccgccacaccggtcaccgccaccgtctccgtctcctcctccgcgcctgccgcccgtcgcccctgcaaagaaaataatagagaatagtctgggtggaatagagaagagcctagaaaagctatagttgttcaacacatcaaattgataaaaatggttcactcatttcaaatatagcaattaaaaaatttcctattacaaatatacccatttcaaaagattatcacaataaataacaccgttaattttagtcgtcgaaaatatagcccgtaaaaaatataaatgtatgattatttggaagatattactaaaatatagaagtgtgtgacataaagaatgtatggatgaaccgttgaggtggaaagggatatgaaggagaaatcttttttggatggttattcatatggtaatgggtatatgaaggatcgaatttggatgagctgttggggatagtcttatatatagtttttgtctttatcaagcaggagcataatcttcgaattaaatccatagccgatcattataccgatcgaatttcacatatatcatcagccacaactgacgacgaacaaataggtagataatggcagagagtaactaggatgaaactggtacggatatttttttccattcagacattttttgggatcggataggtttggttggatattttcggatttgtcggagatacagacccggggtatgcgaagtgagaggaatttaccttcccatcctgccgcgtgaccctacagtctggccctacccccgcaccccgcagatcgcaggagcggctggggggcctcggggtgccacgtcatacccctcgggctctcgcaccgctttgccccgaggccctcgcccagccgccatctggcgggggagcaagcggggaggggggccaggctgaaccacctttaatgcgcgcagtgccccaactgccccctgccgcattcaacgcagtaggggcagacgtgcggcgtgctcgactggcacgcgacggtcaggaatgaccgatctgtgaccagcctgtcgccggtcacatctgactggatggacggtcgtgcccccacatcgtatctgcctccggcggagtggaggtaggtgtgacccgtcccatcggaggggtcattcgaagttctccccacgagagggcggccaccacaagtcttcacccattaattggggaatgacagggttgtcccccttgtcaggcgagggacggtgctgggccccactcaaggacaaactgtggcttagcttccaggcgaaggcacgggtcgagacccggtcaaggtagggtgggcccccatccgagagaagagtaggtagaggcggtacatgtggtattcccttgaggtataaaatgaggaccttgcccactaagaaaggggacgactctcataaaacctgagctctaggagaaaggaagcaagagcgctctccggatcttagggacctttgtaactctcagcctaaatcccatacacaggagtagggtattatgctttatagtggcccgaacctttataattttgttgtgtacacactagctagtagccttgggggcggatacgtgattttcagaggcgggccttttcccccggccaaactcacgaaagggggatcccacgatctcctgctagagaggatcactcctcgacaggattcgaaaacgaattcagatatttttttctcgaaaatagaaaccagtacagtataagggcactatccattagaatcggagaacggtcggaaactatctgggatttttttatgatttccgcaaacaatgattaatttttttaaaaaaaacacgtatttatacataaatttttcatacggagtcaaatgaaatttaactttatatcaaaattatagagctcgatgagatctataactgtgttgctaataattttattatttgagatcatttaaggctctaaatattcattataaaatatcatatatgtttttacaaaatttcatatctacaattcaagcaacatccgacggagatgcgtgctctatatcaaaattgtagaactcaatgggatctaccactatgtagtttatgacatttgtgtttgaaaatattaaaagtataaaacaaattttacaaaaattgaagatgtgaaataaaataaatagcatcttcaatctatacaacaagaacataatattccatccgtcctaaaatataagaacctaggaccggatgggacatttcctattactacgaatctgaacaggcagcctatccagattcatagtactaggaaatgtcccatcctatctaagcttcttatattttgggacggatggagtaagtgatatgttaagtaagctacctccgtcacatattacttgtcgctttgactttttgtttgcaacatttgactattcgttttatttaaaaaattagtgtaaatataaaaaatgataagttatacttaaagtacttttgataataaaacaagtcacaaacaaaataaatagtaattcatattttttctgaataagacgaatgatcaaacattacaaataaaaactcaaagcgacaaataatatgggacggatgtagtatacatgaagtaggcgatcttgggactagaaagtggataatcatatttacatacggatctcttagaaaacggccatgaaaattgatttttcacatacggttatgggatcgcctacaaaattgacaatataaattttagagatattgacctaaaataacaagcgatatctcttgcttgattaacgaagctcaatttgagaggcttttatatcccggcaaatatacgttactgtattcattctgtttcatattccctctgtatctatattcgttaatattcgattctattttcgtatccaagttttcgattttgaaaaaaaaaagaatacgatagaacagtttccgtccattttgtatctgttttcatccacaggagtaactcggcttcaaatagttacccgtccaaatcctgccactagctccaaaggcaacatcggaaacgcaaaggcaaccatatgtttcagatgttcttgtttttttttccttttctttttcccctcattcttaataaagagaaagaagagatcaaaagagccatgattcgcaggcaggcaacggcggcatcatttcgcttcgttcccaagctgtcagctgccacggcgcgtagcatggacatgccatgattcgtcgattccttcttcgccctgatgatgatgatgatttctcgtgcggaagcaccagcaagccaagcaagcaagcaagaagacagagcgtgtgcatcgcctgtcaaatctctccctctcaacccctccatcgcttttggctttccttcctttttagggaaagaaacgctaatggttttctccctgtggtgtctgctgataatcctgctaggcgatgcgtcagcttttcgctttgtggtacggttgcttgccaatgtggttgagtttttgtgttaaaatttcatattactatctctatcccaaaatatattccatccgttctaaaatatagcatatattcgagatttatttttaaaatataataaatctcaaccaacaatctcttcccaatatcttcacttctaaatcaattacaaccttctcctatttaattctacatactttcttaatactatgcacgaccctagaaatgcttatagtctaggataagtagtaaggataagtagtaagaatttctagagtcagtcacagttattaagaaagtatgcataatttaacgggcaaaggttgtgattgcctgaaaagtaaaggtcggtgaggaaattgaatggtggagaattgtgattggttaggtagataatgttggtggaaaagttgttatttttaaggcaaattctgaacctaaaagttgttatatttaagaacgtagggagtaccagatacaacaatgttgaagtttgaagatcggtgtagttttatgagaaagaaacttacattagtcgtaagtttttttccccttatggtcttgattgctccaagattcatacatcttcggatagcatcatctcaagttctcaacaacaaggcctcctttgaaatggaaaattttcataaaaagattgagaaaaaaagttaatcaattcctatgaaaatttagaaaaactaaatgtttcgaaggattcctgagatgggaaactccttcctttatcgaatagatgtattgtgtgactaaaaacaaccaacacattactaaagaaatctatacaaaagaatgacccacaattattttacaaatggatttagtgagatcatgcaggtggactttgaaaagaaatttagtgagattagtgatatgtccactgattttcttctcttagagtgtggtgttttatgtgtagtgtgtgcacgcaaatgtgtatatgtcgtgtaaacgttaaaagaaatgcattggcatgcttataaaaagacctacaaattgattgtgttaacacagagtacaaagtaccaattatatagctacaattacatgtacacacctcctcaaaaccttggaaaagggaatgaaaaggaacaccatagtactattactatcggactatttttacagtgagccccctcagcttctaccaaattactagacagccctactccagctccgacaaggagcatggccgtacggacggcggcggccaatgtcgcggcggatcccaactccggtggtcccgtacaccggcagctcgtccccgtaggagccgtcgcgaccacccgccggagcaatggccgcgaggctgtcgagctcgaacaggtccgagctcgcgtcgctgctctcctcacctccgtcgtcggtgtcggcctccacctccatgaccggaattcggcggcagccggcgacggccgcggccaccgcgaccttgccgtcgatgtccaggaaccggacggtcctgctccggctcggccgcgccctcgccgtggtggtggtggtggggggggtgcgcggcgtcttggcgtggcaggggcggcgcgcgtacgacgacgacgacgacggtggcgccgtcgagcacgcgggctccgggtagtccggcgaacacgccgggcgctgcgcggatggacgcttgccggagaagatggagttgagcaagctggcgagccgcgcgccgggcgacgccggcctgcggcacgcgcgggccgaggcggagcccggcttcgtcttcgccgtcttctccacatccggctgctcatgccgctgcttccgcgcgaccgccgcgccgtctcccgcgccaccggcggcggaggtgcggatggggcggagccggcgaagcgagtactccacctcggacgacgagaagtagcccctcccggggcaatccgccgtggaacccagcgccggcgccgccctgtagctggcggccagcgacggcttgtagcagtagtagtagtggtagctgttcgccgcctcctgcctcttcttggccgccgcactcgccgcgtttcttgtccggccgtcctcgccgccctcgtccatggagtcgcagatggcgtcgagcagcgtcgacgagaacgacggctggtcaggcgcccgccgcctcgccctccccctccccctcgccgccggcgccggcgccgcccacctcatctccatgtcgcgcatggcgcagaaacagagcagaacgcaatggcgatggcgatggcaatggcaatggcgcgcgtgattcgattcgatggtggagtggagtggagtggagagtggagtggcgggcgggcgtgcgggggtgggaggggggatcttgttgccggggggcggggggcggggcccgcgccatctcggtgtcgcgcgcgcgatcgctgtctgtccgttcttccgttccacgcctcgtgctccttccatctctccacctcgccgtctcactctcactcactcggcggccgctttatttgttagctttttgctttgtcggcgccggcacgaggatggccgtacctgtgtcccctgccgctctcacgtctcactgttgctgcttacttgcctcgccgtttttagtttttaccgccatgggcgccggcgggatgatcatgggctgctgcctaacgggttgggctgtttcggacgtgggtgatgttgggttggggctttgttctttgtgtttaggaaaaagtacaccgaagttccctcaacttgtcaccgagataaaaaaacgtcctcgaactgcaaaaccagatatcgagggtcccttaacttactaaaaccggtcgcaagtggtcccaaggcagtatttcacatggttttatcctacgtggcgctggttttgtccaccgtggcgctttgaccttggtcttcgttgctgagtcaccagcgccacgcgaagctggtgggacggagtggggcagcgatgagcggacgcgtgggcagagtggcggcacccgaagccggcggggcggtgaaaccaagcggaggacgccagcctcatcgtcgtcatctttcggcttagggaggaggcgcgggagctggagcctgaggaggggctccgctagaagccgctgctgtagaaccgggagcgcatcatctcgagctccagctccgacgccgcctcggccgcgtcagtttcgccgcgcccccactccgccgccgacgccaccttgtcgtccatcatatcgaacgttgacgcggccgcgatcatcgccttggcgctccccgacagcgactcgtctggggcggccctcctgcagccccaccgccccctgcggcggcctcggctcttgcgccgccgcttcatgacccgccgcatgacaccagcggggagcctgacgatgacgagcagcaggatcgccgctcccttcctcctcctcctcctcctcttctctctctctcttgtctgggcagggcggccagcagcggtccacttcgtcctcgacctcgccggcggcggtgagctgttctccttgccagcggtggcaggggcaggagcgagagatgacgagctcgaggaggatggagaaggcagtggagcggcaccgcccgggccgctgcttcccccgccgccggcgcccgcccgcgcgccgctcctccccccgccgcttgcacccgccgaccgtcccccgtgcagctgcttcccccgcctgcgcacgccagcaaccacctccgcctccggcactgaagccgccattgtcgtcgtctacttgtcttcatccacccccaaaccgtcgtcgcgcctagacgtgcgccgccgtgtagccacccctttcccctcgggcgctgatcgccgcgccgcgccgatgcgcccgaccatcgcccaagcggagccgacgccgccgcttgcgccccctccaattggccccctgaccttctccttccggcaccactcccttccctccctccctcctctgcccggcgccgccctgattcctcccctctgcgccgcctcccggtcgccctaccaagacgccgcgccgcgcaacctttctcctcctgcgcgcggctcctgcacgcaaccgcgccgccaccaggctctctctccctgccgccaagctctcccccttccgccggccccctcttccccaccgccgccggccatcacctgcgtcgtcggcgcccatcctttgctgcgcgcgcgtgacggcgtgcgtgaggagggaaaaaaggcagagagagaaagagaacggcgaagagaagaaaccgtgagaaagagacaaaattaaaagagaaagaaaagaaaaaggaagtgggaccccctgactcctcctccccgtgaagccataaagggagagagatgtgacgtggcaacctgacacgtggggcccacgctaactcagctgcgacgtagcataaaaccgggctcaaaaccaccgaatgacctattgtgaccggttttggtaagttaagggaccctcgatatctggttttgcggttcgaggacgtttttttatctcggtgacaagttgagggaccttctgtgtactttttccttgtgtttatttgtgggtcataatggctcagtaatgtccaatacgagttgtttgcaaatggaataagtttgatttaggtccatgatattgacgtcgggtttgaattacatccttcaacaaaaataccagatataacgtggctctcaacttgtaaaaccggtgtacctcgaggtcccaaagtagtatagtgcccggttttaactgacgtggcaagttgactccaatcaaacctggttgagttggcatggcccccacatgtcaccaagcctcctctattcctcctctctccccctctcccccactctcctctcttcccccatctctctaccagctaggaggcctacagtgggtgccgcccaactagaagaggagcaacggccatggcggagcttgtcaacgagacgcaacatctccatctccttattgaactcctcctacacaatatcggtcttccgccacccttctactccgttgcggccgctatccctctcctcgtcgggttggatgtactccaaacttgccgaactacaggaaccattcagagacttcctcatgtgtacacgggtgagcatgtccgggtaggaatacaacgcagacataggccaacaaagggaggatatggacatgtcctgtgtcacgaagaggaatcccccaagctcctcatcttcggtgtgcgctttgctcgcccgcgtgcactcgtcgagcatgcacactagcatgtttggtggtgagcgacggctcaccctccctcgggaccctcgctgaggccgccgatgccgaagcagacaacaacacccctcacgtgcctctgtcaccgacatcttcatcgccacctcgctgctaagcacatctgcctctaatgattgcatcgtttcgctggtgccgcttccctagctcccgccatagggctggattcggtgctccgaggaagctcgacttgcaccttggaggctaattagccatcgctaccaccacctagtggtcggcgggcatggaggtgcccctgtacacctctgcatccacactcaccaccgcggccatgctcccactggtggagaaaccgtctttggtcggtcgcccgaaatccacaatagtctcggttccactaaaaaccgggactaaaaatgatctttagtcccggttggtggctacagcgggtatatttgatctttagtc

SEQ ID NO: 65885 - DNA, 4278 bp, Oryza sativa
gctgtacgtaacgtgtcacacatccatgcgtcatgcatgcatgtcgtacatggcgaacgtgtttgtgctgcatgagcatatgtgcagcgtgtccgaaggagttgcaggtggacggcggcggcgggacggtggcgtgccggagtgcgtgcgaggcgttcggggaggaggagtactgctgcagcggcgcgtatgcgacgccggcgacgtgccggccgacggcgtactcggccatcttcaacgagctacgcctacgacgacggcatgagcaccttcacctgcaacgccgccgcctacaccatcgcctacacgagcaccttcacctgcaacgccgccgcctacaccatcgcctacaaaacagcgtcaccggcggcatggcgcccgtgccgccgcactccaagtggccgatgcagtcgccggtctggcgcttgtttcatcagcatggagacagagacaaccatatacaaatggatgaccaccactcagcactcagcaggaccagcgcgagtacagaacgaacagcaaaatactccgtactagtagtatattacatctacagtaatcgaagtgcggcttgcgagccacgaatcacgaacagatgcaggacgctactatctcaagcatcgatcacaaaaggagcaagcgggacatttgatttctccgaagctgcacagatgctgcaaataaatcgagggcttcgaaacccgacaccccggaggagtctatcgatgccttccttccgcgatgcagaaaagaacaggcagtgcagagtgcgggttacctgctggggcgcattgtggtcgggcggggcacagaagacgtcggcgtcgagcggcatgtcgacggcggagccgagctggcgccggtactcgctggtctccccggcgaagcacgcggtcgcgccaccaccgccgaccagcctgcccagggagatgagagagagagaggggaagggagaggagggaaagagaacatgatgacgtggcgtgctgatatgtgaggcccacgctaactcacccgccacgtcagacaaaaccgagttcaaaaccatcgaaggatgtaaagtgaactgttttgtaagttaagggatgttatatatctagttttgcggttgacggacgattttgtaattcgatgacaagttgagggaccttcggtgtactttttcctttcgacataccaacgttcggcccgagcccaataaagactaaaccctggttcctccctactagtactacggtctcaccggatgtgagaacaagacaaggggcatagtgccgccgatgccgatgcctcctaacacaactgtctccctgctcgacgcttgctccaggcgcctcccgcccagcggcctaggcccggccggttgccgccgcgcttccaacaacctgccaatccacaaggcgcctgccgcccctacccggcaaccccgacttgctggtaggcggcgatgccttatcagctcaactccttggctcgccggtgccgtcacaacattaagcaaggaggcagaaggccaggagcagccggcccgagcatatcaagaccagcccctttaggaccttgatcaacgaccagagatcactgagtttttcggtatctcttattattctcaaagagcaattttacgggacttgaggagatatcatgaggtactatttttttctattgtaaatttggtacctcttgatatttaggtattatgaggtaccaaattttacactaagttttggtacctcatggtatttcctcaaggaccgtagaattactctaaaaaaattgagtaattcattttggtatataagtgtattttgtaggttagttacttacacccttacctctcgttagtggtattttaaattcttcttccgaaattttcttaactaccatatgtactaattcatgtctttgatatgcatttttttttctctctataggatcaagatccataactacaattgaagagctaaggacagtataatattatgcttagaggaagctaacctataacaaggtatttgtatttatgtaacaaaccacaattaaatttgtattgtatctttttatcatgcattaaggaatatcctgtgtcgctgctactactcccttcattttatagtgtagggcacaactattttttttataatgtttcataatacaatacgtgtatgcttataagcaacttattgggttgatccaaacaaggaaatgattatatttttttcttaatctatacgttaatagtagttgcataaaatattttacaatggagggaatattaattatctacttcagtactgattgtgttactactcccatttcaattactgttctgccattatataatttacccttttttgttttggtgctaacaatgaatcagtgttgtgatttctgaattcagtggtgcgctctgagatttgataagtccagaagcagcatcagatctaccctgtttttgcttgcttgttttatcagccaagtgcgtttctggaagatagggttcttctttccggtggattgatcgttgtttgggggcaattctctatttgccattgctaatctttcatgatgattgttgatcacttctggattttagtattttgcggttaataatttaatactataccccctctggttctatattaattaacgttttggacaatgttgaggttaaacttttataactttgaccatcaataacttaaaaaatatttagtttaaagaaactagaaaaacatatatagatttatctttcaaaacactataataaaagtaaaacatgcattatttattgtatatattataatagaaaaataaggtcaaaggtatattttgtagagcgtgtcattgtccaaagcgtcaattaaaatgaaaccggagggagtatatagtttatctcatccatttctgcgtgttcaagtagacaatgtagtgttcttgcgtgcgacaatgaccaatgaccagctagatagggttacccatcgatttgatcttgtttagattagtgctgaaattgtgaagtccaaatggcaatttggacattgaagaagaattgacccttatgcagctgaatggacggaacccattaatgtattccatggatgggggctgttcgatcaggcatttatacaaaatttgactgggcaaacggaagtcaaccaatagaaacgtgacagcggtggcaaataaaaaagggacattgacatttgtacgatgatgtcttctagaaggaaaaaaaatgtctcaattatcttcataaactattatagtccaaattatctcctcaatcaaaacaacttcatattttttttcatttgactcttcaaatcagacgaataaacctcgtatcctaatacaaccagttttgatagggcgtgccatataatggggcaataaaatctagttttcatcctacattgcaacagtgctcacgtgacatcctctatctttccatccacatcttctccatgtgctgcatcatactatccacattcgcatctccatatccgtcggatttctaaaagcacgtaccatatcctcgtttcggacagatttggattggatattatcttattcgttttcacccctacccccccccccccccaaaaaaaaaaatcttcctccatttttaaaaatagttgacagtggtattttttattttcaaactttgatctctcattttctataaaagaattacaaataaaaattatatagtataatcaatgtattgtactatagtgatatacttttgttcgtcatattctaaccatttagagcatgtttggtacagctccaactcctaaatttagcttcaggagttgggtctggagtagagttgtggagctgcctaaacccagctccacaactatagttcattttgtgagagagttccacccagctccactcccagttttagtggagttgaaactgtttggttagaactgtgccaaacaggcccttaggagtatttttgataactcaaaaactttatttccgtttcagaaacatagaactactacattatttaccgtacagttggttgcactaaaatggtctttcaaagctctagcgtaacaacaattgctaggattttttttgacagttataaactggagaacttagttgctgcattctagcatcttttactagtttatcggctatcgattaacttctcctatgatccacgtaacctgcatcatggtctgaggaatatttgcttgcattcgactaatcaaaggttggcctggtttttcctcaaagttttttctcctttatagt

SEQ ID NO: 65886 - DNA, 13478 bp, Oryza sativa
aaaaactgcgaaaatatcaaagcacacgataatcaaatatagttgcgctcaaacttcaatataccgccgcctgtgcctgtgcctgcctcatcttctcgagctcgaccagcctgccgatgtccggcatggcctccttggcggcgtcgagctcgtcgaagcgctccaaccacgccgccaggagcggcgtcttggcggcgtcgaactggttcaagccgaacacctcttcgatggcgtgcacccacgcgacgaagcctccgagcacgacgtcgacgtagccgacggtgtcgccgccgaagaagggcttccccttgcagcactcgctcagtgctccctccagtttctccgccaccgcgaacgtttgcttcaccccctccgccttctcctcctccgtcttgcctctgaacaccggaatccacgcaccgaacagctgcaaacgcacagaacacgtatacaccaatcaatcacacaaatgccaagagaaaatcaagtactccctctgtattttaatgtatggcgctgttgactttttaacaaacgtttgacttttcgtcttattcaaaaaacttatgtaattatcatttattttattgtgacttgatttatcattaaatgttctttaagcgtgacataagtattttttatttgcataaaaaatttgaataaaacgaatggtcaaacattggttaaaatgtcaacggcgtcatacattaaaatacgaagggagtaataatcaacagaagagtactctactagtacatgatcatcgtaacaaccttttcgtcgatgtaggaggcccagaagcgagcgacggcgcgatcgtgggggtcggcggggaggagggtgacgccggcgtcggggaacacctcgtcgatgtactgtacgatgacctgcgactcgcagatgggcttgccgttgtggatgagcacgggaaccttcttgtgcaccgggttggagctgaggagcagctcgctcttgttcttgaagtcctcctcgacgtagtcgtagctcaggcccttgaagctgagcgcgagcttcgctcgcagcgcgaacgggctcgcccacatccccagcagcttcagctcatctcctcctccggccatggcgatcgagtgttctacgcacgtttcgaagattggagcttttggcttctcttctgctcgatcggctcgctctctttgggaagaagtatcgaggacgcagtcacacggtatatatatatagtcggtgcctcggcctgcagtgtttttcgtgcatgtcacctaaatagtcataaaaatatgaaaaaaattagcaacatagattaatttgaaatatatcactccacaaacatacaagtttaaactgaacttctacaagttgtaacaaaaataacaaatatagttgcgaatgtgccataactattttcagtttaatttattatttttgttgcaacttataggagttgaatttggtcttgcatgtttgtggagtgatatatttcgtattaatttatgttgtcaatttttttcaatttttttgataactatttagatgacatgcaaacaacaaggggatgtcccctcgagggatgaaaatccacatccgtgttttttcagataaaacagagtaaagcagagagtatatcatcctgtgcttgcgtagtcctacttggctcagctgctggtaaaacattttgcgtcgatgatctgatcagtgacgcgtaccttgtgccttcttttctcccaaaagaaagtagaagctagcaacacgtgctaatgacccagcaaagatatttctctgggttcaccggcattgatgtggtttttcggaacgtccaaccttcgctgggttcagctttgagaaaatgccaagacgagatcaagttttgggctgtgcgtttcaacgctgaagacagggtcataatcccggtctggaaacatgtaatttcttcctccctacaatcacttgatctgttgtaacctctacgctttgtcttcccaaactgttggttttgggacttgtctaaaaaaacacgtgctaatgacgggcacctactgcgttccttgaatccttcgctccaaactgagccagattttcagcgcatgtcaaaacagaaagctgattagcacacaactaattaagtattaactattttaaacttgaaaaaaatatatttatttgattttcttaacaacttctgtatagaaaacttttgaaataaatacaccatttaataagttaaaaaaatacgctaacgaaaaatgagcaagttaaagtttagaattgaattaaagaatcaggctttaaatttatttcatcaccaagtcaaactcaaaaatattacctccgttctaaaatgtattggattaacatcaccaacaactatgaacctgaactagatttgacgtaacctagcactacgaagctgaacatgttgtttagattcgcagatgatgtcaaatctaatcctacatagctacttcctccgtccaaaatattgtgacctaagatcgggccgtcatacagcgatcaatctgtccgtctgccataccactggcgagtctgtccatccgccccattgccggtgtcgctactcagtgctgccattaccatgctggtgtccgagtccgtgccattggggatcgaagagcagaggaagagggtgcaggcacgggcatttaccaggaggagaggaaaaggataaggagcacacaagcgcgcgcgtgtgccatcggggtatagcgcacgctgcaggagaaacctgtctggagaccgcggccattgcctggacgacgaggagcagcgtcagtgctgcctctcgttcatctccggcctcacctaataatgatggagaaggtggccagcggcgcggacatagcaatcgcttgagggtgtgaaatagtggccatggagattgtgttccatcgctacaaccacagaaaatccccttcacatgacgaaagagaacacatcaagagacacatcagcccactgctagactgctaattaaccagtccgctccaagcgtgacaaacaccaagataaaccatagtgccatactatgacgcacgcaacgacgtacgtcaaagcagctttcaatagtacaacctccgcctcattataagtacaatcataggttttcacgtcaaattttaatcgtttgtcttatttgaaaaatctttataattagtatttttattgttatgagatgataaaatataaatagtattttactcgtgacttatgtttttaaatttttttaaaaaaaattttcaaataagacggacggttaaagttaggcgcgaaaaaccataactgcacttataatggaacggaggtagtaagaaaaaagcggtccatataaactaaactagtgcacaactacacatcagcttcagtctgctcactgaactcgagtaaaccagcagcttctgtttcttggccacatcgagtaaaaatgtcctcgtcgtcgacgagcggttcagccgagcccgcggcggcggtgcgcgtgctcggcagttggacgagcccgttcgtgatgcgcgtcgtggtagcgctgaagctgaagggcgtggaggagtacgagctgttgcaggagacgagggggaagaagagcgagctgctgctccggtccaacccggtccacaagaagatccccgtgctgctccaccacggcaagcccctcgccgagtctctcatcatcgtcgagtacatcgacgaggtctggccggcctccgatggcgccccggccatactgccccgtgacccatactgccgcgccgtcgagcggttctgggcacagtacatcgacgacaaggtaagggcatgtcttgcgtaatttttttttgtctctgaacattttcttctttttaatcctttttagccggatgattttgctcttgctttgatgatatttttgcagattctaccagggcttcgggttttgagaggatcggtggccggagacaaggaccaaaccgcaggtgaaatgtccacgactctacagcgtctggaggaagcatttgtcaagtgcagccaagggaaggaatacttcggcggcgacagcatcggctacctggatatcgctctgggttcgttcctcggatggatcaaggcggtggagaagatcgccggcgtcgagctcctcaacgaaaccaagcttccgatcctggctgtttgggcggatcgcttctgcgcgcacccagccgtggtggacgtcgtgcctgacgctgataaattggttgagttcaccgttcaatatggttctgtgctgaatactgtgaatgttcttcccaagtgatggatggtatgctgctttgtgcctgacgataaattggtttgagttcaccgtgcaacgtgcttcgtgttgccatttagtatggtcactagtgaaagatgatggtcatttacgttgttttgtttcgtttcttcggaactgtagtttccctttccgtctgagtctgtaattttgcttgtaagacttctctctgagtcttttattactacttctctcagtcttttattactactactactactgatgatgatgatgatattctaatgaccatcagccattcgctaccgtatttagtgtcagatggggataggctagctaccagctagcgacgcgtaaagatgaaggttgcacgggagaacggggtcatcgtcagagttggtttgaagtttagataagataaagagatcaaattagagatttattaaagtttgttactagctagatgcagtatataatctgagacttgcgggattgtttttcacgttaactaagatgttaaccagccgaaaacaattgtcaccagcccatagcattatgtaactctggttttatccatatattaggctcaaagtcttaacagatcaccaacccaggtacgagtgctccaaaaggctccaaagttctcaccgccctgcgaatttttattgatttttaagccattttttttaaaaaaatttatttttaaatctgaacctcttagctgcgccatatgcagtggatgtgctagtattgtcttgtcacgtcagtctaaataacgtggctaacaatttcacttttgaaaataagttctttttgagaaaaataaaaaacgccctgcaacacaagagatctggacagacgaggcatcccggcgtcatgtgcagccaagggaagcgatactttggcggcggcgacatcggcttcctgaacgccgttctgtggtctcacattggtcattggccgttcaaggagtcgatcggagaagatccccggcgtcaacggcctcgacgaagccaagttggccctgtagctgacccatgctgtgagcagcgtcatgcctgacgcggacaggctcgtgtcgagttcagtctccattgctaccattgaaggattccaacttccaagtgatcgaaacatcacaaaatcatatcttgtcgctttctcaatcaacaatttgcgttaactttagacgagtaacagcttgtgaaatgtagtaatatgcttttgttatgaaacaaagttgcctccgcatccgcagcctgtagggaccgtctgactatggtagtgcagtgtagggctggagccgcccacatgtggtggaatgcaattatgcaaatgggaaaaagccgcgaattttggctagaatttctcaaaggcatttcaaactacaaatctacagtggtctcagactagccgccgccctaccagaagttgcaaattcatcgtaggcttcttgaatttcaggtgcaccgtgcacgtactcgtaaatcattgccggcggaaactttattagtggagttatagtccaacactcaaacgatcaccaatggtgtgtgattattcaatccattgttttttactttgcgttcacaaccatttttcagtaactcgccaaaaccattttctttctggaactccagttcaaaacagtttttgtttcgactttccaggaggctgaaaaccatatttgtagctcttcacgcgggtataaatagacgcctacattatcactaagcaagatatataagcctataaggcctgcatctgtggtgtgcatgcagcagcaagcatatcgcgcacacgacgagcttccatatatgggaatggacggcgattcttcatactcaccggcattggccgccgtcgccggcgccgtcgcgctggtggcgttctgctcctactacctggccgtcacccgcgccaccggcgacggcgaggcgaggcggcggcggcggcggcacccgccggtggtcggcacggtgttccaccagctgtaccacgtccggcggctgcacgactactacacggcgctgtgccgggagcacacgacattccgactgctcgcgacgcccggccgccggaacatatacacgtgcgatccggccgtcgtcgagcacatcctccggaccaacttccccagctacggaaaggtaagctgagtaaccgggcctcgcatgaatcgcgcacccattccggcccaactacttatgggccgcacgtgagttaaaagcctgttagggcccaattgtattgcgctcatcttacgaatttttttatttatacatttttttattaaaatatttacaaaaatatttttttgtttcaaaaatttacaaatctaatcgcctgccgccctttgggagatcgcccttccagagggcagcaagggacctaaatgcaaattttccagcacaacttgttagctctatgattttacaatttaaaattatattatataaagttagatgaaataaaactttatatcaaaattgtagatctccaggagatctgcaactttgtagttaacaactttttcatttaagatgttttacatatccaaatattcgttacaaaatataaaacacatttaaaaaaatctcatatctacatttcaaacgacattggatggagataaactttatataaaagttgtagatcttgatgagatctataactttgtagtttatcactttttcatttaaaatcatttggagtatcgaataagcattattagtttttaagcaattaaaaccggtggaaagggtttgaacacaaataaaaattttgtatttaggtcccttgccgctctctgggagggagatttttgaaaatatcccttcctaagggcggcaggcgattagatttgtaaattttcgaaacaaaaaattatttttataaatattttaataaaaaaatgtataaataaaaaaaattccttatcttactaacggcatgggaaatttcaaggagataaataaaaaagcgttctaatacaaggtgctttcgttgataaccctagtgacgaaaatctgggagaaggctaaaacctaaaccctagcaggagctaaacgactctcaaagattatcccttagatttctttttcttctatatactccctccgtcctaaaatataaatatttttagacttcgacatagttttcgagttactactttgatcaaccatatctacaaaagtaagatgttttaaataaaaagagttgcactcccttcgtttcaggttataatacgttttgactttggtcaaagtcaaactgctttaagtttgaccaagtttgtagaaaaaatagtaccattttcaacccaagacaaatttactatgaaaatatattcaattattgatttgatgaaactaatttagtattataaatattattatatttgtcaataaacttaaataaaacttgaaacagtttgattttaaccaaagttaaaatgtcttataaccataaatggagggagtgtattatgatagcttgtttaatgataaatctagtaacatcaaatgtacatgattaatctttttttctattaataattaaaattttaaaagtttgatttgatatattctaaaaatacttatattttgggacggatggatagagtagttgtttcttacttgtaaaatactagcttttaacttagcacactcgtttttttaaaaacaaatgtattgtgctgacatgtgccatgtatggtttaagggcccgttgaactccgagatcctgaatgacctgttcggggaaggtatcttcgccgtcgacggcgagaagtggaagacgcagaggaagatcgccagctacgacttcaccacgagggccctccgcgacttcagcagcgacgtcttcaagaggaacgccgcgaagctcgccggcgtcgtctccaaccacgcggcgtcaaaccaatccatggacttcaaggtaagtgcatgcatgccatatcaataccaagctcacgtactgacgtatactacatcgatcgttttcttgatgtccaaatgttcgtttcttcaggggttgttgacgagagcaacgatggactccatcttcaccatcgccttcgggcaagacctcaacacgctggatggctccggcgaggggcgccacttcgccaaggcgttcgacgacgccggcgagtacctcctgctccgctacctcaacccgttctggaagctggccaggctgctcaacgtcggcgccgaggcgacgctcaaggagaggatcaaggtcgtcgacgagttcgtgtacaagctcatccgtgccaggtccgacgagctctccaacaccatggcacaagatcatgtaagcaatacctcacatcagtggcatgttggtacatcaatttgtgagtgaccagacgcttgaaactgagctgaatttcgtaactgaaacagcgttccagggatgatctcctgtcaagattcatccaggcaacgaccagcgattctgggacggttgattacaagtacctgagagacattgttctgaacattgtcatagccgccaaggactcgacatcggggtcgcttgcttggttcctgtacatggcgtgcaagcgcccggaagtccaggagaagattttcgacgaagtcatggagaccaccaacgccggggactgcgcttccatcgacgagttcttgacgagccttaccgaccaagcactgaacaagatgcactacctgcacgctgcactgacggagacgctcaggctgtacccttcagttccactggtgatcactgatcagtcaatcaattgaccaatgaacagtatgatcaggaagttataatgagagtatatatcaaacttaccgttgcttgtttgtcttgatgatttaggagaacaagcagtgcttttcggacgacgtgttgcccaacggttttagcgtcagcaagggggacggggtattctacatgccctacgcgatggggaggatggagttcttgtggggtaaagacgctgaagctttccgacctgaacgttggctcgacgagcacggcgtgtttcagcaggaaagcccattcaagtttacagctttccaggtgaaattttactgaactcaccatcatcgtgatcgaattttctgaacttggtgatgagacagtcctgaattctgactacctgagtgaatcttgtgtaggccggcccaagaatctgcatcgggaaggatttcgcgtacaggcagatgaagatcttcgcggccgtgctgatccgttccttcgtgttcaaacttcgcgacaagaaggacaacgtcagttacaggacagcgattacgcttgccatcgatcaggatctccatctgactgctacggcaagatgagtgtacagtgtacactatacactatacagtgacagtggcacgtagggcagctgactctactcacgctagtgacagctccttgtgaaaacataataataatatctctcgaaaataatatagctgcaaacttaattgtgtctgattgcaaatattccgtctagcttgctggaataaattactatttcccgtgcatctaaaatttatttaaaattatacccatcctaacactactagaaaaatagtttttccaggcggcaaaaacagttttgtaagcaaaggcctgcgatgcccgcctacgaaaatcaggcggcatctccattattgtaggtgttagattccacctgcccgtgaaaatcatcaatgcgcacaaaaataaaaacagccgtcaccacccctacccgccggcgccaccattggcctcctcggccccctcccaaaacagccgtcaccacccctacccgccggcgccgccaccggcctcctcggccccctccccctccggcagacggctctccacctccgtccaaggggagtgccacttccgtaggccagctctcctcttccatccagacatgggaggggaagggcctgcgttgtctgcgccgccgctgccatccgctcctccgctgtcacaccccaatctggcaccgccgtacaacggcacctgacaggagcgtgtcgtgggaaaaagggcacgaaccgcttcctacgaaactgcgatctcagtaccagtcccaggacatagcgctggtacccacggtgacaaatatgaatcattgcaatccttaaaagaaatagaggacttatttaccttaacttaggttgcagctcagaacagcccgagattgcaaccgacgacgcggacgaggaaacaccaacaacagcggcagcagcggaaccaacggactaacacccaacaccacaggcgacggctgggaaccaggacgaaaccctaatcttcactttacgtcatcttcaacttccgggcggaggaactatatatatttatatagagcaagggtgagtactttcgtactcagcaagtcacgggaatttaggtgtttaatgcaagcttagaagagaggcaaggttgttttgcaaatcttttatttgaagacattttgaaatcactaagtgatttatttctttctaagtttggggcgaaaagagacttgcgtctcgattcgactttaagagatgtttttcaacagctcaattggtaatgtactgacctcccgggtcagatcattacttcttggctcccagagccattccacttgattaatcggctcccagagcctttttcattttctcggactcccagagtccagctgcccagcagcacaacaatccgcttccactcgggaagcctagtctatgatgcccgtagacatcccgaatcacacagattcgtttcttgaccactcaggtcatccatctgccacataggctgataatggtaacgattccccaccagaacaacttttcacaaagcacaggcaaacaaatctacgctacaggaaacacctcacatccgcccatgaccgcgggcacggctgtttgaacagttagttaatctctgcagagggggtatactttacccacacgacattactaacccggatcacccagcccgtgagatcagccacgtcgggagaccttaaggctttcatgacaaggcatttcgaaagccaacacaggttcaccatatgccaacgagaggggtcccagaccaacaccagattaggtcccagaccatactgtgccaggaagcccgagggttcttcccgacaccaccccgttgaatccacatgtctcttggcatcatggctccccccgattagctaattactcagccaggggcgtcccattgcacccgtgtggtcgcacttgttatatgctcggatgaatttcccacaggaatcagtccttatatgcgaatacgggacagtgccacacaggcacaacccccgcatcgcgagttttcacaatccattttattttcaaacacactgacgccacatgtcgggttttcaaggcttctcaaacccatttcccaagttttcgacaaacaatggtgtatgtgggatatttggtatacgcgctcagagagcacggataccgaggttccacaaaggtggagtgacaaggaaatcagggtagtacaacctacaggaattagtgcgagtgtgcgactactgggtaggtccgtcggtttggcacgcataccgagaccaagcaagttgagtgtgtgattctaataatgcaagttgcaaacaaaataataatgattttccaattataggagcaattggtcaaagggtgacttgccttgctcaaggtcttcacgaagcttcacgaatcttcgagaaaacccgcgatcgacgaaaatccggtaaccgcaactatacgcaaacaattgaaaacctaaacaaaagaccaaaagaaagatcctatttagactaattagtagtgacattaaatagatctcaattttatggaaatactggaagttgaacggagtcaatcagagctacggattgagagatatgaattttggaagtttaattggaatttctgggcaaaggaagatatttgtggaacaagaggaaattgatttatgaaatttatagaaataatattctcaagaatattattgaccgtcactgacgtgcgggaccaaggaaatgatttatggaattttgggaataaggaattgatttatggaataggggaaaaagggtttattaaatcccttgaaaaaagaaaggagggatgccatatagacttcctcgggcggcttaggcgcggcccgaggggtttatgcggcttggccggacctaatgggccggcgcgagcgcgggaggggcggcccaagagagggggcgcggggagagagaggccgacgcgggtggacgcggtccaccacgcgggacccacatggcggtggttgggttcacggtggggagggcgcacgcgggggcgggcgctagggtttcgggggcgcgtggtttgggcgcggcgcaccgggtggacggatggtggcgggcccacgtgcagccgcacggcttgccgtggaccgtgcacacgggagggaagacggagggagggggcggctgaccggcttggcccggtcaaggccgaggtggcaccgagatggcgcctacgtggcagccacgcgggccggcgggccgagatggacggcggacggcggccgagttcaccggagctcgtcgtgacgattcgagagagagggagtacacctgaacgatgggacggacgagagggagtgagccaccggatcggattcgccggagggaggccggcgacgacgaatcgcggcggcgcttgccggcggcggcaaaagagggaaacgacgacgacgcgatgagagctcgattcctagggacttgagcatctacgcgacctctggagttcatttctagagtcggattgggtgaggctacaccgaggaaggccggcgacgagcggctactactgagtttgggcagcgacggcggcgagcctacggcgagcagcggcggcggtcggggcggcgccagcttgctactggaaggctactcgcactactgcccagagctaaggagaggagagggagcgaggagggagaacgggagatgcactattgagccgagacggacgctgtgacgagcggccgacgacgcgggagcgagctctccggcctcgggccggggaaggggaaggagacggcgcctggagtcccgcgtcagctcctcgcgcgcacgccggcttcaccagcacgcgcgatggaggagggaggcgaggacggcggtagcaaggcggcaagggcacggtggtggcgagggaatgaacgagagggagatggggtggctcagtttactaga

SEQ ID NO: 65887 - DNA, 20982 bp, Oryza sativa
gaaaactgtgctaagacatcttactccctccgtctctaaatataagggaatttgtttgttcgtgtagtaggatgtatcacatccaatcaaaatcttttatactccctccaacctaaaatataggccgtgtttatattcaaacttttttcttcaaacttattacttttctgtcacatcaaatgttcggacatatgcatggagcattaaatatggacgaaaaaaatcaattgcacagtttgcatgtaaatcgcgagacgaatcttttgagcctaattacgtcatgatttgataatatggtgctacagtaaatatttgctaatgacggattaattagacttaatagattcatctcacagtttacaggtggaatttgtaatttgtttagttattagtatatgtttaatacttcaaatgtgtgtccgtatacttaaaaaaattttgtcacacgaactaaacacagccatcataacttttgggtggatgggacatattctagtatagtactattatatgtctcattcaccctaaaattgttatattttaggacggagggagtatattataggagagagggaggaccagctgaaagaaaaacaatcaagatacagaagtcattctcagccattaaaagaaagaacgacaacttgttggaagcataataaataaacctgagtaaggtaatgcggtgctcgtccaatgctccagcctactccctccgtcccataaaaaaataacctagtaccgaatatgatacatcctagtatttcgattatggacatacatacgtctagattcatagtagtagaatatgtctggttctagattcgttttttatgggacggatggagtatcgacgaatgacaatcccatcattaattatatcctgcctatttggaacctacccggctataactaaagagatgcattatacagaatgacaaagatatcccatcactaattcgcgcaaaatacagaagggcgcatcactcagcgcggcaatccacaactaaagccaatctaactaaatatggaaaaactaagaaatgttattgataaacactcaaatataagaaatatcatcaacaagtgagagttacctaaaatactatcatacatgtgattttatcctagaaatatcattgttgttaagtttccattaatcggatccatatgccattataacttctttgattttgaaaaatatcataattatttgtttatttgaagatatgttattacaatttgaccgaaattagtaatatgccactagtaccatttcaatgtaattataaaaaagatttggactaaattacccctcctcctctctccttttttgttcaggatccaatgaagtcatgccaccggcaatggagctaacggtggagtggtcgggtagtctaggtggtgggggcgagtcctcaatgcttggtaggaatcagagcttctcatgttggctatgttgtggtgttgtggacgacgagagtggagaacagagggagtgcctatccggtgagttgggtggggattgccggatcggacttgtggaagagatgacaaatagtgagagggagaaggaagaagggggtgaagggaggaggaggggggcatttgtccaattttttaattgtgttgaaggggtacgtaatggcatatttctaatttacatcaaattgtaatggcatgtctcttaatatacgaatagtaagaacatcctgccgctgtggatctccattctctcgtccccgcttagtctgctgtaattggatttttttttctctctccttagtctgttgtttctctcctcccttcctctgttgtcggttgatgtaagtaacctttgttaatttaattcacgtggggacttctcccccagtgttttcagttaaaaaaaattatacgaatagtaatggtatgttttgaaatcgaagaaattacaacaatatggattcaattaacccataaataattgctcatggaactattcatgttcaacccttgacctcccatatttttcaaaacaaaatacaaatatttaaaaagagattatataatccaagtatattgtatcttaattgcaatcataagataaaacttcctactatttaagagtaactaattgtcaaattgtatgtgtagtagtcaacgctaaagtatattttaaaacgtaaggaccgccaaacaaaaccaaaaaaaatgtcaggaacaaatgtcattctctatcggacatattatatactgtatatataaaaaagaagaaaggcgaacgtgttgggaagcttttcttcttctttttttttatatacatatagtagatgaagtaatctgggagcataataaacactaaagaaacctgaggaccacgccaagtcattgccgtcgggccagttgattagtgttgtactgctgtcatgctgggctagtcgaacactaatgacgtatgacaggatatcttccgcttctgattgacagatatcccatatctccctgcccccttaaaaaaataatcgatagcgaaactattcgttctcattgtcaaactttgatctcttgttttattttgaaaatgttacgaagaattaaaacgatatgacaccatccaaagtatattgtgtcttaaatttcacgtattttaaccattcatgaggaattaatgatacagctataattgcaagtaaaaaaagatttggagggagagacgtctcacaaaaaaattaagaagaaattgtgaatatattgtggattgaacacgagactttaagattgaaaacaacaccccttgctactgcagtatcaaatgcatctctataatatgtcttgtctaaaggtaaagcctgatacagaatattaattagacaatacacattttatttagagactattcccttaaatttttgaaataataaatactctaatcattaattaaaaagttttttattactattattttatattttattctcatgcagccaagttctattttataaaaactaagagttgttattcatgagttgtcaatagtaacggcaatgttttatctctcttctctctgtttttccgtgtcagcaaatattcttaattagtaatataacagccattgtacatataaccggactagtgaatgttgatcgacatttaaaaaacggagggaggactaaactcattgcaaaaaccaaaaataaggaaataataatatataaatgtcattgtcagccattaaaataaataaagacaacttgctggtggaagagtcaagagtggaagcatgataattaaacaaatctgagaatagtgtagtgctgtgctagtccaacactccaaacatgtttacatgtcgacggctgacaagatatcttccactattttatcatgcagtccacatggagtaccccataagcccatcgctaattatatcctgccaatttggaaccttctcctatctataaattaaagagatgcattcgcgccaaatacaaaaggggaaaacactctcagtcgcgcgtccagcaatcggcagctagctaatcccatctcgttgttgcttgtagccatgggagcggaacgcggcggggactcttgctactctccggcggcggtaatggccaccgccggcgccctcgctctggtggcgatctgctcgtacctggccgtcaccagcaacaagcagaagcggcggcggcggccgccggtggtcggcacggtgttccaccagctgtacaacgtccggcgcatacacgactaccacacggcgctgtcccgcgagcacacgaccttccggatgctcgtgccggccggcggcgaccagatatacacctgcgaccccgccgtcgtcgagcacatcctcaagaccaacttcgccaactacggcaaggtttatctcctctcttcttttctttctttttttttttggaatttcacttagataggtatgattttttaaaaaaagaaactaagaagatggattgacgttatattttttagtttaaatttaacgtctacaagttgtaaaaaatatatatggttgtcaatatatgtatggtaaccaaagtttaaatatttgttttcttttgttgtaacttttggaatttcacttagataggtatgttttttttaaaaaaaaataaattaagaagatggattgacgttatatttaagtttaagtttaacatctacaagttgttaaaaatatatatatggttgtgaatatatgtatactaaataaagtttaatttgttttcttatattgtaacttgtaaaaaaaataagatttggagagagagacgtaccttcaaatattttttaagagaaaattgtgagtgtattggaaattgaatacataactttagagttgaaaccacacaccccttatcactgtataatcaagtgcatcttttttttttaatataacttgtagaaattgaaattggatttaaatgtttaaagattgtttgtaaactgctacagtatacgtagcttctagttaagttaaccctatatgtaaacctagttgaatattattccctccgttgaaaattataggacacataatatttcggaaagtcaaattttgtgtgtttgaccaatgattaatcaaattataagtatatttagtgcataaaacttatatcttttaaaaaaatttcccaagacattagttctacagataacaagaatatattttataggtggtcagtggtcaaatcttgtcttaagtacttgttccaaataaaatatgccctatggctataatctgctacggagggagtaacttctactatatgaaaaccacaattctacgcaatcatgtttggagttcgccaccaagcactgagagtcagtgtgttacatctacatgaggtttaaatatgatgcttaaaaatgacgtttaatagtttaaatgttttctggaacaaatagtcacaagatttctcttttattatgggccggacataagcctcagatgcattccggccttccacggacgccgtgctcgtctgataggcccattaattatcagcctcggtcgtaatcccgttccgacccaactatcaagggcccaaacagatcatcataaaccagaaatggaataagtacatgttaggtacttaggtcccttatcttaacattgggtttgaatcatttcattgaacatcaatatcagatataacacgtccctcaacttacgtctctcaacttgtaaaactgatgtacccaaaatcccaggacagtataatgccgatttcagctaaagtatcggctaagtcagcgtgagacccacatatcaaacgtctcactttaccatctctcattaggccaggaggtagacaatgagcaacgtggacaggggtagcgaccgatggggagaggaggggagaagacgaagaaagagtgttctgactctgactaaaataccctgacatgtgggtccaacactgacttagctgtcacctcaatcaaaaccaggaacgatactgttctaggacttctggtacaccagttttgtaaaaatgaggggcgtatgtatatctggttttgcattttaagaagacgattcaaacacgacgttaagatgagagacctaaaataaacttatccactcagaaaatcacaatagttcgaacatcccataggtaggcccatcggctttgcgcaagcagctatttcatgtttgtgccagtgtcgtggaagtcggccggcacagccgtttaatcgtccgtcaaaacggaaacggtagccagaccgtaccgtatcatcaagtcggagcaacattactatttcagagtaattatacagttgtatggcatgattagtcggttatttatcgataaatcagatgtctgtttatgaaactaacataaacttgcaacttgcagcccagctgcactattttgactaacaagcccaatactattgcgctactaaccatcagtattgatatctattgaactaataaatggtattttcataatatagttagagatttatacaaatattttttattaagatgatgcattttgtctccaccgttgccattaacatcaattatgtacatcttagtgcgaacgccaaaaatccgtataattccgtttaatcatccgtattacgattaatcgcttgacggcacctcgtccgtccgccacccgtatttcgttttccacgacactggtttgtgctgacacgtactgtacgaaacaaaggggccgtttaaccacgggaacgccaaggacctgttcggggacggcatcttcgccatcgacggcgagaagtggaagcagcagaggaagatcgccagctacgacttctccaccagggccctccgcgacttcagctgcgccgtcttcaagaggaacgccgccaagctcgccggcatcgtctccaaccacgccgcgtcaaaccaatccatggacttccaggtaaattaagcgatcgtaactaccaaatggctaataatgcacggcgccggtgagacggtgagtgacgtacggtttgtgtcgaacgtttgttcagggtttgatgctgagagcaacgatggactccatcttcaccatcgcattcggcacagacctcaacacgctggacggctccggcgaggggagccgcttcgccgcggcgttcgacgacgccagtgagttcaccatgctccgctacatcagcccgctctggaagctggcaaggctcctcaacgtcggcgtcgaggccatgctcaaggagaggatcaaggtcgtcgacgaattcgtgtacaggctcatccgtgccaggtccgacgagctctccaactcacacgactccgtaagcaacccctgaaactaagcagctcactacactccggtttgactgacatatatatgatagatccatttctggatgtgtaactaagctgaattttgtatctgtacagggttcgaggcaggatatcctatcaagatttctccaggcaacgaccagcgattctgtggtcgattacaagtacctgcgagacatcatactgaacattgtcatagccggcaaggacaccacagctggggcgcttgcttggttcctgtacatggtgtgcaagcacccggaagtccaggagaagatctgccacgaagccatggtggccaccagcgccggggacaccgcttccgtcgacgagttcttgcagagcttgactgaccaagcgctgaacaacatgcactacctgcacgccgcactgacggagacgctccggctttacccttcagttccaatggtgattaattatgatcagtttcatactaccatcgagctaattaatcaaacgacatttctctcatcgagtgcgtaacaaacgtctcttgttgatgatgatccttttctttttcaggaaaacaagcagtgcttttcagacgatgtattgcccaacggttttaacgtcagcaagggggacatcgtgttcttcatcccctacgcgatgggccggatggagagcttgtggggcaaagacgctgaatacttccggcctgaacgttggctcgacgaaaacggcgtctttcagcaggaaagcccgttcaagtttacagcatttcaggtgaagtttaccgaactcagcacacaatcatcaatttctctgaagaagttggtgactagatttctgaattctgtttacctgcttcttccgtaggccgggccaagaatctgcctcgggaaggagttcgcgtacaggcagatgaagatcttcgcggccgtgctgctccgtttcttcgtgctcaaacttcgcgacgagaaggagatcgttagctacaggaccacgcttacactcgccatcgaccagggtctccatctgacggctacggcgagatgagtgcatgtcacactacacagcctgggcacatactgcagctgtcacctgtacactgtactcaatgcaagtgacagctcttgtgtgccaaatcgaatgatatctgtagaccttaataacgtctgatcgcgaatgatccgtattgcactctggaaataataaagctgccggtgcatgtacctaaatagcagtcagcgtcagagaaacggtgcccgacgaactatacattcggttttcagttcagatggcacacgttttggcttttgggcgttggtgttcatggcagatgcaacgcattcatcagtcatcactgtgccgcgaaatgtatcatggacgatcagacgatcacatcgtgtcaattaaagctacagcgccatgctgactgctgatgttaatcttgatctggacatggatcgagtagacatgccgatcaagctcaggaagacgcgtagaaaatgcaccgaaaaatgaatgaatcgaggaattggagtacagtgaatcagtggccatggcgtcagaatcaatggatcagcgtgtgaccatcctagtggttatagaattagttaggccattagttaaagtgacagtctacaacacacatcaatccagttcgactgcaataatgcaatgtgattgataaactaatccgtcgcgaccatattaatttccgcttcaaatatgcatggttgccgtgtcaggcaggacgcgggcagggcttatccgagccgtcgccatccatatcatagatgcggtggattggtggaacaataaactagaacaacaaggaaaacctaaacagaaggtggccatgcatggaacaagctgatttgcccaggccttgacttggtacttataattttagtactagcaacagtagctattagttagatcaagctagaaacatgtgcgggaaggagtatgtagggggtcatctttaggtggtgatgttcatttttttttaaaaaaataaagataaggatgaaattaggttatgcaaaacaagaatgtcattattttagttgagttttaattattataaatttaatagtggattttcgtttatattttaaaacaacttctatattgttgttttgtaaaacacaccgtttaatagtttaaaaatattaatgaaaatggaggtaaaattttacttcctctgtcaaaagtattatgaacatgagacacagtactagaatatgttatattacatattaaattaatttattttaaaatttaggaagtactttctttaaccaaaagatttaaattttaggaaagaatcaagacacgtagggagtactatcttaatagcacaagaacaccgcctttctcagcgagagaaatgggtacccgtgcgtctctgacatgcatcatgcatgagcaaaagtgtccgatacatataaaatggcgggaggagctagagtacgttcgagcctaccaaccagacacgacggccgtgctggtgcggtgcaggcacgtactacagtactaccatccatccgttcgtcacgttggattcttggatacttgtgccacgggctaaacatactcctcctccatacacaccgtcaccgagcaacctgtcctggatagcctaatgcagtacaacccacttagcttaatcatcaaacaaacatcgccacaggaactatggttaactggagagtggtagtttaatcctcgggaaccgggctgattaaaaagagagagaaagattaatcttctcgagagccgtggttgcaaagtttgcaagctcgtgggcagcaaatgtgtctgcatcctacaagacgatgtgctcgtgtacgtacgtttgctcgccgaggaggagagagatgcgagctagctagcgtggggttgggttgggttgtggtggagtggctacccaaaaaaagagcagtggatcgagtaggatgatggactgatgtccagtagcgccgcgtttgcctttggacgcgagcgagtgaccggccgaatctggtttggggatggatgtccgggttttgtctcatctccttcattcctcggtctcttccccgccatggcaagttcaaaatgcggctttgctccggggcaaattcaaacgcatgacgggtattacgtgcaatttgtgatgaattgcggtttcgcatgatggatggtgattggtgatccatacgccccctgtgcaccggcgggcggcggtggctctcgtcaaagcgtcctgagttgttgacgcggcttcacacgtccgtcgtcaaaaccccggggccccaaaccggtcaaccgaccattgaccaccaccacctcggcacctcctccatatacaatggccgaatggcgccgtcccgccttgtctcactccactacacacctccaccgccgctagctttcaaaaaaaaatggacgccaatccgcctcaccggctcaccaccactccagccactgacaggtgagcccccactcgaaaatatctccgtccgatccacccagcgcagtcgcagcggcacacgggcacgtacgcacgcacgcccgccggaatagggaggaaccccgatcccgaccggtccagctatcgccagtccacatgagagtacgtacgccacaggagccatccgggccccggtacgcgcgctacgcatctttcgaacccaaacccccccgcgacgacgccacgccactgccctccagctcactgccagtgctcccccatcactccactctccccccacgtctcgcctcgccgcaacagagaagcttttcagcttactccctgtggcaccctataaaacctcgcgctgcctctcctcgccggcattgtattgtacacacgatggagtggtcgtcgatgcggtggtggtgcctcgccgtggtgctcctcctgtccacgccgctgctcgccgcgggttacctgcaggagaggaagaactacatcgtgcacctcgagccgagggacgaggccgccgccgccgctggcgacgcctccgtcgaggagtggcaccgctcgttcctgccgcaggtggccaagctcgattccgactccgacggcgccgacggaggcccgcgcattgtgtactcctacagcgacgtgttcaccgggttcgccgcgcggctcacggacgaggaggccgaggcggtgagggccacggcggggtgcctcaggctgtaccccgaggagttcctgccgctggcgacgacgcgctcgccggggttccttgggctccacctcgggaacgaggcgttctggagccactcggggtttggccgcggcgtcgtgattgggatcttggacaccgggatcctgcccagccacccgtcgttcggcgacgacggcctccagccgccgcccaagaactggaagggcacgtgtgagttcaaggcgatcgccggcggcggatgcaacaacaagatcatcggcgcccgcgcgttcgggagcgccgcggtgaactcgtcggcgccgccggtggacgacgcggggcacggcacgcacacggccagcacggccgcgggcaacttcgtggagaacgccaatgtccggggcaacgccgacggcacggcctccgggatggcgccgcacgcgcacctcgcgatatacaaggtgtgcacccgcagccgctgctccatcatggacatcatcgccgggctggacgccgccgtgaaggacggcgtcgacgtgctgtcattctccatcggcgcgtcctccggcacgcagttcaactacgaccccatcgccatcgccgggttcaaggccatggagcgtggcatcgtcgtcagctgcgccgcgggcaactccggcccggaccccggcacggtcggcaacggcgcgccgtggatgctcaccgtcgcggccggcaccatggaccgcgcgatacgcaccaccgtgaggctcggtaacggcgacgaattcgacggcgagtcactgttccagccggggaacaactccgccgcgaacccgctcccgctcgtgtaccccggcgcagacggctccgacacaagccgcgactgcagcgtgctccgcgacgccgaggtgaccggcaaggtggtgctctgcgagagcagaggcctgaacggccgcatcgaggccggccagaccgtggcggcgtacggcggcgccggcatcatcgtgatgaacagagcagccgaggggtacaccaccttcgccgacgcgcacgtgctcccggcgtcgcacgtcagcttcgacgccgggaccaaaatcgcggcgtacgtgaactccacggacaacccgacggcgagcatcgcgttcaaggggacggtgattggctcgtccccgtcgccggccgtcaccttcttctcgtcgcgtgggccaagcaaggccagcccgggcatcctgaagccggacatcaccgggcccggcatgaacatcctcgccgcgtgggcgccgagcgagtcgcacacggagttctccgacggcgtcggcctctccttcttcgtcgagtccggcacgtccatgtcgacgcctcacctgagcggcattgccgctctcctcaagagcctccacccggactggtcccccgcggcgatcaagtcggcgatcatgacgacgtcggacgccgtggaccgcaccggcgtccccatcaaggacgagcaataccgccacgccaccttctacgccatgggcgccggctacgtcaacccggcgctcgcgttcgaccccggcctagtctacgacctccacgccgacgactacatcccctacctctgcgggctggggatcggagacgacggcgtgaaggagatagcccaccggccggtcacctgctccgacgtcaagaccatcaccgaggcagagctcaactacccatccctcgtcgtcaacctgctcgcgcagccgatcacggtgaaccggacggtgaccaacgtcgggaagcccagttccgtgtacacggccgtcgtcgacatgcccaaggacgtgtccgtgatcgtgcagccgccgatgcttcggttcacggagctgaaggagatgcagagcttcaccgtgacggtgcggtgggccggccagccgaacgtcgccggcgccgagggcaacctgaagtgggtctcggacgaacacatcgtgaggagccccatcatcatcccagccacggccgcgtagtaattttttgcaacttcagcatgtacagtatgtcagtaaatagctaagatcaataaagatccatcaccttggtttgacctgtgttctgttggtcaagatgtgaagaatgtagcactccttgactagttggccgatcctgtcaactttgacagctactactggagtactactaattaatttccatcttattcatcagaaactatacatcagagattatcattaatagatgagtcaatgctcattcatactctctccgtctaaaaaaaagacaaatctggtttccgtacccaatgtttaacaattataaaaaaaattaaaaaaacaagccacgcacaaaatattaatcatgttttatcatctaataccaataaaaatacgaattataaaaaaatttcatataagacggacagtcaaagttagacacgtaaatttagggtttgcctttttttttttttggacggagggagtattcaaagaaacaggtggttagatgcttcagggagtacagtttgctctgctttgcttacagaagaactgcttttgtttggtagtaggaggacaaacctattgcacatccatttccagcctgttaacaattgttgcgtcttgacgaaaggtcaggctaaacagtagtagtcagcattaaagtatgtacatgtagtaccaaatgtatcatctgctttttgtttgcctttgcacatgccctctgcaaacctgtcttgcgcttgctgtcacgcttactcagtacttagatctgaagttcatgtaccgtaattacgagcagttcccatctaaaattactggtcattgtgctgtattatgctgtactgtaatcttcaaaactgcacatgttcatgccattcactcacctcatgactgtacttttgtgaagacatgaatttttatccgacttcaaaagaaggcaaccgttgtttcaaccaccctactttcaaatgaaaattatcctagttcgtctgcagcaagcaatgccatggtggatcttcattgttcagaagatgggagatgtcactaccgaaacaggaatggcttgcaaacgtgtcagttgagacaatcaaattactgtttctgaaggtaccagagcagtcaatttgctgggacctccaagtcccctgagaccacacaaatattcagagaccacaagaaaaagatcaaagtcttcgggaagaatcaactcacattgatccgtctctgtggtcatgaactgatctgcataactgtgaatggctgatgtaaccagatcctgaatattgcaagtgaaaccaggaggcacgatgaaaacaaatgaccacttctaaaaaaaaaaaacaaatgaccacatcaaactgttgttttttcagcaatgaatttgatgcagtccttgtttttttcagcaatcaaactgcacacggtaaggtttggtcccgtttactttttaaaatgggacaccatcttaatataaaacatcggcaacggtctaactgttcgaaaaaaaaattgatgcagtccttgttttgcaacagaactaatgagaacatcgaacatggtggcctcacaaaagcagcagatatttttccatccgctactattcggatcttcaagaattccagatggagtacatgtctagctgaaagcaagcaacacacatcagcaaaagagattgataaactgaaaaggggaaggatcagattccagatcgtagtacttcctgctactatcctacagtactatcttctacaagcaaggatcatggagaaaagcttgatgaaagcattcaggcaaagcaaccttcggatgctgatgacagatgccaaaatgccatcaattatactgaccggggaccccagatccagcttgccgattcggcggctatcgcaagctatcatcgtgtgcaccgtgcagtgcagacaaattgttccaggtcgcattgatcaacagagggaggtcatcaaaccgagtggaaagggttatcagtggaagggagatcgctcgccgcgcagtcgctgacggctcgccggagattggccggcaccaccgatttgatccgcttcgtgggggagattgggagaagggaaactatatggtttgggttggggctctgaagccatcgtatgtattgggccggtatgctgatgtggctgaaaagtgggcccaatatagtactaaggtttgttgggccgaactaggccgttccgccaccttggcccaatggtactctgtctgactattgcttttgaaaggaagaagtcagtcaggtatggatccttgagtacgatccaagcaaaagatgagaacgagaagattcagatataccaatcgtcctaatcttctgtcattgcagatactactacgcggtttcagtgtatatatatgtgaatccatctgccaaaaacggagacagaatcatagataccagtataataattccacgggattcaattagccatccacagatcgaactcgaaactcgaacgtttgttcctttctgaacccagagagacagcgaatgcgatcgtttcccacccatgagaccacgatcatgtggctgatggcgtgatcaagaaatgagttttgcgcgtgtgcgtggcaaaaacggttggctctggtcagggcgtcaggccgttgggcatcagtgcagcaccctgatctgatcatcagcggattcagaaagtttcagttatcatactgatccgaggaaccttagcggcatggcatggcactcgtgatgcttagcctgtaagaaatggtgagacgtcagctattcaaagatgcattaaaatatttgcccttgtcaatgtataattggtatagtaaccattcaccctatccaataatggggagaaactagcagtttgcacgaaatggtgtctgtgtctctagcagtttttgtgaagaaaaaaaatattctatcaatatggttttggacaatgttccaagctgagattataactttgaatgtttatatatttttattttaaaatgtttaaattggatcaatggaaaccatatatgcatattcgactcgaaaatgtgtattatactagattagttttaaattgttctgcagtaggaattaacggtcaagtagcatcttgaaatcgtattagatgtccaatgtggcatattcttttgatgtcgggaaggaagtagtccaccaaaaagtaaaaattacaattgaaagctcaaaacacatattagactcgagcattgaaaaaaaagccatggagaccttttcgtacgtgacactgaccccacctacggaatgtatgagaaaagacaaaaaaagaagatttacttttttcagtataatatttacactccttccgtttcagttttatatgataagtctttcaacaatttcctagccaaactaagtttataaaaaaaattatcaacatataaaatatcaaattagtttcattgaatatattttgataatatgtttgttttatattgaaattattatgtatttttctataaatttgattaaattttaaaaaaagttgattagataaaaagtcaaacgatttaaaatataaattgaatagagtacattatgagttgcggtctttcaaaaagaaaaagagagagaaaaaataaataatttcctgctaagcaaatactgtccgtcacgaaatctccaatcgcgtcatcagctataccaacgcaacgcgcgttctcctcccccacccccctctccccagtgacgatgacacgtgggccccacacgacgttaggaacgaggcggtccgctcgcggaactataaaccggtcagcgtccgcacggcaccaaccttccttccttgtgcagttgtgcgggttggccggcccgcccgtggatcgtcttccaaccgggcgcgagtcggagtcgcgaccgcgaccgcgacctcacccaccgtttctcgatcgtttctctccctcctcctcccgcgatccggtcttcttcctcctccccgtcgtgctcgccgcccacgactcctcctcctcctccaccaccacccctccacgacgcggcgggcggcgagcgcgcgcctcgtctcaccctcacgcctcccacgccttggaacccaattggagatagaagaggggagcgcgaggtcaaaccaggggaatcggaatcggaatcggaatccgcgacgagacgaccctacccccgcgctccggcgaccgaccggcggcgatggagggcggaaaccacggtgggggagggtacccctacccgccgccgcagcagtatccttacccgtacgggcagtacccataccagtatcctccaccgcagcagcagccgccgccgccctccgcctacctctcgccgtcccgttcgttccacggttacccctccgcgccgccgccgcagccgcagccgcagccgtacgcgcaccattccgccccgctccagccttacccgccgccgccgcagcaccatgcctacccgccgccgcagccgcatccgccctcgccgtacgtctacgacccttaccacgcgcccgccgcggcgtacccttcctacccgagccccaaccccagcccgtccatctccccgagctccagcttccaccaccaccctgaaccgccatcgccatcgccctccgcgccgtcgtacccctccattgcggatgggctcgccaacatgcacgtctccgaccgccacgactacccgccgccgccgtcgccggcggccgtgcccgcggcgtcgtccccctccgtgctcccgccttccgcgtcgttccccggcggcgggagcagccacggcggtggcgggatgcagatggtgccgtacggccctcctgccggagggtcgcagcacggtgggatgcagatggtggcgtacggctcgccggccggagggtcgcagcacggcagcgtgaggccatccctgaaggtggtgctgctccacggcaccctcgacgtctgggtgtacgacgctcggaacctcccgaacaaggatctcttctccaagagggtcggcgacctcctcggtccgcgcctcatcggcgccgtcggcagcaaaatgtccagcgccaacatgaccagcgacccctatgttaccatccaggtctcctatgccaccgtcgcgcgcacctacgtcgttcccaacaatgagaaccccgtttggacgcagaatttccttgtccctgttgggcatgatgccgccgaggtcgagttcgttgtcaaggacaatgatgtcttcggtgctcagctcataggcacagtgtcgattcctgctgagaagctcctttttggagaaaggattaacggcatctacgatgtgcttgagtccaatgggaagccatgcgctcaaggtgctgtgttgcggctgtccatacagtacatcccggtggctcagctcaaaatgtatcaccatggtgtcattgccggcccagatagcctgggagttcctaatacttacttcccgatgcggcgtggcaatagagtgacactgtatcaggacgcacatgtgcctgatggttgtctcccggatttctgtcttgatcacggaatgcgctatcagcacgggcagtgttggcgtgatatctacgatgctatatgccaagcacggcggttgatttacattgtgggatggtcagtgttccacacaatccacctcatcagggaaggagttgagaagatgccatcacttggggaactgttgaagatgaagtcacaggaaggggtgagggtgttgcttcttgtgtgggacgatccaacatcaaggagtattcttggaattaagacggtatgagttattcattgagttcaaaattgctttgttcatgacttttacaccgcacacgagaacatgattttgtgtccaaactccaaactgcaaatttataaattgaagtgctgcaatgtttatggaaaaattgggaaacattggcacttgaagattgtctaatcctcaatacacaaatacaaaaaggcatcagaaagggcatttttacaactgctgttatcacattaaagaatttacaaaacatccggttgcatcaatataacattgagaggatcttcatcaagctcatctatttcctccaaatttttctgtaatagtttggtagcttgtcctttaggtgcatgtaccttatctttggtcccatgtttcatgatgctggaaagtttgaagtagattatgctgcttatccacttgtaggatggtttcatgggcacacgagatgaggagacccgcagatttttcaagcactcttcagttcaagtattgctttgcccacgatctgctgggaaacggcacagctgggtgaaacagcaggtattgtgatgccacacaaacttatccattatgatattccatttttgtttgtcacctaaattactacaattgattgcaccaagtgagtggtttcaaactttttatatgtctactcttcatgcttggaagttatgctgtacttcacaatcgctgttccttatacctgatcaggaagagaaatttgatattcacataatgcacacatatatttgttgttggattcttttgtataatggcatttatcaagcaatcttgtattgtattaattcttttagtaccatgtatttatcatatgatggtattgaaattcaggaaacaggaaccatttttactcatcatcagaaaacagttattttggatgctgatgctggcaatcataagaggaaaataattgcttttgttggtggcctcgatttatgcggtgggcgatatgatacacctagccatcctctatttaggtctcttcagactgtgcacaaggaggattattacaatccaaattttgctgtaagtgtttgattcctttaacatatacttgtatcttgatgtggtttctgatgtaaagctacaattaacttcttgcttttgagatgatgatagtaagaaacgtatctaatatttagttcctaaccatggaatatctttcgacagaaagctgttccatctttctcttatctttggttcctgaaagtttctttctctctctgcttttttttttctgcagacagttgatgctcgtggcccaagggaaccatggcacgacttgcattccaagattgatggtccagcggcatatgatgttttgcaaaattttcaggagcgttggttaaaggcatccaaacgccatgggattaaaaagttaggaaaatcatatgatgatgccctcctcagtattgaaagaatacctgattttataagcattaatgacgcaatatattttagtgacaatgatccagagacgtggcatgttcaggtatttatagtatcttgtagtcagtgtgtgtaagtttttccttgttttaactttctacttaaactttatttgctttgaaacctaggtgtttcgttctattgattcaaattctgccaaaggatttccaaaggatccacgggaagcaacccgcaaggtaattgagtactgtttgcatgtactaatattatattcattattatgtgcttttcgctaacaccttgctttgcctagcagaatcttgtttgtgggaagaatgtactgattgatatgagcatacatactgcatatgtcaatgctattcgtggagcgcagcacttcatttatattgagaaccagtatttcattggatcttcgtttaattgggattcaaacaaagatattggtaagcatatggtgtaaagttatttttttaattaatgtgcacccaccaataaaaaaaatccagaaacaaaatacagtgcacattacattttcttgatttgcaaaccatttcagcaattcagaacacagcaaatcccttatctgatcctaaattggtattcaaattgtgagttttcaggggctaataatttaataccaatcgaaattgctctcaaaattgcaaacaagataaaggcaaaagagagattctctgcatatatagtaattcccatgtggcctgagggtaatccaacaggtgctcctacacaaagaattctttactggcaggttagatcaacatgtctgctttgtgtcttgtttaatgtttatatagattatacccagttagttcatttgacatgatcgcatgttttttttgttgctcctgtagcacaagacaatgcaaatgatgt

SEQ ID NO: 65888 - DNA, 68693 bp, Oryza sativa
  unsure (1)..(68693): unsure at all n locations
acaaaaactttcaaattttggataaaaattctgaaatgtcagactttaagtttttggccaaatgttgaatatttacaatcttatgtttatgatatggtattttggaatttttgtccatattttggaagtttttagctcagggtattttggtcatttggataaaattgtacagtactaacgtagactaaccggacggcgatggtaaatcataggggttaaataaaagtcgatggcatattatagaacgcgataaagtcagtagcaaatcgtagagctgtgacaaactcagtggcatataatggattgtctctgtaatctccgaaccccatgacggcttgacctatttgattttgaactgttttctttggcagtgcgcgaatgattctattgtttgcatcactgtttacactgagcgcataatgggagagttgcagcttttttttaagtgaaagtgctgttacagtatcactagccgtttgcacagtactcctcctatactttttttttttttgaaaacttttgttcctgttcttgggccagataagcccatgcattgaacatggatgtgcaactagtgacataggagtatcggatatggagtatttatataatagatgtgcattttacacatggatgtttatgtcaacatctaatctcactaactattctgatcatgtagacctagcagctacaacatgtaaaacgagttgattctaaatcgaaattaagtagtaactcgaactttgtgaagtcatttggtcaattttaagaggtttgacaagtgtcagtacaggcgtacagaatctgttaagctcagcagcggaagtctaccaaccgaggatttgatgccaacgaggcaatgagctgtatagaagtgcaaatggcaaccattaactttggtttcatgacaccaaaattgggttttttgaactgtacctttgttcattcttctcatccaactttcctgcgaatttatttatttttcattttcgaaatgcaaactgtttcttggataagctgacaggagtcacaggaccttatattcttgcccatcacaccgaatcaggtatgtgcctcttgctaaaccggtgatggcgaccatatgaggtagactggcgattttattgataatctctcctacctgcaatggttacctgtttcttgcattgcaactttgcaactgatagtatcatgtatggtagtgtggcaacttgcatgatagagtgatttttactgtgtttgaggagtaaccaataattttttttattaatttgtggctcctcatctctactctaaagagagaatattatccaaacaaatctgcaaagatggtaatctgctatatgcgactaatcgttttgtgtggacctaaatgatagcaacatctatctcttttctgttgttgtggggcaaggtgtacgttctgccaaaagtatgaaggagacatgatatcgcttgaaaaaggataaaaagcaactgaatatttcagtacaacgctctgttttataaccagccggactcagcctttttcactctcagtattgtcactgtaataagtttattatatgattcagccgaatatttcctcctgaattttttctttccttctccctggagcgtgtggctcatccactacgtataaggtgacaaagaaaacaatatcatgctgaaaattctatcatgtattggagaggcatattagcatatactacatatcagaagcaaagttcaggaaattctgtcagatgcagcctgaaattttatctctctcataacaccaatatatacaactttcagcaagttctgaagtaagtctactacatctcaaagtctcaaactactatactgttcttattgtacaaaaaaggaaggatgaacagccgaatagtcaaaagagagaacaattttcacgaacagacgagttcttcagaacagttaagaatcagttcagctctgcaggagtacctgctgcctccagaacagttaagaatcagttcagctctgcagggagtacctgctgcctccaagtccttcacagcatcagggccatggagttgaagctggagaagcggctgagcatgtcggcggaggtgaagctcgggtgggtgatgctccggtggaactcctggagcctcttgaggaagaggacgatccgccggcaaggcacgaagacgagggtcagtgggatgagcagtatgcctagctccatcaccggcatggccacagccttcactggtcgatggctctattcaactctttggagtgtggtgtgcttctctctcttggtagtgatgtggtgtgcctcaagttgtttatatagaggaaagtgttgccattgccacccaccatgaacttgtttggacattactttcggttgtggggagctgaacattatgatatttttattccttgtcatgtatactgcctttatcccacatggatttactatttcctctgttcgtaaatacaaggaatgcacctagaaatgcttatatttatagattgagttagtaggatcataaattatgaggaattttacagtttttaaaaagtaccttgaggtatctaaattttacactaaaattttaatatcttgaggtacttaatagaggtaccaaattttacacttaaaaaatatggtacctctggtcctatagtacttcctcaagaatggtaaaaattactcatagcctatagcgcaactataactctaacacttcaacgttgttagaatcaaattgaaaggttcgaattggctcatgaatcatataggtagttatctataccacttaaaatgttagtagtggtggtgtctgttttcacacctatcactgatatttgggccccacaatatatactatcacaccaactttcaatgagtactcccctgtttaactgttagctctccccaaattttaaaaccaccttacttattcaataagaaaaaacatagtactatttgaactaaatgagtacttattcattgatttaataagctagagacttttttttcggttacaacgcacaagctcttggctagtatatatagacaaaatctcttattttttggagggggacattagtaatttaggttcctgcaattacggattaatcattttctctgctactgttaaagcggagtcgttgttgtcctcctctccctaaaagaacaccatgctgaaaaaacaacccacccaaaaagcaatgtatttgtacgaaaatcaacatgctacttgccagaaaaactgaatagataaaactaaatcctataatactattcgtctttatttctttcaatttcattgtaaagtacgtgcatagcactaatatcaggaaagtatggaggagtagtactaattgtaaactatccatatggatttttttggataatggaaatggattacatctccggcttctgtcataagacacacaaccataagtttaatagtaataaaaaggtaagataaaagtaaatcaaatgagaaataaggtgatgggacaaatccccaactcccatttattattgactagcgttaaaccatataaaatattttagctagcaattcttatggaactacgtcacctatagtagaataagagacccttggctaccgattctaaaagtgtagcaccattacacatagtatcatagtatcatgctctatccatatgaatttatcctacggtatgttcattacatgatggactcgtcagtgagcatctagctagtcactagtcagttgagatgtacattcagaaaggtacatgtcgatattttgcgaatcatctgacctaacagttgtccctaatcatgcttatattaacatgacgagctagcctgtcagtcttccctagaaatgatataaagtcagaaattagtaggcagtgttttgtccacagctagctttatagcttttcaccgttactagtagtattgtcttttctgttcgccgtagccattcagacattcaatgatgttattataccttctcattttgttcagactcactgtctttcttttgtgtttgccttgggtgaagttgttagttctagaagtattcttgcataaaaaccgttgtagcactaactgtgctgccaacagattgtgactgcttttgtatcttatttatcacagttaccagccaacagattgtgattggatcaatacaagcaaatacagtcacattctgatctctctattcattggttcttcttcagattacagctccactttgctgcggttcggttaagagtagtagtttgtttttataactgtgtttttgggttgcacctaaagctaaaatcttccatgttccaagttttttttttcgattactcaaaagatgcacgcgcacacacataccacagcacctactagtgagcctacacatgctcaaagacatactagaaataaaaacggagcggatacggacgaataatactcataccatatttgttatcacttttttttaccggatatgaaaacgaatacgaatacggatagctcgaatacggaaataaatacggattatctcgaatacgaataaaaatcgaatatgatcagacataaatacggaaacaaatttttctcagagtacgaaaaccaactcaacttctaatagaaacaaatatcaacttatataattagctcattttatataaaatgaagtataatttataaatatttttaaaaatttaaataatattaatagtatggactagtgttaagagataaactactattaaaatctataaagtcatattgaaggttatagagttagaaagaaatgggatatgtcttatggcttctgcggatatctgaatagcactgttcaccggatatccgaattattatccgtatctgacggaaaccccgataccatatccgggagaaaatatccgtattcgtatccatatccgaaaggtatccgtatcattttttgttcggagcggacggaaactatccattccgttttcatccctagagacgacgattaatcttttcaggtatacgcaaggagcctttttttttaattaagaggagtaaaaagtttgtacaacgaaaccaaagagcagcagaagacaggagaactggaagggggggactaaagcctaatctcgcgaagaaagactgtgacctaaaagctcctagcaactagaggcgaaacaccggtacagcagcgttggctaaccgccacaacgccgccttgtcgaccattcctctggctacctccacccaacttttgtgctgctgattgaagactcgattgtttcgttctttccaaataaaccaacgattaattactgcattaacttaatttctattgaaagcccttttgtgtgtactgtgcagtagccacataccacttttgtttatgtaccttttccctttttctttgcgtgtgtgacacttaatttgttaaatgctattagttggaaaagcctgtccaatattagccaaagcatatgtctctttctgcacattctgatccacctaaatctggatttgcacctctaacgatctcatcgattgttctctccatcttacatgcctacatcacatcacacagtatcatacaaagcttggcgcatcatttcggttacagacgatcaagcgtgaggaatcatttgcagatctggaggtggcgataacgtaatcccttttctgaagcttctgttgctgaaacaccaactcttgtaccgatctggaagctgcatgcatctggcattcatcctacgatctccatgcccatcgatcttggaagatagtgtgacatctgacgccgatatatgctaatatgcatatgcctctactccaattttgccccggcaatgatgcggctacctgtgaccgtttcagtcttgttacctgatggattcatgtgagaaaagaaaagttttgcgagaaacgcccagggatcttccggcttgcttcacaaggtggtgggctaaataacctgggttcgaaacatcactctttctaattatttgatacggatttgctatcctactgtcgacagtttttaggggtgaaaactgtcgaatttttaaccgtacgatatgctttgagatttgtgctgtgaaggaaaaaatggaaaaaaaaattaaccgtacgatatgctttgagatttgtgctgtgagggaaaaaatggaaaaaaaagtttttaggggtgaaaactgtcgaatttttaactgtacgatatgctttgagatttgtgctgtgaaggaaaaaatggaaaaataaattaaccgtacgatatactttgagatttgtgctgtgaaggaaaaatgatttgtgttgtgaaggaaaaaatggaaaaataaattaaccgtacgatatactttgagatttgtgctgtgaaggaaaaatggaaaaaaaacctgatgcttgtggccaggattgaaccagagacctgcagcttgcatgctcgttcaactaaccaattgctccatccaatttttcagagttatatatgagttacatattacttatattgtagttacatagtagttacaattacaattgaaagtttttcattaaaaaaatgtcgaatgttgtatagctactccctatttgatattaggtcattctctaatattcacgtctttttaaagaaaagttttgcagctgaaaactactgtcagcaatgtgaccaaggcaccaaaccgtgatgaattttcgttggaagtcggtgagtgatgttagtgtgaagtgtgcgtgaagtcacagtgatgagtgggtgagtgattggttaatacatagccttataggaagccatgttagggtgatggtatccgggggcaacgaacgtcctcctgtctggtgacacagtgtactgatcaggagtgagcgcgcatgtgcggcagcagatgaggcttactccttcagtcaaaaaaaaaaaaagaaactctgagtttccgtgtctaactttaactgtccgtcttatatgaattttttttataatttatattttcattgttgttagatgataaaacatgattaatattttatgcgtgacttgtctttttaatttttttttataaatttttcaaataagacggacggtcaaacgttggacacggaaatcagggtttgtcttttttaggacggagggagtagaactcaatcatgcagtacttaagtaactacttccactgctctagaaaaaaaacaatttttggttatgtatctatatggttttttccttaaaaaatattttctggttatggatctatatggttttttctgggttggaaggtgtagcttatgtgctgttcaaataagttcggcaagaatctgagttttaatgttacctgtttgacaaatgattatttagaaaaatctgtttaaattccaggattttatttctgtggatcttgcctgaccgtgggacctaactgatagcaacacaacatattttcttttgcaggataagattggcattccttgtcatagggcataaatactgtgaaatgatgtaggcttgcttgaaaaaaaggagaattggatgaggaactaatcatttcagcacaatcaatgttaaaattttcagaaaatccacattgtggacgattttgccctcgaaggagagagcagaagcacaatggaggtgatgccatgctgctcaatatagcattctgactttgaaatattacgaattcgagtataggatacataaatctagcttccccaaattgatccttagttctctcttgtgcatgctgaatttacaactggaatatttccttcctgtactttttcgatccatcgagccgacaaagaaaacaagaatcatgcaggaatttctctcaggtcaacgagaagatgaaaaattcagtaagttctgatgttcttgtacataagattaagtaagttcagaccacttgagctttgcttatggtacacaagatgaaaaatgcagtaagttcatgtacatctcagattactggagctagcttatggtacacagaaagatgaaaaattcagagagagaactcctttggatcttccaacgaacaaaaagagaaagagatgaagagctacagcacgagctgaattagcatcagcaataatccagcaccatggccaaaagccatctgagtttccgactagatcaaccaagaaaagcacccacatataccttcttcagactttctcagagcacgaagaccatgttgtcgttgagcccggagaatcggctgagcatgtcggcggaggcgcgccgccgcggccgcgtcatgctccggtggaacccctggagctgcttgaggaggagcacgatccgccggcacgggacgaagaagagggtgagcgggatgagccacacgcccagctccaccaccagcatggcagccaccctaagctccctcgagctcactcaaactgaaactgaaactgatggcactgcagctgttttgggttctggagtgtgctttcctctcgcttaattatgcttcactttgcttatatagttagataactaactagatagatgtcgctaaagcctttactctacctcgtgtttgacaaattgacagcatcagcagagattcaatcagggctatctgctggacccatttttactaacggttcttggaagaaactggagaacacagattcagagagttttttttaacagagccacagattcggagatttgctctaatggttttcttttacccagtggctttcatcctacatggatatgcttcgtgcttgtccatggtggtagtgagcttcagtgaacaagctatctttcggttgagacggacagaaacatctcgatctgatgcgtacgccatcagctgctgtcgtcttgtcgcatttgctaaaaaaaatattatgatcaagcatttcagcatgtggggtttccaaccacttgatatgagatcagaaatttgtgagtgccgttgagtgtcaacagctagtgtggctcttcacagtttttgggtagccctgacataacctccggtgtcttttctgttcgttttaaccattttactgattcggtaaccctgtaatcttgcattaaccctaataagtgtttctgtcatttcgtcctgattataaaccgtaacgcttatcagtgaaaaaaaaatgtatttttataaatatgttttagtgacttaaaaaccaacaacagaaaataaactacgatgaaaaaccatcgaaatcacctataaaattaagtttaaaatttacattttggttgcagtgataaactgaagagcaaacgattgtgcatttcttttgtcaaccttgttacgactgtttcgtatggtattgtgtacagattcttaggatgcttggataaagaagcaacctccaaaggtagcaacttctctcacagatcaagaactgcccatctcgtttgattggagcaagttgtgtgcattcatattctatcagaaaagggacaaaacaaagaagatcatgggtgttctttttcttcttattgtaatagaaaagtttgatagggaaggttactgataaacattaagatacatctcaatggattaatttaaaggtaaggctatttttttttcactttcacaggtcctgaacctttaatattccagcttaactacccattttcttatatttcatccggctttccccttgtgatttgagtgttgtatgatgtatcgcattgattaattgttgtttgtgcgctagggtggttgggagttcttgtccggattagctatgcacatgtcccctttggtcacaaatattgtactgtatttcttaaccccacgaaattggaatcttgtcaggtcgagttgtatgaatgtatcatgctcctacttgctactagtagtacaattccttcatttgactcatcctctcagttcagtggaatcattgcagatgaggcccctctgtgttgcgttgctgcacaccaactcttgtgaagttcaggaatttcgcacgcatatgctccaacttctaatacatcagctttgtctgcttgtgagttgagaggaacgggattttacagctgaaacaaccgtgagcttttgtgaccaaaaccatggcgagtttttcgattttccttgggaaactgatggctgatgcgagtgtgaactgtgaagtaacactgatgagtgatgtgtgggtgttgactctttgttcagacagcggccgtgcaaccaaaagtctcgtcctacactctggctgtgtttagttcacactgaagtttaaaagtttggttgaaattggaacgatgtgactgaaaagttgtgtgtatgaaaattttgatgtgatggaaagttgaaagtttggaaaaaaaaactttggaactaaacagggcctgagtctctcagaaaaaaaatcaactttcgctgatgaaactgaacaagtatttgtaatgaggtgatcgatcaggcgaggacacgccggagccggagggcgggttgtcgctggttggagctgaaacctgaactgattgacaaacagtatacctgaaattgtgcatggttgattcatgcttaccagtcttttccctggtaatctggaatgatggaacagaagcggagacactgagacaacggttagccaatttatgaatagtttgataaactgattgagtggaacggcagcggaacatcgatgagatatctgagatttctgtctcaaaattcgtctaggaaaaattgcacagtcggtttttatggcgggattacgggattagtaataacttgtatggggcttcgttcagttcatattgggcttataatgggactcgattcggccttctcactgctgggctcttttgttatgagaaatgggcccttatgggatatgctaagttaacgggctgactgtttctgttcgtagtgagattttaatgggcctcatctacagtgtattggccattttctgaggataaagagggaggagaaagttaactgacatgtgggcccaaaatttatttttattgttttactcactgacctgtgggtcccattaaggtttgtttcaattttagtgccacgtaagcgctgcgtcgatgtcacatgagatgaagaccaagtcagctcgccacgtaagtgccacgaagggcaaaacagctgagagagtcggtttgcaacggttttgaaagttagggaacaggttatgcccggttctgtggttgagagatgcgattcaaccagccgcaagagtttagggacgctaagtagacttattcctgttacgtttgaaactcgacccatagtcgagggatcttaagtagacttacgcccattggtcggcccatctaaacccagtccatcgatccaggcgctggacgcgggcagcagcagcagcaaagtcagcggcaaccagcaaccgcttctgtaggagaggcagcgccgcgggcagccggccggagatggccggcgccggcgccggcgagagcctggacctccccgtggtggacctagcgtcctccgacctcgccgccgccgccaaatccgtccgaaaggttctcgcctgattccggattctgctcttctactcctaccaatctgggaggccgcctgtgagcgcagtgagcaagcgtgattcgtgttggtgtgtggtttggttttgcaggcttgcgtggagtacggattcttctacgtggtcaaccatggagccgagggattggcggagaaggtgttcggggagagcagcaagtttttcgagcagccgctgggggagaagatggcgctgctgaggaacagaaactacctggggtacaccccgcttggcgccgataagctcgacgcctcgtccaaattcaaaggtctgcgcctcatgttccatagccaattcttcgcttgagctttgcagtttgcagtttgcactgctcttctatagccaatttgagcctaaggggtgtctagctaggtaactgtaataatagaagatgacgagttgtgtcggcaaaaggcagaacttgacaaattagtgcctgatgatgaagtattctttacgcgtacaaggctatataagtacattaagaatgtcccaatgcttgtgaatgattccttttagaaatgattacaagtcatggctctggtttgatcgacctgaaggtcgcacaatcttcaattagtacaaggccaatataattcgagatgaagcagataactggataagtgctgaagaaccatttaccactttaacgtatcctctctgcctctagtttgaacagccgatacatcttgtcgattttaccttcttgtgtttgtaatgatgcagttgagacttttgtttgtgatttgtgatccaggagatctcaatgaaaattactgtatcggacctatcagaaaagaaggttatcagaatgatgctaaccaatggccttctgaaggcaattccccctcctcttctttttctttgttgtcatttcttcgagaacataaataaattctttctttgggtatagagaatttcccatgttggaaggagacaatgaagctataccatgaaactgcactgtaagttatcattttgcccatctcagcaaaggaaatttaactgctgtgatgcaatctacaacaatcagtccatcattaattcgctgcatcagcattgtgtttgtaatacttttatataactatttgtctcaaatttgaatattcctatttattcgctacctcttccagtgctactggtaaaaggatactctctctaattgctctgagtttgaatctcgacgttgaattctttgactgcccagtggcctttcttcggttattgcactacccaggtaaccttagtgcgagtccctttataatatgaaattaaccaaagttgcattctaataatatgcagcagagtgctaagttgagcattttcattattgtcgagccaattgagcttcttttcctccttacacaaacacacagtacttattggttttgtatgaatagaaaatatttttaaatgcaggtgaagctaacgagtccgatgatggcaattatggtgcatcagctcactcagactatggagtactaacacttgtagcaacagatggcactcctgggctgcaggtacaccatgttctcacaaattttgattctccatctcagttctgttctcttttgcagctaattgatcatttaaaacaatataggagtatgctcataatattttatgaggatgagattattgcccaccttttaccactttcaagcaaaacaatacctcttctttagaaaagtagaaatataatatgcataattttttgcacttatgttctggtttctctcactgttttgagttttcagatatgcagggagaaggataggtgcccccagctttgggaagacgttcatcacattgaagggtaaataacaaatatttttttagtaaaaaaaacaaatattttttatgatattaatgaataacaatttcatatatatcattgctttgtcttttttagaaaatggattaaaatccggtctctacatccaaactggatgtacatagccctacatcatatgaaattgctttacgccattgctttgttcttagctttctggacctcaattctgtgtgctccttagataatgcgttgtcttgtgttatgtatctgtagggccctgattgttaatatcggcgatttgctacaaaggtggactaattgtgttttcaggtaccatcttttcttacttctgttatcctattctgtggttgtgaggaagcctcatgtactgtgctggctgttttaaataagttcaaacgaactattacagttgtgagtagttgcccccaagaactttctgttttctgcaactcgatatggttaaatatgttagaaggcacagcactttctcaatgataaattggttaggcttgtcaatatcatgaacaagttagaccatgttcgtgtggttccttacaaattcagggtgctgttttatgacattatacacttcttttcctattttatccctatggaaaagaacaattttttgattgttctcgttcttttgctgacttgtaggtctacactgcatcgcgttgttgcagttggtaaagagcgatactctgtgagtaactgagtataactaacacctgaaatcagaaattcataactgagttttagctcctattgaactcatgttgtaaagtcgggtgaacttcttattggtaaaaccaccattgataatatatagcatttcgccaactaaatattgcatcctttttggtgcacgttctttcttacacatgtttttcaatttgtcaggtggctttctttcttcacacaaaccctgatttagtggttcaatgcttggaaagctgctgcagtgaggcatgcccaccgaggtcttcttcctcctgttaagcttagcattattgcagttctttcatgcttgcttctcactgttagaaattgatgcacgttcaggttcccacctataaggagcggcgactatttggaagaccgattgagggctagatacaaataatcctacgttggctgcgtacatccatgttggatgtaaaggccaggttttaatccattttctgaaaaacacaaataatcctacgtttttaaatgtgtaaagcttaagattagtgaacttcagtgagcagctattccgttgagatggacggaaacatcttgatcttatatgtagcccatctgctgttgctgatttctcgcgtgtgttaatactagctttacttatgagcaatcatgtcagcatctggtgaaatttgtaaccgccttcgagtgtcaacatatatttttgctcttcactgttttcaggaagactggacataacctccactgtattttctgttgccaaaacattggtatagagttttttgtataaagattcttatgatgctttcacgattaaggaagacacaaataaagtaactttgctctcagatcaagaactgcccatctgtgtttgattgaagcaagttgtatggtttcacattctgtagtaagggacaagagcaagaaattcatgtgttttttctattgtaattgaaaattttgacgggggaagcgctgatatgcatacttcctgtgtgttctaaagcctgtgccttctacatgttgcagctccatttttgccatagtttagtaagcagcagctctgatgagtgataagtggacaattgatcagctctaatgaggctggaacctgaaatgaaatgactgacaaccagtatccagaattggtcctggtctgttctataattggcttttcatgggcctctcctgtacggtcgtattttctctctgctgggctgtaatcttgtgcgagattggccatgcctttgtaagaaatgggccttagtgggccatgtttactgtagctgggccctgtttgtttgtccagtgatggcccacctgtcagtccagtccgtggatacagacgccggaagcggatggacgtgactcccgctcgggcgcccggtggaaggagattaaaatcgggcgtcagcacccgatttactacgtgtaaactcatttttctcttaaattactcatccaaataatgatccgattgcaccattaaattcattgcaattaaatattaaaaaaacaagactatattccgacgaaaaaaatagcttattattaaattatttttaaatattgcacgatgtttcactaggtatataaaaacaagatcgaaagtgtttcactcgtttaaatcgggtgttatttcaccttatataaaaataaatatttcagcaaatagcgaaagaatgtttcagttcactgcaacattagatctatacataatgaaacattatgagtacactaggtgaatattttcggtggaacagaaaataaaccaaattattttaatagagagtttttaaaatatatgggtgatttgttgcaatgaagttgtgtgggtgtgtggaagtggcaggtgggtccgtgaggagagggagacacgtgggtgggccgcagggcgagcgtccgatcctggcgcacccgcgccggtcgaccgagaactagcattctcggaagcggacagcagcagaagcaacaagcagcaaccacttcccggcgggagaggcagctggaagccggagatggtcgccgccgccggagatcgcctggatctccccgtggtggacctcgcgtcctccgacctccgatcctccgccgaatccatccgaaaggtgcgcgcccttctccccgtggcaatttccgccaacttctgcgaggctccgctatgttccgtgggtgcggcgacgaggaagcgtgattcgtgtggtgtggattggtttcgcaggcttgcgtggagtgcggattcttctacgtggtcaaccatgggatcgaggaggggttgctggagaaggtgttcgcggagaacaggaggtttttcgagcagccgctggaggagaagatggcgctgctgaggaacagcagccacctggggtacaccccgccctacaccgagaagctcgacgcctcgtccaaattcagaggtcttcgccttctattagtcgattcatcgctagcttgcgatttgctgcatgctgacccgtctttttttaatggcaaaattaggtttgtgttaagtgaaattttagagatttgctctggtccaacaaaaagtaccttttggtaccggtacctcacggtaccaaatcgtttccgatcgttggatctaacaatgcccatcctgccagctagatccaatgatcggaaatgatttggtaccgtaaggtattggtacctcgagatactttttgttgaatcggagcaaatctcgaaattttaagcctaaagtgtgcctgatagtactagataggttaatttaatagtagaacgtgaggagctggaatgggatgacccttgtgttagcaaaagacagagcttgacaagtcaatgcctgatggaatatccctccatcccactcactaagacacacgcattttaagatttgactttttaaatatttgactaataaatagtttattatgaattaaattttcatggttattgatgaaaataatatcattgaattgtcatttgaatttactttatatgattatgattttgttgctacaaacgttgtagtatactagtatatgagaaatttaaagtcaaagatagactactaagtttgatagcaccttagtgagtgggagagagggagtataagctaattaaaaatgtcccattgcttgtgaacgatgtcttttaaaactggccacaagccatgggtcaggtttgatacacctgaagatcacataatcttcaattagtaaaaggtggatatgattcaagatggagcacataatgagacaagtgctgaagaaccatttaccagtttaccacatcctcactgcctatagtttgaacaattgatacatcttgtagattttaccttctggtgttttgtagtaatgtagttgagattgttttctgtgattttgtgatccaggagaccttagtgagacattcaaaattgggcctattggagacgaaggttttcagaatgatgctaaccaatggccttctgaaggtaaatcccactccccaccctccaccctttccaaaacataaacaaaaccctttccaaaacataaccaaattctatatttgggtgcagagcgcctgccatgttggaaggagacaatgaaactgtaccgtggaaccgcactgtaagttttcattttgctcgtctcagtgaaggaaattcaataattatattgctatcgacagccatccgtccatcactgattcgccgcgtcagtattgtgtttgtgtaatacttctatatgactgtttcattcatgatttgaatattcccacttatttgctactacttccaggggtactggcaaacggatactctctctagttgctctgagtttgaatctagacgctgaattctttgactgcccattggcatttcttcgattgttgcactacccaggtcaccttattgcatgtccctttctcatatgaagttaaccaaagttgtggagtaatgatatgcagtgtactgctatgtacatgcttgataatgtccttatctcgcttcttgccatgtcagaatgcagattgatgcttggatttgttcttttgcactgatttgttcaacaaatttctttctttgaacaaaatgctgtatgtcattctaaaggatgaagaacatgatatcctcctattgatgtagctttattgggttggcccttgggaacattacaaatatgtcaagtaaattataatgaaaaagtcatactgctacttgcatggtctcaattgcattttttactaaaacttcgtttaatatctcacttgttaacttgcactagtagctgacagagtagatctgcgtgatagaaatcgctaacagttcaaactaatttatcttgatgctgacatactgtatactggagtgtaatgataaatatgttcttgtaaatcaatatgaacctaagttatggaggttcctaaggtagctttgttttctgcattgttttgcttgctattgtcatactggaaagtaggatatgaactgaaaatatcatgaaacttcaacctgcttctaggaacttttgttttggaggactgactttgtttcgttgttattgtgttttcttccttatatagtagttattggttttgtctgaatagaaaataattctaaatgtaggtgaaatcaacgagtccgatgatggcaactatggagcatcagctcactcagattatggaatactaacccttctagcaacagatggcattcctgggctgcaggtacaccatgttcttcacatatattaattcaccaatttcaattctgttctcttttccagctaatcaatcatgtagacaaatacatgctcagaaggtttggtgagaatggggttatgtgatcaccttttaccactttcaagcaaaacaatactttcctgtttagaaaagcagaaaaataatatgtattatttatttttacatttatattctagttttctcactgttgtgcgtttgcagatatgcagggagaaggataggcatccccagctctgggaagatgttcatcacatcgatgggtaaatagtaaaatactttttggtgatattaatgaataacaattccaaatatactgttgctttgctcttagctctctggatcactgtcttgtgtgctccttagataaccaggtcttgtgtacagggctctgattattaacattggcgatttgctagaaaggtggacaaactgtgttttcaggtatcatccgtttgtacttcaattaatccattatgtggttgtgaggaagcctcatgtgctgtggtgactgttaagaaagttcaaataaaccagctacagttgtgagtagtttaaccaaaaactttctgttttttgcaactcgatatgattaaatatgctcgaaagcacaatgctttctaagttggtttaggcttgtcaatatcatgagcaggatagatcatgtccgtgttgtttctgaaattctacaggtcttttcgagttctgaaatttaaggaaaaagccttgtgtatgaattttgattattcttgctcttttgctgacttgtaggtctacactgcatcgtgttgtggcagttggtaaagagcgatactctgtgagtattactaaccactgaaattagaatttcattattgaggggtttcagctcattgaattattgctattttttgtggaagctcccattgaattcatgttctagagttggatgaaccccgctttaagggaaaactaacactgataatatatagcacttcagtgacttagactaaattgtgtgcttaacttcaggacctttctggtggacattctttcatacgcaagttttttttttttttaaatttgtcaggtggctttctttcttgacccagaccctgatttagtggttcagtgcttggaaagctgttgtagtgaggcatgcccaccaaggtcctcttctttctcaatcttagcattagtctagttcctttggcacttgcttctcatattgtttgaaatttgatgcattttcaggttcccacctataaaaagtggagactatttggaagagcgcttgagctctacatataaataaggaaaaatttgctacatgacacctaaagtttgttgttttagccgtaggacactcaaagaacgtgtaagcatggtaattatctgctggacaccgaacacactattttattattatattcgatgccaatggagggagaaacagtaatgaaagtacacatttacccttgtgttggtaaggtgtgtctagttcgaagcagccgctgtaattcttaatgctgctgccccagcagtagcttaaatgtaatgcagctaattacgtatcatattatgtacgatcatgactcaaaattagttaacattggaatgatctttccagaaataaaaaggaagttaactcgctcgccgcttgaatccaccgctcgccgattgaatccgctgttgcgcgctcgttgcttcaatcggccgccgcactcgccgcttcaatccgatattgcactcgctgcttgaatctgtcgctggcctaactttagtatctgtatacaaaactaattacataaataaaagttaatttgcgagataaattttttaagcctaattaatctataattagagaatgtttactgtagcatcacataggctaatcatggattaattaggctcaatagattcatcaagcgaattagtccaagattatggatgtgttttattaatagtctatgtttaatatttataattagtatccaaacatccgatgtgatagggacttaaaagttttagtcccatctaaacagggtctaaagctcacagccgatggtcaaccttgcaatcacagcaccatcgtcaccaccaaaacctaggattttagaaatttgaaccagacctactcgggttaaaaagaaactagcctcatgggtaaacttgtcccttttaaaagtttctccctctatttgaatcaaatataataaaataatgtgtttggtatccaacagctaattgtcaatttgccatgttttcacggtgtcctctagcatatatgcgatctttggatgtcctgtggctaagaccataaattttagatgtgttgatgtgaaaaacacgaggcctgaaagatctgcttaacttcagtgcaggtccaaaaatattgcttttaggttcgtgagcgtgccagttgatttgatcctgcaatcaacaagaaataaagacaaagaaaccgcggttaaatccataaatgatagccgatcggctagccgccgatgacatatcatttaactttaagctggtgtcatatgtgaattgataagtaatcatgaataaataagaaagaactaaatctactcgatcggttgtagatgttaacaatatataatccttatgtcgatatatacttaaatcaagtgattgggatagatcggtcgccatgccgagacaatataaatcacttagatcaaaatatatactaacaatgagattatagatgttcatagcatagccgatcagatagatctagcatgtatcggctaatactccgataccactctatattaagatattaaagcaagcaaaatatatcaaacagaagcctaatatattttattgtaataagatcttaacataatggcagatctagcatatcgattaagcacatgaaatataaagctaaatcaggtaagaccggctgaaaccccaatactaccctaatcggcaaccaaaagcaggctagagattaagattctaataatgacttataagatcaaactcaactgatgcagctataagtatgaaaagaaggacaacatctagatgatcaagccgttgtatgttttatagagtggtagatatcatgtataatctaagtcaacatagatatttaacctaattggctgccttccaataatagatgttagccggttgaaggttagacaacgatattgtcgaagattatacagagtatatgataactcgacgaattacataaacaagactagagtatcatgaagatggaagcactaatcccgagaatgcaagccgccataacaagttttacccctagttgaagatcgaaaacgatgcagctcaacccgaaagcaagaactcgtcgaaacaaaacgaaagtaaaagggtggcgatgcgctgagattgtattgaacgtgtgttgttgtattacatgaggctcggggtctattaatacccgagatttacaaaatatgtccgtgtcggacacgactcttatctctaacaaactctaagataccataagtctttgcgacagacttttgcccaaacatatctctaagaaaattacatgaaatatcctaattaatagatacaattgtcttctcaagactcgatccatacatggcaatcctcatgaagcacattaactcaacccgacagcgtgtaccgctccacattgttggcatcggctcaatcggccaaccttgtccgactcgaactctgccgatcctgatcatagccgattcggaattttagccgattctcgctttgtttccggaacgatctctatcttgaattccgcttcgatttatcttcatctccgatacttggattaccaaaatttgttgttaacaagatgtcctattgctaattttgcctacaacatttttacatgtgtaaagcttaaaattgataactggctcccattaaattggctgctacatgttgcagctccatttttaccataatttagtatgaagcagctctgatgagtgatgattgactattgactagtgagcagtgagtgatcagtggttgatcactgatcaggctgaaacctgaaatgaaaggaaaaagtccactttgactcccttaattgtatgccgaatctaattcgtacccctcaaccagaaaaccagagagaacgactccccgaactattgaaaccggtgcaatttgactcccttagcggtattggagggcggttttgctgatgtggcgctgacgtggcggtattgacccggtcttcgtcccacgtggcgcttaagtggcattagaattaaaaaaaaatgtgggacccatctgtcattcacaccaaaaaaaatatatttgtgggacccattgacatgtggggcccacatatcatcctctatctccaacccttcttcctcctcccttcctctcacatgagctgcgtcctcggccgcccctccgacccctncctttaccacccccagcagcccaaccccccccccgtcgccccggagaagccgcccgccgtcgccaagaaggcggccgaggaggaggaggagaagaagccgccgaagcaggctaggagggagaggcacgcatggtcgtcgcggtctgccgccgccgaggcggtcggcctggggctcggggggagcttcgccaacagggcgcgcggggagcaggtggcggccggctggcccgcctggctctccgccgtcgtcggcgaggccatcgacggctggaccctgcgccgcgccgactccttcgagaagatcgacaaggtacgtactcctgccctcgcgctcgccattgttggtggtgggggaagggaactgagctcatcggtcttgtcggtggcgcagatcgggcaggggacgtacatcaacgtgtacaaggcgcgggacacggtgacgggcaagatcgtggcgctcaagaaggtgcgccgcccccaccccggcgcgcgacatccccgcccgcaccggccgccgccgcctccccccagccgctccctcgtgccttcctcgccgccacggcctcctcgccccactgcgcccccgcgtccccgacgccggcaccgccgcccccgcccttcaccggccctaccgtccgatgggaaggagaaaaagggagagaaaagatagagaagggagagagagggaggaggaagaagggtgggagagagaggatgacatgtgggccccacatgtcaatgggtcccacaatatttttttttgtgtgaatgacatatgggtcccacgtatatttttttaattgtaatgccacttaagcgccacgtgagacaaagactgggttagcgccgccacgtcagcaaaaccgccctccattaccgctgggagagtcaaattgcaccgttttcaatagttcggggagtcgttctatccggttttctggttgaggggtacgaattagattcggcgtacaattaagggatttaaagtggactttttccgaaatgaaatgactggtaatcagtactcggaattgggcctagtcaagtctataataggcttttcatgggcctctcgcgatgggttagtcgtagtttctctctgctgggctgtatcttgtacgagacgggcactaatcttttattcggcattgttcgtttaatcccaaagggattttggtgggatgaaaagcccttccttttcaattgggtagggggtggtaattggggaatctcaagcatccgtttgcatttaagttactgagcttttactggaaatttgatgctgagcttttactggaaatttgatggctgaatggcagatacaagtatcaagtcgcacttatgtgatgcgtggctattaaacagtaagtgatcagtgatcaggctcaaaactgaactaacaactactatccgaaattgcgcgtcgtcgcttcagtcttttccggttttccctgaaaactaggatgtaatggaagccctggtgcgagatgatgcaatccacgaacagtttgatgacatatctgaaatttctgtctcaaattcatctagaaaaaatgattaaaaatgataaatgatatgcagccgatctatgatggagcagctggattattttcgggacatttaactttagaccacttttaagatgtgtcaattaattatttgccactcgctgtctatgacatgtgggctctcatgtgtctatgatatgtgggtccagtgacaaatcatttatcaccatccgtaagagtggtaaataattaattattccattatcttcaggtgaattgcctgtactttgtcttgcataattggcctcgtttaattcataataggcttcttaatgggcctttctttgtacgtgatgggatactaggccattagtgggcctaagtttctctctgctgggctattctctggttgtaaatgggccccaaatctttgagtaatgggccgttcgtggtcccgttttaccctagatgggccaagtttgcttccttctctgtaagcccagttaccgtggggatacagccgccggcggacgcggagggcggcggcggcagcagcagcaaaccgccgctttggcagaagaggaatccgggatggccggcggcggcggcggcgggaatcgcctggacctccccgtggtggacctcgcgtcctccgacccccgagccgccgccgagtccatccgaaaggtacccaatccattccggattccatggcaattttcctggaaacaatctgttccgtgggcgcggcggcggcggggagagagagagaacagggcgtgattcgtgtggtgtggtttggttttgcaggcgtgcgtggagtccggattcttctacgtggtcaaccatggggtggaggagggattgctgaagaggttgttcgcggagagctcgaagttcttcgagctgccgatggaggagaagatagcgctgcggaggaacagcaaccaccggggatacaccccgccctacgccgagaagctcgatccctcgtccaaattcgaaggtctgcgcctcctgttttgctctgctcgccgtgttaaactgctaattgttaaacctaagcatcctctcctttttgaagactgttgataaatttaatcctgaagtgtatgggataacactggcaagttagtataatagtagcacatgacagagccggagtgacccttttgtcggcaaaaatcagaagttgacatgttagtgcctgattatggaatattctttattagcagtattaagcaaattaaaaatgttccgatgtttgtgaaagatgcttttaaaaactgaactaggaaccatggttctggtttgatctatcctgaacatctcacaatcttcaataagtacaaggtgcatggagtaataaatacaagcgctcactgcctatactttgaacaaccgctaggttttgtggattttaccttctggtgtttgtagtgatgtacttatttaagatctgtaactgtgatttatgatacaggagacctcaaggaaagtttctatattgggcctattggagatgaaggtttgcagaatgatgctaaccagtggccttctgaaggtactcccttctccttttttatcacttctttccaaaacataaataaattctatctttggctacagagcgcttaccaagtcggagggagacaattaagatgtaccatgcaagtgcactgtaagtcctcgttttgctcatctcaccgaaggaaatccattaattgtattacgtcagcattgtgtttgtataatactttggtgttatttgtttaaataatttaaatattcctgcttatttgctaccactactaggtctactggcaaaaggatactctctctaatcgctctgagtttgaatcttgacgctgaattctttgagaacattggtgccttcagctgcccatcagcatttcttcgattattgcactacccaggtcaacttatttcatgctcctgtatgtcatatgacattaaccaaagtagtattctcatgatatgcagagaaatgctaaaaacatgtgtgctggtctttaggttgcttcttgttgtgttggattgctgataattgccaatggtttctttagctctgatttattcaacaagtttatttatttcaaacatgaatgagtgcactatatgtcattctaaagaatgaagaacttgatatcatcctattgttgtggtattgtcgtgtgggtgctcagaaacattacaaatctgtccattacagtgaatagggaaattgctactttcatgatcgcaattataatctttttctaaactataacaatttcatttgttagctaaaacttgcattgaagactacttttcagtttgtaaaaatatcttaactgttaacttacagtagcagctaatggagcagatctgtgtgatctctattgctaaaatttctcaaagcaactgtcttgctgctgcccgctgtttgctggagcataatgataaatatgttattgtaatctgtaagtcaatgttaatctaagttttaaagataccttaggttgcttcattttgttgattgttttgcttacctgttattatactggaaagcgggatgtgaactgaaaatatcgtgaagcttcttcaagcttctaggaacgtttgtttttgtgagctgactgtgtttccttcttgctgtggagctagttaagcgttgtgtttttcgtccgtactgtagtatttattggttttatctaaatagaaaataattttaaatgtaggtgaagtagacgactctgatgatggcaattatggtgcatcagctcactctgattatggaatgataaccctcctagcaacagacggcactcctgggctacaggtacaacattttctttgcacaataaattcaccaacttagctaaccaatcatgtagacaaatatatggtcagaaggtttggtgaggatggggttatgttcccaccttttaccactttcaagcaaaaaatagctcttgtttagaaaagtaagaatatctgttgtgaatttgcagatatgcagggaaaagaataggaatccccagctctgggaagatgttcatcacattgatgggtaaataaaagtaaataagtttttttaatatattaatggaaaaaaatcaaataaatcattactttgttgtttaatttgctggtctcttgtaccctcagggccctgattgttaacattggcgatttgctagaaaggtggacgaattgtatttacaggtacccttttccttttatttttgatgacatattctgtggttgtgaggaagcctcatgtaccatggttgttaaaaagctcaaacaaaccagttacaattgtgagtagttgcaccaagaactttctattttttgcaattcgacatggctaaatttgttgtatgacacaatgttttcttaacaagaagttggtttaggattgtctcatgaacaggttagaccatttcagtgtgtttttgaaattctataattcttttggagttctgttttattacattatacacttccttttctattttatatctctaagaaagaaaaaccttgtatatgaattttgaatgttctccctcttttgctgacttgtaggtctacagtgcaccgtgttgttgcagttggtaaagagcgatattctgtgagtattatgactgctgaattcagaatttcataattgagagttcttttttttttcctggggaatcaaggggttttgtcacctgctgaatacatgttgtatagtcaggtggacctattcatgtgcaaactatcactgataatatagacgtaacgtttcagcgacttaaattgcgtgcttaatgttaggacctttttggtgcactctcttacacatgttcttcaatttgtcaggcggctttttttcttgacccaaaccctgatttagtggttcagtgtttggaaagctgttgcagcgagtcatgcccaccgaggttctcttcctcctttaggctttagcacaagtctagttccttttattatgcttgcttctcatactgcttgaaatttgattcattttcaggttctcacctataaagagtggcgactatttgaaagagcgattgagcgctacatacaaatagtcctatgctttttcatgtgtaaggcttaacataaggttatttaaattccgttctgatttgcagtgattttttaggtggcccgtggagctacctcgggctcagttcctttgcttggacacttgacagtttacataaaaaaatgtgaattggatctgcatatcttttccaaaaacgcgcaagagaactacacaagttcaagcagtggatttttaggtcgacactaaccgtgtggaactgtggatgcaggtaaaaggaggctaacatgtgctacacggccggccatcgttctccattgtccatttttcttctgcgtttagacatcacagtagtccagaaggttgtttgtgttgttttactgtaacgctgtaaagaaaaagtctgcagtgatgtgctatgcttgatttctctctccactgctcgacaccaacctgaactttttattgtttgtcgttcaaaaaaaaaactttttattgtcacctgcgagctgactggtgtttggactagtattcttgttgacttggtaaagaaactccagtttgatcctgggaggcaagtgattccccatctccatccttcactttctaactcttgacaaagtgaagttgagttgtgatatctagattttgttcatacctgatgaacgcgactaaatatgccatcgagaagattgtgatgtcctgcatggctaacaactgcttgccatatggcttttttacattttggaccttttttaaaacttattttacaaatatatcttaaaaaaacttattccgcctttggtggcaccaatgtcattggtaccatggttcaacatgacggtgccgatgccccctagctttcccaaagaagccaagtcacttgtatgatggcgaatggcaccgatgacctatttgtaaaaaaattgaaaagaacttatttgtaataaaaatatttataaaataagtccttagcactaataaccttgatgctaaggacttatttgtaaataatttttattacaaataagtttttttttgatttttttaggttctcgacggcaatgtcgttggcatcgtgaaaaggatctattcctgctataagtttttttcgaggaactatttgtaaactaagtttttgcaagagaccaaaagtgaaaaaaaaatccactgcttgccatgaccggatccatgagcatgtcaaagagttacaagtgtgtatgctacaacttggtctgaaacggcagcttggtgggtggcggcttccatgacaagttcagaatggtcatcggatccatgcaaaagctcaaactactcatggttcgagccgttgctgttgattcgcttgccggtgaaagctcggaactctggcaagaagactggtgaccaaatgaagtagtatggtcaagcagagatggtagattattttagagcacgtttggtacagctctaactcctaaatttagctctaatagttaagtctggagtggagttgtggacctgcctaaacccagctccacaactctagtttatttggtgagagagctccacccagctacactcccatttggtggagttgaaactgtttggctgagctctaacttcagaaggggtggagctaaagttagagctgtgccaaatagaccggaagtgtcacacaactacacgtacaaagtgacaaatctcacctcaccaaacaggtcaatgacaggtgcgtttaggtattctgcgactctttgcaatgcgtaataattacatgattacatagagacaagcacattaaatatacgttgattaatctcggcatggcatcaaatacaaacacacggacaggtcaaacctgtacagtatgaatagagttacagtgtctactactgcttggtgacaactcaaaaattggttcgtcaagaaattcaggctgatatttgaaaactgcatgggagagttgccaaagttattatacttgaagtgaaagagatgtctttgattaatttcgtccaatgtttctagacacatgcatcatgtatctcaactcctcaaactccaccaaaaatattgctcaaattagtaaactaaaactatacagctagtgtcaacatgttatccaattcagaaacactaattatttctacatgtggcatgctgaaaattaatctgatgcctaacctctcctactgataccaaacctcaagaatattaactgcagctggtctttttctgctcgaatgaatgtagctgcacgcaaggagaagcctatagggttttgtgggcgggcagcttaattgcaagattaattttagtggagaagtacattacggtttataatcagatcttacctgatcaagatcatcatgcttaatatcgttataaaactaaatgcaaaaccgggtgctgagttgcctgcggcttaccacgttgcgacgacatgaatgaaaagagaaaaacatgaggctacaattaatggatttcggacgtcagaggaatctcccacaagttagcatagcaagccagctgataggactaaatatatagttaattcgttaaatttatagtcgtctcaaataaaaaaaaaggttgatcttatgttgacctttcaaagtcaacaattatataagcactaaatttttatcattcatgtattatgtagtatatgttttaagaatatttcactaaaaatatacatttttaagtgtatacttaccgattttttaaggaggtaccataattttcttgttaattttatatatatattaccttgtgatacaataataccacgtaggtagtgaaaggtattaaaatttacgctaaggctatgtttggttaatccccaagagggagggattggaggagatttattccacacctattgtggtgtggaattattccccctcaaacccctccaatccccttcaaccccctctaaaccgaacaaggcctaaaacataaggtgttctccagactagcatcttttgaaggtccaaaataatctttttacttatcaaaattacaaatttaggcagtttttttatttggaaaaatagtacagtttgacctttcaaaaactaggacgagttctatgattagtatgttgggtttttagctgtttgactttcgaaaaagtattttatctacacgtcccatggtgattggacgacttatatatcctcaagcggccggcaaggtcagtcaacaatttttttattcttgaaaggtacaaacaaattgattggcaacgtacgtaattgacaattaagttcgacaagcactgcctttgaagctagcaaatatatatcgtaagtggttggatcatcaacaatttaacgcaaaagcaaaaaaatggacagaggaagattgatcaggggcaccctccacttaccgtttctcaccggacaatagtcaaatagttagaatatttgcctcagctgccaggtcaaagcaaatgatggatcttcatcctctacggagtccacgcggttttttggggtctatgggcctcctgtgatgtgcctcaattctacggtagaccggtgtggctaagtgcacctaatacttccttcatctcaatttaatcatctcttaagatttttttttgtcttctcaaattgatcatcttttaatctctgtctattcgtattttcgtgcataaataaatggcattattctacatgtctatttgtctatgcatgcaggagtaaatgtcatcctcgtatgcctggcatgcatgcaattgcacgtttgcatgcctgatcctatcttcctatatagttgtacccatttagtttacttctataaagtagggcatgcaagaagtcacatcatcaataattctaagccatcgtatcgcattagtacatacttatcagccgttggatcaagaagctactcatccatctaatttaataattgattactcatccagtcacctccctttagattataatcacgtgtgacattgttatccattctttacataataatatgttttctcctcccaagtcctctccaagataatgcaaacttatcttctttatttaatacaactcaaattgttgtataacatgttagttttgttttgttataaacaattggataacatatagtaatcaggcatcattaacccaaacctgttttcgaaacaagctcgagataaaagcaaagaggtgcaaactactctaattatgacgatatccagattgtgcatgaaaataacttttgtatattataacaatacacaataacattttaaaacaaacatgaattgtattgtaatagcagatcgatgctatatatgaagccacattatttgaaacattgattgtatttgatgtaaaactagcaaatcccgcggcaaggcacggggtgccaactagtatatataacatcttagtcgatgaggtttaattttagaaggaataatactttcttacctaggtctcggcaccatttataagtatgatgctcaatttggaaaggagggagtagagtttaactggtagtgctgcggaccatcatggtttaaataatagacttgacataaatgtcgataaattttaaaagttaaaattttcaatgggtaagtgcattcccatattttgggaggtcaatatctcctaatttccatattatggtggccaccaatgccataagggtccctcaaacaataagataggtggacttttttctcttccccaacaccaagacatcaaactagaaaaaaaatattttaaaacaaggtgtaaagtgatgaaaaatatgaaataaaaaattataagggactaattttattttatatttttttaggatttaaagtgtacggtgaggttctctttacttaattctcgttgcaacgcacgtacatttttttatatataattgaaattctcatgattggatggatatatcacagaactccatttgtatcaaaatccgggaattctgtgttagggggataaatatatttgtgtaacaatatagagaccatcggatcaacatggaagagacacgtatgtttccaaactaatcattagtacaaccatacaataggctataatactgataatattatcaaagtaaattttactttgagccactcttataggccaaagtttcacaatggactggaggtagttcatctttttacataacaccacatatgtttgcactttgaccggggttcataacttatgccttgatatctatttctccaagtagtgaaatttgatctttgaaatgttcatatgtagtaacaaaatctatttatctttgaatgttcatttgtaatgaaatcccatttattttgtaggatgtattataacataataatgtacatttgttggttcttatgctatatggtgtaaaccccgatccaaagtgtaaagataggtagctatatgttgtaaagtgaaaaatataggcatgatcctagtccataataaaaagaattggtcaataagagtggcccaaagtaaaaattactctaataataataataataataataataataataataataataataataataataataataataataataataataataataataatatgaaatgacccctacgtaactacttccaaacaacaacaatttaattccatcctccggtagagagaaattatataaattctccaaaacaagggaaatatctctactacttactcaaaaaagggaactgttgaggaagcactggtgatgtggtggtgaagtcgtagttgcatgatttcatccaccagagtttaaatcccagtgcctacgaatattacatatatgcaggtggaatttcaggagaattttagtaagatcatggatatgccactggttttcgtctcttaaagtgtgttaggggaaacatatgtggggtgtgaatatggtgttgcatgtgtagtgtggtgtgtgcatgtatgattgccgtgtaatcgggaaaaaaaagaaaccgttgctttatggtagggtgttcttgacgttatgttggattcaggacctgtttagatgtttaatacactttgccaaactttcataccataagtttagcttagccacggtaccatagctatagctcgaactaaacacttgcatataaaagtgaaacctagctagttatgggtttgtggcaaattaaagtttgaccacgaaccaaacaacattcttaaacagtttgtgtttagtttctgtcatgctgaactgctaggtccagtagttatctgtaatttgtaaactcttttgcagccttctagatatgacaggcactgttttgtttgtaatgatcagttagctccattcatattttgaaactgaaatttggagatcatgtatatggactatggttgacattacaaaatgaatgtagatatgtcaggcacgtacctcgggtacgcatgcactgttacaaaatgaattcagctgaccctctcttttacttctggttataaacaaatagttgacattttggttgatttgaggataaagtttcggtcgagtaagttgtacatcattgtatctgaaaattggtttgcaatctaagttttctgaacaatatcagcacacgatagtggctagctagctactagacagattgtgtacttctggcagctcgaatactaggaagctatagctagtgcactagtagtaaattgttagcaaattagttgactatccaagtaaaggcatatttaaatcacttaagaatggaaggaaatgtattaaacttgtacgacatgtatctatatcctatatatttttaaagtttatccccattaatatatttcttttctctcattaagcaacatcagcttaattatttctaaactttggatgatctatagtccaaattatctccctcctttccgtatcccataaagtcatattaccttagttttatcttttaatgattaatctatattatcttctttttcttctgtcattgaggacacatcatcttagttttacttttaaatgattaacctatatatgatttaaattgttataaactgcaatatcttaattatttatattcttttccatggtcgaccaaaagataaaaattatatagagcatataaagttatatcgtctagctattaattacatgttatttatattattatcatacaaaactcctgcaacaatgtgcggggccttgtctgtcaggttgatgattcagtcaatggtgccggatttagggttcataaagttttttttggtgacggtggtttagaatcttacaaaagaatgaagatggtggccgatgctcattcatgttttgttacatgtgttagagttgctcggcattgtgactgctcgtctgcttactcgcggaatttcaatatttacagtttctttgttctatcttagtatctaactttttcattattttttataacaagaggactattgtaaatttgtaatattctttcctgttctgccaaaaaaaatggcattgcaatgccggatctttgatgaatagtaggggccggccggaaagcaatgaagttcaatttacttttagtaccccgtcatgacccacaaattcaggattttactatgctgcactttattactattctgtcgcaaattaagaacacaaatagtacgtctatgagcaaaagtcaaacagttttttctttttcatgataatgatcaagtcggacttttccccttatttttttttcatcaggccgggcagctccaacatttccatgtaatataaggagggaaggagaataatattgcagaaaattaagcattgacttgatttcattagcccattttgtacaaatttcatttgccaaattgcatccaataacattccttgtcttcataactccgacagcgaatttaacaattttaactagattgagacaacctaaagaaacgctaaaagtaacaaatttattttgaaaacatacctataaaattgtgtggtggcaattagtctatttaatcagtgaagtgcttttgcagaaataacccatcacctctcgcgcgcctactatataaatagatccctcgctgctcattttctcctcgtccagcttcaagctctcaactttctcatcactcgtctcctcgatttatttgtctccttccatccagacacctcgagccggcgatcgatcatccaaaccaagctccgccgcccgagacgacgaagtcgacgtcgccgccgccgccgctcgccgccggcacacagctagctgcaagctgctagacgacgacgtcgagctgatccgttctaaaacatcactataaactaatccatgtcctgttcttgatatccctctctctgttgcatcgaatgaccctatccatttcggccttagctatcttgctataaagctcgtggtagcttgttacctttgctagagttttgaattcctcatcttctcccgccgtttttagctagctgttttgttgcacacgtgcaacacaggacaagacgtgtgtaagagcttggatactgccgccatcgctgccatgtgcgaggctctcgttgaccggcaactcctccccccgtgcggttgcaatggcggcggcgacgtcgttgtcgttgtggtgccgaagacgtcggcggcgccggtgttggaggacaggccgaagacgtcggcggcggcggtgagcaagggcggcgaggcggcgtcgatcctgcggctgtcattgccgatgatcatgacggggctgatactgtacatccggccgatgatctcgatgctgttcctcggccggctcggcgagctcgcgctcgccggcgggtcgctcgccatcggattcgccaacatcacggggtactccgtgctgtccggcctcgccatgggcatggagccggtgtgcggccaggccgtgggcgccgggaacctccccctcgtcggcgccaccatgcagcggatggtgctcctcctcctcgccgtgtccgtgcccgtcgccttcctctgggcgtggatggagccgctcctcctgctgtgcggccaggacgccgccatcgccgccgccgcgcagcgctacattctcttctgcctccccgacctcctcttcctctcgctcctccacccgctccggatctacctccgcgtccagtcgatcaacctgccgctcacggcgtgcgccgcgctcgccgtcgccgcccacctccccatcaaccacctcctcgtctccgtcctcggcctcggcatcgagggcgtcgcgctcgcctccgcctgggccaacctcaacctggtcatcttcctcctcgccttcgtctacgtctccggcgtgcaccgcgacaccgggggattctcgctgccgcgcaagatgttcaaggacgtcgacgggtgggtgcggctggtcaggctggccgccgagagctgcgccagcgtctgcctcgaatggtggtggtacgagatcatgatcctgctctgcggcctcctcgccaaccccagggccaccgtggcgtccatggggatcctcatccagaccacgtcgctgctctacatcttcccgtcgtcgctcagcttcggcgtgtccacgagggtcagcaacgagctcggcgcgaaccggccgtccgccgcgcgcgccgcggcgagggcggggctcgcgctgagcgccgtccagggcctcgcctccctcgcgttcgccgtgtccgtgcgcggcgcgtgggcgcgcatgttcacgccggacgccgacatcctcgcgctcacggcatcggtgctgccgatcctcggcctctgcgagctcggcaactgcccgcagaccaccggctgcggcgtgctccggggcagcgcgcggccgagagacggcgcccacatcaacctcggcgcgttctacggcgtcggcacgccggtcgccgtcgggctcgcgttctgggcgggcatggacttcagggggctctggctcggcctcctcgccgcgcaggcggcgtgcgtcgcggtgatgctcgtcgtgatccagcgcacggactgggacgtacaagccaagctcgcgcaggtgctcgccggcgccgcggccagtggcggcgaccacggcgtcaacgaagccggtgggaatgacgcggtcgcgcacgtcaaggtcgcggcgccccacggcgacgaggactcgagcttgctcatcaccgtgagcacgtagctgaccggagcaacgccgtgacaacgacgacgtacggccatgtctacgtacgtatgaaccacggtaactagctactccctccgtcttaaaatataatcatttttagctatgaatctagacaagtatgtgtctagatttataagccaaaagttgctatattttgagacggaggtaaaagtcattgtgtcgtgtgaaagcacaaagttcttccggagtctgaactctgaacattttttttggcagttcgcatgagttggtcagtgtatgtacggttatacttatacacttaattatacctagtatatagtgccatagttattgcagaaaaacacctgagcttaattttggtgaaaaatagctcggtgtttcctgtaattacatggccttcatagaacagtattaggtggtgttgagcgaactaatcagcacctagttaattgtcttcggttttagtaggtggcctgaggactcgtattttttgtatattttattcttttccacaagttatgtattgtcatgggtatatatatacttgtatatgtacacacaaaattgaaaactaagtgaaatttcggtgttccttttatattttgttggtacataattgctgtagtacaattcacacagatatgatgaaaattagtttagtagatggatcatgtacgccctcattcccagcgtgaaatccaaatagttatgaattttttttaaaaaaataaaagcatgtattgttgttgtgtactatatcgatcgaccacacaaacatccctgttaaatccgttcattcatcttttttttctcaaacaagcaagataactgcctgtcattttttaaaaagagaataaatgagttcatcttgtacacaaaattttagaaatctaactgtaatgtgactacacactttttatagtctaattttaattgtctctccatgtgtacagaaaatttaacatcttttttaggggagggatatataaaatctttattattagaagtttctataaccattgttgaccacatgaaaacaattgatgtcacatgcctaaaattgtttaaaaatagaagttctaatggaagatacatatccagttttcatacatgataactagtcaaactagtcaaattactcatgcgttgcaaaggattatccaaatagacaaaaaacaatttgaaaaaaatatttatctctagttgattatattcaaacaagattcttcatgcatcttaaaaaaaaaagtataccatctattttgaataggtatgttagtacactaacttcaattaatgtacggaatcttatgatcctatatactcactagtaaccatcatcatcaagagttatttgaagtagtatatataaatccgtgtatccaacagataagaaaactataacctttatgatgggacaaatgtagtataaaaaaaaatgctattggacataccataacaatttgttatgtaacaactaaaacagtaatctattagagcgtctgtatacaaatctacaatatataattagttgcatctcaaactcaattcggcctccgttcccatagcttccacggtagcttaagcagaatctaacaggctaagaaaaccttcctaccaccaagctagctagcgatcccggccgccaccttaatcctatcttactataaagttatctcccactaactccttaagtttaacatgcaaagatgccacatcatcatccactaacaagatgccacatcatcatccactaattaataagatgtcacgtcatcatccactaacaatcatcacatttaaacattatgcaaacatgctatatctttatagtttttataatttaagagctttttaaatacaaacatgttaaattatcatctaacataattcacataatgttttaatgtatatcttcatattaaattcccgcagcaatgcgcggggtttcacctagttaatcaaatattaaaacccaatttgtatagcaccagagttaatattgcaaagtggagtcgtaggtgcatgattccattgctataatttaaattatagttcccacaaatattaaacgcatactctctcctttttaaaatgtaagagattttggaaggatgtgactcatcctaatattacgaatctggaatatgtcacgtcccaccaaaatcccttctattatggggcgaaggaagtatgcatgtagtaatgtacttagactttcaacatgattttaataagatcagggattttaatgtgttagaaaacgtattcgtggagtacgagtgtaatactgttacgtgtgtaatggtatgtgcatctccgtgtaattgaaaaaaaaaaattaatgcaaagtataccggccctatagtacgtaagcgagaatatatacgtacgtaggcgcttacgcacgcgcccacaaacaaataatcaggtggcgtctgatcattgccactgttccctacgtaggcggccggcgtcgctgtcgatggcatgtcggccggggttgggtttgctagctgcaggctgtcttcccggccgccggcaccgtacccggccacgcgcgcgcggaggccggtgagaacggcggcgcgtagattagattgtccgcttcctcccatgccgccgcggcgccgtgtcgttggaattcgatcgagatcggctgtgtcggcaagttgaccatctatcgatcggcaattcggcatcgacacgacgtacgacgacgacgacgccacatgtgcatgcttatggtgaactactccctccgtcccataatataagggattttaagtttttacttgcaacgtttgaccactcgtcttattcaaaattttttaaaattattatttattttatttgttacttactttattatctacatcatcactttaagtacaacttttcgttttttatatttgtaaaaaaatttcaataagacgagtggtcaaatattgcaaataaattaaaacttaaaatcccttatattgtgcgacggagggagtacctagcttcgtcgcatatgcagccgtacgtatatgagtacgtatacttgcgttctcacgtcacatcgtccattgcaggctcttccccgctgcttgcccactggcgtgtgggccctaattagtgtgcaacagcggcttaggggcttaggatgtatttagttcacgctaaaattaaaaatttgattaaaattaaaacaatgtaacggaaaagttggaaatttgtgtgtgtataaaagttttgatgtgatagaaaagttaaaagtttgaaaaaaattttggcactaaacttggccttagttatattatggctagtcgatgcaccatacattaaaaaaaactatattttttttacaagtacaagtcgaatatataccactaaatacaagtgccaactcatatatattacccacctatatatattatgtccccatgcacacacttatatagctaccatgcatataaacaagattagaggccagtctcatatagtatgagttttggccatcaaacgcgtctacatgtatatactgaatttctcttgctctctagatttggcagttattacttggtcaaaaatattttggtttcttatataagcctgatattaaatgtcactaagaattactctctcgttcacgaatatatactcgtcaatttttatccattttatttattggcaaatatttttcacttcatgttttcgaatgtatttttttttctcatcttactcattaatttcatctttcatgttctctcaaccacacatttaggcttgttcggttaatccttacccccatgagattgaagggatcaattttacacctattaaattgtgaaattaattctcctcgattatctccaatggttctagaagcatctagctagttagctttgaaaggtactccatatcatatatggcgatataatatgaaagcaaatgattacctagatatatcgatccatgttatggtcaaaagtaataattaagtagttatgaacgaagggagtatattttttaataaaaataaaacttctatcatggaaaatatattaatatggttatctctaacaagtatatatattagtaagcaatatatatactagtacatagcacacggtgtctgaacatcgacatatggagagcttgccatcgttttcgcagtactggctgtgatctaatttacaattattgctcaagctacaattggtgtttgctctttgctttcgttaacctgctgccccatttgcaagttgtttgttgtatattttctgtaaaaccaatcatgtgcgtcatcagcatataattaacaacgcacataatatgaatagatcgattcgtctacgtattgctgcatctttgtgtactttgaaaaagaatctagctagctgagatgtacgtacgtatggaaaaggattccgttgttatattaattccacgctttcgttttctcaactgtaaagcttgtcaatgcatgtcagcgtcagttgtttttcccttagactactgtaggatcgaacacaaaaaaccaaacttaccagaggggggtgaaaggggggtgaatggtaggaaaaaccaaaaacccaaaaacttttagcggaaataaaagttaccctcaaattgaaaatctcgatgtagtcctgtcgccgccgccggtcggacagctcacacgccgccggaacccaaagaaacacaaatcgaagaactctcaaagtagatgacaactttattgcttctctctatttttacaaagtgcaacaacagcactctttacaaaaatctcgactaaactcgaaaccctaactaaactatcaactcaattgttctcaaaagcgataccgggaagcctcacgctccctctctatttataaaaaaaaaaaactccctactcaaagtaggtgtagaactcctattcacaatagaactcaatccctgatattccaaatcttcacaatttctctaacaaatccacagccacatccaatcggactgcctccgtcccggtcgtcgcgatcgcctggccacctgagccgactcggcctgccatctaaccgagccgccgctgctgccaaccatcggcatgcatacatacatgtatcagcatgcatatatgcatacacgtcacgctacagtaccacgagtactgtagcacatatactcatcctccaatttcttaaccaatttcctcctcgaacaccgacgcttgcatgcacacctcgtgaagcccgttgcgaagatcttttccacacgatatccatccaccgtatgctatctcatatccaacttcgtcacccggtatccttgaccgtctggacctcaactcctccctgagtctagtcccgatccccaccgttgaccgaagttgatctccaagaatcctgactctagtcaccttctcacatggtatcctgaccgcactagacctctgttcctccttaaaacatagtcccgttcctcaccattgaccaaggctaacctcaagtcacctgcacacaatcagacaaaacaacagttcctgggcacagatatcacaacctgacccacattagtcgcacgcactcacaccaacatccacacatactctcaaaccaattcattgattaaatcatttacaaaaccaattattcatcacaaatattaatcatgacaataatttcacaactacttcagcatatgacaactaaaaaagtgcatgtaacatatgcagagtaattaattaggcattttgatgttataaatgcataatgcagaaggaaaaatggtgcacaaattactgctagctgtgagagtaataatccatacaacgactatgagcacatcctcaattaactcgctctttttgagaaaaaaaggttggtcgcttaagggtaaaatgttacactggaatagttctataacctcatctcgttccagctgatcttccgtggctgcaaatatatgtgcggtatgtttgtgctttttgtatatatgattatttgtttatagaaaaaatattgcatctttgcatattttttttcgcgatcgtaaaaaagattgcacgtcaatatattacaataaaagagtttttgttacacaatgcaatttgccaaaccggcctatgccaagggaagggagaaaacaaagacaaaaaccaaggaagaaaaagaaaactcatacgacggataaacgctactccaatcagcgggatggggagggcgggaagggagcagagccatactacactcccaacaaatccccaaaagaagcaatgcctgctaacaaccatagatggccctccaagaggatggactctagaaccactaagaccgaagagagagcgcagagtcgaaaatcctggagctccgttccttctacagttaccaagagaccaagaggactagggagtcaaagccggcacggaggtgcttaggtaagcaggccctagaagatggccaccagtcctggtgctagctgccacggaggagagagagggcaacccagccaggaggcgacagcacccgtagctagacctgtcgagcgaacacgcagtcgaggaggatgtggttcgccgtctcaagctcctgagcgcaaaaggggcaggccgagtggctatcgatgccacacttccgaaggagatcagccgtccaacaacactgctgaaatgcaaaccagaggaagaatttgcatttagcataacccttcacgtgccagagaagatcagcacaagcaaaggagtgctggccatagaataacgcctggtacgctgaacgtgccgagtagcgttggtcactcgtcaagcgcgcatctttgcatatgaatatacatacacacatttgaggaaattttatttattatattttatacttaattagtacattaatttagtttgcattgctacacaagaacgctatgctggtatatatatgactgctcacctatatatatgatgcaaacagcaagttatcacgaaattagtctcaaaatatggaatgtatatagaagaccatgtaatttgtaagagagatgtgtttaactttttaaaaacttcaagatcacacaaccccttcaatcttctcaaacacaaaatagttacaaattctctgccaaaaaaatccacatgcactagaggcaaccaatttttttttctcaatgtgtagactttaaaattttacgagtaaagcacaagacctgttcctaaaattaaagcgaggttatattcccaattttaggccctatttagtttacgaaaagaaaatttttgggtgtcacatcggatatttgaccggatgtcggaaggggttttcggacacgaatgaaaaaactaatttcataactcgtctgtaaaccgcgagacgaatcttttgagcctaattaagcactgtagcactttatggctaattatggactaattaggctcaaaagattcgtgtcgcgatttccatgcaaaccgtacaattagtttttgtttttatctatatttaatactctatgcatgtgttcaaagattcgatgtgatgtttttaggaaaaaaattttgggaactaaaccaagccttgcaagttcagcatttaggtcgataatcctatatattttagagtaccactgctctctactagtagtataaagtaatccaaaccattgatcttatttgatcgaagggttaagatctatttctagctactaccatccaacttaacaggagtagaaatatggaggggtattattgtcccgggaaaaaatatggagggggtataatcataatttatcactgattaaccctagcggccattcattcgatccttcctcacgccgcgatccaatttctcgatggaatctgtatgtgtttgatgcgtttgagactgttgaacactggattcaagtcatgatgcatgccagcgattaagctatgattatcgtgactagcgtgaaactccggtgattatcgtgactagcgtgattaagctatgccaccgattaagtcagatccaagggccgatgccagcgacctgctgacccgtgaggggaaaaaatgaaaatggctaagttaccctcgtaactgtgttaataagttactattttatccttaataagaaacggttcagatctttttattggtagtataattctaactaatagaaaacaccgaagtattgtcctatatattttaatgtatcttagcaagtccaaaacacatttaagtgggtttgaccgtcgatgtgtggctgtatgtccaccatgactggacaatatttgcatttagctccctccaatgtttgttcgcaccggtgacgccgcatcgaactgaccggccggccggtcaaggaagctgcagcgaggtagcaccgtagcagtgctcctgaagagcgcgatcaccttggtctccttcagaccgagctacataataaatcaacctcacaaaatatgatgtatactaacactacaaatctagatatacgtgtattcaaatttttagtattaggatgagtcacatttcgtatgaggttatgttgagattcttaatgttaggatgcatcacatactgtatgaggttatgttcagatttttagtattagaatacgtcacatcctgtacgaggttgttttattacaggacggagcgagtaggcgtcatccccctagctagctggcccagcgatcaagtatacgtaaccgcgcgctggcatggactgctgctgcctggagtgtactgtagcggcgctaggtggctgtatacttgaagcagtacgtcgatcgtacgtgttgtgtacgagtgcttgatattcatactgtttttttgtttctcatgccatcctgaaatagaccaaacagtaattaatttatgctttgtttgtttgcttccgtaggtagcttaaaaagattatataatgaatatataatcaaataccacagtacccttctagaaagcaaatacattaagctatgtatagtgtatgtactactactccgtattagctagctagagatcgatctgcagatcagatcagctgtcacgcgtggcctctgacgccttgaatgaggtaagttaattaacacttgttgtaaaatgtaaagagggcaaccgcggcagatcgatcgatcgatcgatcttcagaataatgcgatcggtgcctcagttccattggctatttctgatggccggctgggccgggttgcatttttgcatctaatataccagttcagaaaccaaaaggatacatatctttttgtactatcaattattattctgtcatgtattccgatgtgctgcatatcctatagcatttgcccttcgagctccgaagagactggccgggatcgaactaatttacacagcaaatgcagagggtaataattaagaaacactgcaatctatagtattatacttcatgctggttgaggtgcatatcgcttctatgcctatatctaactggtactgtaagttgacattttgatgtctcatattgaaaattctcaagggctcaaaagtcccattttttaattggttgaccatgcatgaggatgtacatagcagtgggacatggtcagagatgatctagatggatggcaaactaggggctgaactgtctactacctgcatggttacatgccagcacgctcacatgaaacctgcaagatgaacaagactaaccaatgatcttgtgtacaatgtacggcttcttcatgcgtgtaccaatggggattcgctgactagatggcggcatacattttatgcgagagaaacctttaattcgttcagagtattcagtgttgtgccatgttcaatgtgtaattattctactaccatgtatagatgccaaggtttaatataaagtatgtatagtccactggcttgatataatcgcaacataagttatagttcttctccgaacaaaccatatataaatagaaaagtagcactgaccgaatgtgctagttttttacgcaaacacgcaaaagtcttgcgtgcaatctatgtattagaaggtagaaatagttgcatagacgatgcaaccaatgtagcagttggtacggaaaggggtgaggcggggaaggcttcatgtgccacagggaggatattacaatgatgcaacctcctataataagaaaaaaacagaaaaatcacaaaggtttcgtgccttctataatctatttgtgtttcttgcagtatcaaatcagttgttattggataatttattttatctaagtttgaatatttttaatgcaatcttgtaagtatttatggttataattttatttcatgtaatttatagggttagataattattagtcaacgttttttattaaatattactcaacattttaggtaataaagatggtactttgtttaaataaatttcaagagtgatgagaatcattggattccatccaaggagagagaaaaatggcagaatttttttaaaagttcagtcacctaaaatctagacactacttaatacatactttctccatcaaaaaaaaacctaacctagtatgtatataggagtctgaccagattcattgtactagattatgtcccatttcatacatgttgggttttttttgggacggagggagtcgatcgatctgaggcaaatcgtttatccttatgctatttttgcttcttgacatcacgaaagccgacgaccctcagttgtgccgattttgcaaattttctttatagatacgtcatgtatatagcatattcatgccaacgtatacgattataactccaaatatatagttcatctttaaattagttaagaaattgatttcccttaaataagagatgaaaaagaagtactagcgtggccgtcatgcatgagatttccctgacgacgtctagcatatgcctattattgatcgtttatgtacatacacgcctgtgattcttatggacattcattgattatattgccgtctcacctctttttaattggttgactagttaaggaaaaaattgtagttatatgttacttttttagcatgctacagtacttaaaaattacgaaactcttacaactaacattgattttaaccaaaacgtattttgcggatgttagggtttcggcgacggccgggcgaccggccgccggcggcttcacccctagtgtggagttggttctggatggagttctactccgatctgttgttgggttatgcagggtctgcacctgcgtttggtaaggctgtgacgatcaggtctcacccaaaggtgggtgatccggtggattggttgcttcgggggaaaagtaaacctgtaagtttctggataaagcggatcggagaggtgctttcctatggtgtgggtaacaaacctttgattcaccatacagatcaagggccgattggctggggcagatatgatccatattggtcttccagagtgggatcgtatcggaatcgaactctgccggaaatcaatataaagtgacgaactggctctggtcgtggatttaagtcacaactagcttggcgaaaatacaaccaaactgccttcgcgtcttcgtttgtgccgatcacgtgatccaatctatggcgtctgaagtcggtgggggcgacaaagggatcgtcatggcgacggttacccgcccgaagccgatgacggatggcagggttggatcgtcgagtttggcgctggttctggcggaattgccggcgccgaatcaaggagaggtcttggctgtggcagggaaggaggcgggggagcccaaacagaacctgatccctggaagtacatcggttgtggctgggactccaagggtccggcgactcacatagaaggtgatatactggaggatgaagatgacgtggttgaagtcagtcttgatgcagatgaggcaaacctggtggggcagtggaccgtccttgctcgctactactctttgaagacgccaaatcagaatgctctctttgatgacatgcgtcgagcgtggagattgagggctgacatgaattacaagtctcttagggacaacctgttcattgtttccttcagctctgaaggggattataagtttgttaaggatggaggtccttggttacatcgaggtgatgctcttttggtggcagagtttgatggcctgacaagcccatcgcaagtcccactggaggtggttccaatttgggttagaatctatgatctcccgttggttttgatgacgaaggataggggaatcttatatggcagcaagctgggacatgttcgggaggtggatgtggaagcagatgggcggaacaagcatgatttctttcgtattcgagttgatctccccgttaatcgtgctttaaaaacacacatagctatcaagatcaatgtccaaggcaatgaggaggtttgagctgagatatgagagagtgccgcacttctgttttttctgcggttttatgggccactctgacagagaatgcgagaagaagctcactaatccagaccagccgttcagattctcggcggagctgagatgttctcccttgaaggcctttgagaggaagattaacacagtgaaggctgtgcaaagctctggggtggctaggaaactatcgtttagtggagcgggcagtgctagctccacttcatcgagacataagaaggttgagcaatgggatgaggcagttcctccaaggatggaggcttttgatggttttgaattaaatgagaaggaaggggatgctaatgttgacctgcagcttgccgatcagacccgcaatatgcaggtgtcagggggtggttctcaggatgccgaaggcctcacaaaaggaaggaaaactaaacaagctagaccggcaccttcaggtgatctggtttagtcaacggggaagctgtcgtcgggagagatgatacctgcaatgagggagttactccaacaagcgtcttttggtgaagtctccaccgaggacactactagccttaacaagaggaggtcgcctgattcgggaactaagtaggagggcagagtcaagcaagctgctttggagtacacacaggcaacaggggaaggaaagcagatcattgtgaagccggtctctgcaggaagagcactgaagcgtgtcaggaaggaggcaacgggggatacacagatggaggatatggaagcaaccagctcgggggctgctggtaaactgacgggtcccatggcggggtcctatcaggagcaatgaattgcttatcgtggaactgccgtggcatcgggaacgccacgacagttcaagagctttgtgccttggtcaaagaggccagttcccaatttgtatttttatgtgaaactaggcagccagtggataagattaagcgtttgcgtaatagattgggtttgagaggttttgcaggggttagcagtgatggaatgagtggtgggcttgctcttttctggcatgagtctgttcatgtggaaatcttaaataagaatgaaaggtttattgatgcttatattcgtctgtctcctaatgatcctttgtggcatgctacctttgtttatggggaacccagagtagagaatagacacaagatgtggtcgttgctcaactcaatcaaacaatcttcaaacttgtcgtggctagttataggggattttaatgaagctttgtggcagtttgaacatttctccaggaaacctagaagtgatgctcaaatgcaggcctttagggacgtgttggacacatgtgagcttcatgatttgggaatttctgggttaccacacacgtatgataatagaaggggcggctggaacaatgtaaaggttcgcttggatcgtgctttggcagatgacgagtggagggatttgttcagtcagtaccaagtccaacatttggtttctccctgttctaaccattgtcctattgttcttaaattacatggttctgtcccagatcaggtctgtcagaaatgtctgcactatgagattttttgggagagagatgcagggatcagcgaagtagtttcggatgcatggaacgaaacagggggaagtctgatctgggggatatctctctgtcactgaggaaagttatggcagcgctgcagtcttggagtaagaaaaaatacaagaatattggcagagaattggagaaaacaaggaagaaactctcaaaccttttagaagctggaactgataaagctgctatacggcaaacctcggattacatgaatgaattgttgtatcgggaagagatgttgtggcttcaacgatcccgcgttaactggctgaaagaaggagatcgtaatacaaaattctttcacaatagagtggcctggagagccaagaagaacaaaattaccaagctgcgagatgctgctggtacttttcataggtcgaaaatggtgatggaacaaatggcaacacagtattttaaagatatgtttactgctgacccaaacttggatcattccccggtgactagattaattcaaccaaaagttacggaagaaatgaacaacagattatgctctgaattctcagaagatgaaatagcaaatgccttgtttcagatagggcctttaaaggcaccgggtactgacggctttctggccagattctaccaacgtaattggggctgcatcaaaaatgatatcgtgagagcagtaaaagaattcttccattctgggattatgctggaaggggtgaatgatactgccatcgttcttattccaaaaattgaacaacctagagacttgcgagacttcaggccaattagcttatgtaatgtgatctacaaggttctgtccaagtgtctggttaataggctgaggccttttttggatgaattgatctctaaaaatcagagtgcttttgttcctaggagaatgatcaccgataatgcacttcttgcttttgaatgctttcatttcattcagagaaataagaatccgagatcggctgcctgcgcgtataagcttgatctctccaaggcttatgatcgcgtcgactggaggtttttggagcaatcaatgtataagtggggtttttctcattgttgggttagttgggtcatgacctgtatatccacggtgagatatgcagttaagtttaatgggaccctactgaacacattcgctccgacccgaggtctgcgacaaggggacccgttgtgacccctttctctttctgtttgtggccgatggtttatccttgctacttgaagagaaggtggaacagggagctatctccccaatccgggtttgccaccaagcaccagggatctctcatctactgtttgcagatgacacactgttattcttcaaggctgatctttcacagtcacaagctatcaaggaggtgttcggcagttatgctactagtacaggtcagctaatcaatccaacaaagtgctctatcttgtttggtaactccttgccgatagcttctcgagatgccatcacaaactgcttgcaaattgcaagcacggagtttgaagataaataccttggtctccccactccgggaggacgaatgcacaaaggtaggtttcagagcttgcgagaaagaatatggaaaaagattctacaatggggtgagaattacctatcgagcggcggaaaggaagttcttatcaaggctgtcatccaagcaattcctgtctatgttatggggatttttaaattgccggagtcggtttgcgaggacctaacaagcttgacccggaatttttggtggggagctgaaaaggggaagcggaaaactcactggaaggcatggaaatctctcaccaaatccaagtctttgggtggcctaggtttcaaagatatccgtctgtttaaccaggccttattagcaaggcaagcgtggagactcatcgataaccctgatagcttgtgtgcacgggttttgaaagcaaaatattatccaaatggatcaattgttgacactagttttggagggaatgcctccccggggtggcaggccattgaacatggcttagagttggtgaaaaagggcatcatctggaggattggtaatggcagatcggtgcgcgtgtggcaggatccttggctgccaagagatctgtcaagaagacctatcacaccgaagaataattgtagaattaaatgggtggctgacctcatgttagacaatgggatgtgggatgctaataagattaaccaaatcttcctgcctgttgatgttgagatcattctaaagctgcgcacctcatctcgtgatgaagaagattttattgcctggcatccggataaactcgggaatttttcagttcgcacagcttataggctggcagagaattgggctaaagaggaagcaagctcgagttcctctgatgtcaacatcaggaaagcttgggaattgttatggaaatgtaatgttccatccaaagttaaaatcttcacttggagagcaacctctaactgccttcctacttgggacaacaagaagaaacggaacctggagatttctgatacgtgcgtcatctgtggcatggagaaggaagatacaatgcatgccctatgccgctgtccgcaagctaaacacctctggttagccatgaaggaatcaaatgatctgtcactaaggatggatgatcacttattaggcccatcctggcttttcaatcggctggccttgttgccggatcatgaacagcccatgtttcttatggttctgtggcgaatttggttcgtccataatgagatcatacatgggaaaccgagcccttcgatagaggcttcacaacggttcttacagagctatatgaaatcacttttagagattaagcaacatccttaagctaatctggagaaaggcaaacatgtggttagtttcataccgaacagtcctgttggtcaaaatttcagacaacaggtgaacttgaagaaatgggagaagctggcgctagggtggatgaaggtgaatatcgacgggtcctttgacgcacaggttaataaggggggaactggtgctgttctcagagatagtgatgggaagattatctttacgtcctgttcctaccttgattagtgctatagtgcgctggaagcagagttgctagcttttaaaacagggattgtgctgtccctgcaatggactctgttgccgttgatagtagagactgattgcctggtggctatccacatgcttcaagcagatggggaggataaatcggacctagcttttcttgtccgagaggtgaaagatctgttagctggaataagggagattaaaattgtgaagggccatcgtgaccaaaatcgtgtgagccatctgttagcgaataaggctcgctgtgaatctatttcagatttttggcctaagaacacttgtaatttcatctcacattttgtctgtgagtagtaatatatctccctttccccgcaaaaaaaacattgattttaaccgtttgatttaaattactggaaacagaaaatctaaacatatgtatcaactttagtaatagtatagtacagaaaatgtaatacttgtaccatcttccattttttcgaaagaaatataaagagagtatgtgctgcgatcgatacaatcatgcatactccctccgtcccgtaaaaaatcaacctagtattgaatgtgacacatcttagtattacaaatctggacatatctctgtccagattcattgtactagaatgtgtcatatccaattttagatttgtttttggacggaaggaggacaatatttgaattgaaaccaattgcaagctagccgagactctagctaaccataggtcttgcccgtttgttctttatttattagatgataccaaatactgcagatagtaggggagtggattttgatccctcaaggggatgtccactccttatttgcatgtcatttaaatgattataaaaaaattaagaagatatataaacatgtgatatatcactctacaaacatgcaagttcaaattcaacttctacatcttacaacaaaaaaacaaatttgactatgaatatactttaattagctgtagtttaatttatttttttcattgcaagatgtagagttgaatttgaacttgcatgtttgtgaagtaatatatcacatgttaatatatcttcttaatttttttttcaaattgcttcataatcatttaagtgacatgcaaacaacgaggagatatcccccgtaggatcaaaaagtttccctagatagcaataaccaccaaattatgtccatgtggattactagtagttctaagagatgctcgcgagagctgtatatatcacatgacccctaatggattagtaggttgttctttcgtgtgcttgcatgcctagctagctagcttcaggggttgtttggttgcatgccacaagttgccacgtctaaagttagtcatgccacggttttttagctattgtttggttcatgacacaactgtggctagccacacattttctctatatggccccacatgtcatacactagtattttttgctaactttggctaagttgtggctagtattttgctaaccacacattttgtggcagccacaccttgcctaatatgggatttggcaaagttagtaagcaaccaaatatcccctggtgacacggcccattccataggcacatctttgaggcatcctttcaccttctcatggactacagataaagaaaacataagacatagtatcaaactgaacgtcgcaagagcagaccaaattgatcaattggaccaccactacgttggtacatagctggtagacggcgctgacaatctaccttgaggcacccaaaaaaggagtccgcactctactccttctaatgacatgggagatatggtaggagagaaaccagatagtgttttatcacaaaagctttcggcaattttcctcgcagggaaaatctagcatgaggcgaaaacttggccaacatgagcaaaacgactcacacagcttataccttagttttcccatttacctttgttagtttcttttatctatacagaatttctttctactatattcaataaaaattggcgcactctaattaagtgttgatttgtaaagaaaaaaaaagcaagaactgcaacacgtaccaatgcatgcatatactattttacatttagtccatatatttttttttcatataactaaattaaacttgatactgtggaaacactgttgttttcgctaattaattaattgcattgtcattttctttgtgagttttgaacgagctgagcagaggcagttgtacaatagtctgccaccttaattcttttttttttcgggaaaaaggacttcattaaatcacatgggacaaattacagtctttttcaatcaaccatgaaacagaattggactcaaacccagcccaaaagcctgagtaatcgtcccttctagctttgtttgctaattcatggctaatcaaattttgttcccgctggatcttcgtaatagaagtcgtcctttctcctgatcgaagccatcttgcttctctgactagaaacgccagggttaagcagtcctccttattagtgagtagatgcacaactgagatgcagtccgtttcaattgcaaccagcagcagtgtccattgcagtgctaaccgaaggccctccacacaggcggcaagttcagtctctaacgctgaagagcagtttgcaagtgacttgcacatcgtaaagatggtttcaccattgtagtcccgaagaattgcactgatcccagcactaccatcggactcaaggaaggagctatcgatgttcagttttgccaatcctgagggaggtcgtttacagcattcttttggcttatcatccttttgcgtttggcaaattgtgtcgccctggatcttcttccgatccccttcaccaggtcactcctttggccattctttatcatcagcaaggattggacatagctttccaagaaccttttcaatgcacttatgggtgttggtcttttatcgtgcactatctcattatgaatgtaccaaattcgccacaaaatcatcagtatacgcataccatcttctgccgaaactgtatctagcaaggctaacaaccattctgggcctgtctgccaccttaattctgcatatatagctgtcctgtgcaaatgtgcaattaattggtatagatgtccaagcatcagcaagtatatcttgcagtgcaacacggcgacaaaaatgtgcgtccaacgcaaccattgtacaatgaagaagaagtagaggccacagcatgcaagatatatccatttgcaatgccatgaagaagaagaaacagctagctaccgatgctagttaattagcttgcagataagggtttgaccagcactaattaatcaccacctacaggaagtcagaaattaaacaatgatacttacccccaaagcttagcagaaacaacatgttacagctgtttcaagcaccaagaggccaacgcccacctaccttacctagcttgtttttaatcaagaaactgacgatgtcccacgctttgttgcgggatatatattagataataaaaaaaaatgatgaaatgatttggattgaaacattataaaaatgatttaaaaatgatgatttagcatgtgtatatttagttatagaatgaaataaattatatatataattattatatacttacatgttaagcttttctttcttaatgggttagtgtagcatgtaggttttagaagctaataaatattatgcttgcatgctgagctttagatgtttagggtgtattagctttatagtagaaagaatggatacaagctgctcttgagccggccggccggcgcgcatgcatgcatcgatcatcttcgtcgtcaaggcgatcggaacagaccagtagccgtctcttggaattcctttcaacttaattatacagcttacttagaattatatcaaatattaatgcttaaagagtaaagatagtactcaagcaataaggtggtcatattgtgttgaaaaccattatactttcggaatttgttagaactaaatcttcagttatatactgattatatactgatacttgatcttttgctcgagacatcattttcaggtgtcattaatttttattttcatgtattagactgagatagaaattttttacctcaaattaagtattaagtatagtactctctccatcccaaaatataagcattttttgactttgatacggtctccgagatgctactttgaccaataatatatataaaagtaaaatattttaaataaaaagaggctgcatattatgatagtttgttcagtaataaatctagtaacatcaattttatatgattgattttatttttatttttttactattaatagttaaagtttaaaatatttgacttgtcactattctaaaaatgattatattttgtgccggagggagcagtagtcaggggttggagccatcgcccggctagctcgggtggctgctcgggcgtgccggcgaaaactccaataaattttaatattgataagtaaatcgatgatgatatttttatagcaaatactagcaaaatctttttggcttcaccactgatagtaattaacattacggcccctcttgtgaaaaaaagacgaagggcttgttcactttgctactattttcaaccttaacaagttttggtattgccaaattttagtaaagttgctaaaattttagcaaaattatcaaattttggcaagatttcatatgtacttattaaaatttggcaacaaattaaatgtagccatttttttagtaattttgcttaaaaaagataatgttgaaaatggtagcaaagtgaacaagcccgaaaccctggtttgagacgtgagaaaaatcttctcttcactcacagaaattgaaccgtttccaatggaatccgcacgaaaatctcgtgaatagcatgagtgagtagtcacacacacatgaacacatactgtgcgctgagcctcggcagggagcatcgcgcggcgcgagcaacccgggggggacgctctcgtactgtaagttgacattctgatgtctcatattaaagaattcttaagggctcaaagtcccattttttatttggttgacaatgaggatgtactagtactgatgcatagcagtggagcaaggtcagagatgatcagatggatgacaaactgggggctgaactgtctactgcctacatgccagcacgctcacatgaaacctgcaagatgaacaagattacggcttcttcatgcgtgtaccaatgaggattcgctgactagatggcggcatacatgtttatcagtttatgcgtgagaaaccttttaattcgttcagattattatgtggtgtgccatgttcaacgtgtaattattctactatatatagatgccaaggtttaatataactatgtatagtccattagttagctagatataatcataacaataagttgtagtttcttctccgaactgcaatctatgcgttagaatgtagaaatagttgcgtacacgttacaactaatgtagcagttggtacgaaaaggggtaaggcgggggaggcttcatgtgccatggggaggatattacaatgtgcaacctcctatgagaaaaaaaaagcgaaaaaataagaatttcttacatgcctaaataccataaaggtttcgtgccttctataatccatttgcgttcttcgtgcagtatcaaatcagtcgttattggatagtttattttatctaagtttgaatatttttaatgcaatcttgtaagtatttatgattataattttatttcatgtaatttataggattagataattattagtcaacattttttgattgaatattactccacattttaggtaataaagatggtactttgtttaaataaagttcaatcattggattccatccaaggagtgagaaaaatggcagaattttttttaaagtgcagtcacctaaaatctgacactctctagtacatgctccctccgtacttctaaaagaagtcgttttggacaacgacacggtctacaaaacacaactttgactttttgtttctataaaaatatttattgaaaagtggtatatgtatacttttatgaaagtatttttcaagacaaatctattcatataatttttatattttcaaactcaacaacttgagagttattcatggtttatattcctaaggtttgacttaaatactgtcgtaaacgactttctttacgagtagtacggaggaagtatatataggcatatatgttgttgattacagctaatgatcgatctgcggcaaatcgtttatctgctaattttgcttcttgacatcacgaaagtcgacgagccctcagttgttttttttttttactaaatcacggggcggagagcttgccaacctgaatttgccattgtatttgaggtagaatacaaggtccattagatgagattaagagtctggaggggggaagagaacgaccttcagttttgtgccgattttacaaaaagaggttttagagatacgtacgtcatgtatatagcatattcatgccaacgtatacgattataattccaaatatgtagttcaaaatccatctagttcatctttaaattaagaaattgatttcccttaaataagagatgaaaaagaagtactagcgtggccgtcatgcgtgagagttccctgacgacatctagcttatgcctattattgatcgtttatgtacatacacgcctgtgattcccatggacatatattcattgattatattgccgtctcacccctttttaattggttgactagttaaggaaaaagttgtagttatatgttatttttttagtattgctacagtacttaaaaaaaacgaaactcttacaactaacattattttaaccgtttgatttaaattgatagtaacagatatcagcgttagtaagagtatagtatagaaaatgtaatacttgtagaatcttccattttttttgaagaagaaagagatgatgtgtagcgatcgatacaatcttgtataccctctctgtcgcataaaaaaccaaactaatactgaatatgacacatcctagtactacaaattctagtcatacatttgtccagattcgttgtactagaatatgtcatatcccgttcttagattttttttaacgaagggagtacaatatttgaattgtaaccaatgacaagctagccccataggtcttacccgtttgttctttatttattagatagaactcactctatctacttttgatagtcatatttcatcttagcacagtgaccaggaataagtaattttacttatcatctatttaagctactagttattcctcgtaaataagcgattcattaatatttacatttcttgatgcccatgtagccaatcttgtactccctctagtttcattttaatcgacgttttggacaatgacacggtctacaagatatatctttgaccttatttttctattataatatatataataaataaatgcatgtttacttttattatagtaatttaaaagataaatctatatatgttgttctagttcttttaaactaaatacttttaaagttattgatggttaaagttataaaagtttgacctcaatcttgtccaaaacgtcaattaatatggaaccggagggagtatggaagaatggagagtcacacattaaatccgagaaagtcattaagaggatagttggttagattgaaatatgcctatcaaaagtatttttttttgatttggaaatatgcttataaaaaatagatggagggagtaccatatattcccttcgtcctaatatataaggtatttcagagggatgtaacacatcctaatactataaatctgagcagggagtctgtccagaacatggagtctgtccagaacatggagtctgttcaaattcgtagtactacgatatgtcacatccctccaaaatttcttataccatgggacagagggagtagatggtaggcaataaccaccaaattatttccatgtagattactagtagttagttccagtagatgctcgcgagagctgtacatgtactccctccatactcataaaggaagtcgttttggacagcgacacggtctccaaaacacaattttgacttcttgtttctataaaaatatttattgaaaagtgatatatgtataatttttggtggggagctgaaaaggggaagcggaaaactcactggaaggcatggaaatctctcaccaaatccaacaaagcttttaccttagttttcccatttacctttgttagtttcttttatctatacaaaatctctttctactatatattcaataaaaattggcgcactctaattaagtgttgatttgcaaaggaaaaaaaagaactgcaacacataccaatgcatgcatatactattttacatttagcccatatattttttcatataattaaattaaacttgatactgtggaaacactgttgttttccccacatcaattgcattgacattttttttgtgagttttgaactgagggagcagaggcagttgtacaatagtctgccagcttaattctgcatatatagctgtccagtgcaaatgtgcaattaattggtatagatgtccaagcatcacagcaagtaaatcttgcagtgcaacacggcgacaaaaatgtgcgtccaacgcaaccatattgtacaatgaggagaagacgtcaggcctttttttttagataatggaatagagcatcccggtctttgctcaaagagctacagccaattattataatctcacacttaaaatgagtgaagttcaaagaaacttaaaggatgaaaccaaccatcaagaagaaacaacctaaaaactgccaacccaagataaagagtacacaattattgaattctgtttgtgaacctccatccaaaattgacaaaaagttgcataaccgttgtctcaagaatacggcatgcagcctttaaaagctcactatcttcctcacacttttgtagttgtgcccaagaccggagccaatgtgttgccctgaaaactacctgcatatatgaaatagatggtgacttgtcaaaaataacataattcctactcaaccatagagcccaacatatagcaaatgctcctatgagaacaagttttcttctttttttgtccacccctagaagccaattatcaaaaatatgagatataccatgaggaaggtaaagactaaaagaaaactgaactgctctccataaaaactttgcataatgacactccacaaaaagatgttgaatagtttcatttttcatacagaaaaaatatctcaagctaccattccaattcctccttgccaaattatctttagttaatacaacccctttaagcaagtaccacatgaagatcttgatcttaagaggcatcctaagtttccaaataatcttgtttctctcaatataattattgtttattaaggctaaatacattgtccgaacagtaaattgcccattttgatgataattccatctaaaacaatcattcagttgactcaactgaatatgcacaatagaagcacacaagttatgccaatgtgctaaattcttaccaaccaaagctctcctaaaagaaacattcagcggaacaaatctcataacattagcaattgaagaattcttcattcgaacaatggcatatatagacggatacttatctttaaaagcaacgttacctatccatttatcttcccaaaatctagtttgttccccattattcacaatccaggaacccatattcaagaaagtattttttaactttcatgagacttgaccagaaatgagaatcccctggtttcctatcaacttgagttatataatggttagagagatacttccttttcaataagtcctgccaaaccccttgctcatttattaacttgaacaaccatttactcaaaagacatttattttggatctctaaattatgaacacctaaacccccttggtctttgggttgacaaattatatcccatcttgtcagtctatattttttcttatgatcatcaccttgccaaaagaaacgtgatctataataatcaattttttgaagaactccctttggaatctcaaaaaaagatatcataaacatagccaaacttgatagaacagaattaatcaaaaccaatcttccccccacagacatatgtttacctttccaactactaagtttcttctcaattctttgttcgataatcttccaatctttattgccaagctttctaaaatgcattggaataccgagatacttaacaggaaaagaacctagcttgcagccaaagatattagaatattgatcattatattcctttgcttgaccaaaacaaaataactcacttttgtgaaaatttattttcaagccagataacttttcaaacactgttaaaatcaatttcaaattcttggcttcttgtaaatcatgctccaaaaatatgatggtatcatcagcatattgcaaaatagataaaccatcatccattaaatgaggtattacctcacttaacataccatcatctttagccctcttaattagtaaagctagcatatcagccacgatattaaaaagaatcggagacagaggatctccttgcctaagccctttataggtttggaagttatttccaacttgatcatttactttaataccaacatgaccaccttgaatgaaagaagctatccattgacaccttttaggtgaaaagcctttcatcctcaatgtctgttgaacaaaagaccatttaaccttgtcgaacgctttcttaaaatcaatcttaaagattacaccacttttatttttacgatgcaattcatatatagtctcatgaagaataacaaccccttccataatatttctcccagggataaaagcagtttgagtagggctaattaccttttgagccactccaataattctattagtagcaactttggtaaaaattttaaagctaacattaagtaagcagatgggcctatattgctggattttcatggcctccatacacttaggcaaaagaatgataggaccaaaattaagagagaatagaggcaaagtaccattatgaaactctataaaaagatctaacaaatcagatttaataacattccaaaaaacttggtaaaactcagctggaaatccatcaggacccggagccttgttatgttccatttggaaaattgcctttttaatttcatcctcagtaaattcttgtgttaaagcttcattctccaattgagatacttgaggaatgtcatcaattttattttcatcaagttgtaaaccggaatcatcgggaggaccaaataaacctttataaaaggtggtaatatgcgatttaaggtttttgcatcaccatttattacttggtgatcaccgtcttgcaattgaaaaattcttgtttttctatgcttaccattcgcaaccaaatgaaaatacttagtattagagtctccctccaagatatctttagacttagccctctggtaccacttaatttcctcttctctcaaaagcaaagataatctatttctataaaaccatctaatatcaatttcatcctaagttaatagagtggattcagcttttttatcaagcaagtccaatttatctaataactcttttttatctttttttgtaaatcccacttgtatgtttagcccatcccctcaaatgttgtctcacagtatacaagatatatccatatgcaggccctgtttagattctaatttttcttctttaaacttttaactttaacttttttgtcacatcgaacttttctacacacaaactttcaatttttttatcatatcgttctaatttttttaaacttcccgttttgatatggaacttaaacacaggcgcacaggcgcaataccatgaaggagaagaaacagcgctagctacctacctatgctagttagcttgcagtcttgcagataagggtttgacctgcactaattaatcatcacctacaggaagtcagaaattaaacaatgatgcttacccccaaagcttagcacaaacaacaggttacagctgtttctagcaccaagaggccatcacccacctgccttagagcaaatttaatattacagcccactactaactcaaattcatttatagtcagtctaatagccaattcaacttactatattattaatatatggtcccacctgtcatgcgcatactgcgtcttaaaatccgtgctgtagttgactacatatctgtagcccgctgctcttctctctcatattttatctaattaaaatatgtttataactggctaatagttgctattgtacctgctcttagcttagcttgtttttaatcaagaaaagcgagctgttcttgtgccggccggcgcgcatgcatgcatcgatcatcttcttcgtcaaggcgatcggataaggctagctagccgtatgttggaattcgtttcaactagattatacagcttattttgaattatatcaaatattaatactaaaagagtaaagatagtactcaagcaataagctggtcatattatgttgaaaaccattatgcttttagaatggaaaaagtctgaattacccccctgaactacaaaaccagacattctttaccccaaactatgtaaaccggacgaattaccctccttatccaatccgcggtagttttggtctacaaggcagtccagtcagcaatatatttattaaaaaataggttggccctacctatcggtttctctctctctcttctatctctcactctctctctctcttctcctttagacggcggcggcagaggcaggagcgcggcgaggcgaggcgaggcggcggcggcggcagaggaggaggcgagggggtggagaggcgagcgcagcggcaagggaggcgaggtggcggcggcgaggcgaagcggcggcggaggaggcgagggggtggagaggcgagcacggcgg

SEQ ID NO: 65889 - DNA, 5788 bp, Oryza sativa
aaaaaaattggcatacaattttgcaggagagaaaagggaaaattcctaattgcaaatgcacagtgaatagttacatgcataattgcataccaatataccattcaactttacaaactttacttttgtctctgaaaatgaaagattaatgtgtaaattacaagtaaattattaaggacaattctataaaagaaaacttggtggaaaagaagtaaacccaaacctttcatggatcaaagaaaaccactgcaattggtatcatgccttataatgctcagcttcgttccaggaagaacacctatatctttgtcgatacctatttgagagctcaataggaaacaccactgctctcccaataactaaatcaaatgtgaacagtgcacacctcagctagccttgaaccatcaccggtgatgttctggctatcagccatgcctacacaggcaaaaatgcagacaaacacagctagcgccgcaagctgaccagtgccaatctccatgaaccaagagatcccaaatggcttcttgactaaatgaactttagagtccggcaagaatattgtgttctctatgactttactctagcagtcattctcgataatcaagttcccatagttgaaaatgggggaacagagttcgcatgcatcaggtgagataatcatttgcttcagattcctagaaatgaccaccacaagttgcttcaagaaagagatcaatggccgaatctccttctcagcaatcaagaaaccccaaattgttggcaagtagccagttcataatcttgctccacaaaaaagtgcagtttttaccagcgcttgcctaccaactacttgatgaaatgctcaaatgacaaaatggcaagcacagctagccttcagggctgcaaacgcaaatagaaaggggaaaagatgccatcaaagtcataaacgtgctaattaatcagattgactgtccaaagaaaaagatcaggaattacctagcgcttgccatctgatcgacgcagatatcgtccagagcggacatggagacgaagaccccagtagtatggagcgtaaatcaggaaggagatggcgatgctagcaagaatcagacacatgagtcctactgttgtatccatctcgcattgcaagcgagggtgagcggctgccgccacggccagggggaacgatgactaaacagagaggtggattggtagagcgacacagccgggacggtgatggagtggttgagtggagcacgactggaacggtgagatggagtggccgagggggtggggggccgggccgccggggtggagcggcggccgggacggtgatggagtgaagcacagtcaacacagcgtggtggagcggaggaccggcgcgtccgagatgatggagaggagcgcatgcaggcgagtggagccaagtgtgatcgagggaaaagagatggcatatgtaacgctccgcttttcgtgagacgttaaaaactaattcggtaaaatcctaattgcgaaaattttcgttctttgtgtgcgagtctaagtcgtgccaagatctcatttcaaatctcgttgttccctctcatcgaaatcaaaatcctccacctcaaattcctcttccgattcaagtctccaaatcaaattccgaaattcagtcgcatcctttgaatcctcgctaaacgctcgctcccaattccgaaaaataccaaactctatcttgagccttccttgattcctccctgaaccctcgagttcgaatatcgaatttgaatccaaatccaaactccaattctctccaaatcagccttctctgtgaaagtctattctacctccctctggctcagtgggccgactcttcttccccggcccatctcctctcagcccgctcccctcctcatgtgcgttgcacgtgccctacctgagagaaagcgcctctctctctcccccgatctctctctctcgttttctctcgctctctctcgcccgcgctccgcgccgccactttgtcgttcaaacccgccaccgccttcgctctttcccgcgcgcgcgcgcgcgtggccgaccggccggtcgctgccgccgtccgccttgccgcgcctgcgccgcgcagccacccagccccgctcgccttttgccgacgtcgccactgtcatcgcctggttccgatgcccccatgccgcatccttccaaaaccaggagacagagctcgtgctcctctctctcgttctcatatcctccttcctcccaaaatagcaagggagcaaagctcgtttctctcctcttttcacctttttccttagccggcgtcacgcccgtgaccgcctctgccgccgcttggccgctagctccgagcacgaccgccagctgccgccttgaccgccccaaggtcggtttgaaccgacctcccgcgcgaaccgacctcgcctccactataaagccgagtccctcctctcaatccctcccgcttcagtctccaccgctgcagtgccatcgccgccttgctgccgccgtcctcgccttcctccgccatcgcgtgtgccgggaagccagcgtgcgcgcggagccaaagaggactctggtcgccctctctccctccccttccccggcccgagaccgaggtgatcccgcctgtgccgtcggacgctcttcccagcgatctcccgacgcggtagctcctgttctccctccccactcttcctcccccctagcttgcgcgattgctagcctatactttcccaaacgcgcgtggacgctaccccgagccccgccgccgcccggcatggcctcgccgccattgccgtccgctcccggaggccgccgctcgtcgccggctctcctcggtgctcctccgtcccatcaggcgccggaaacggattccttgaaccccgaagatgttcccaccaccgtgaatcgatccctctcctctcccggcgagttttcctctttccctcgcaggcggtgacctccgtcgcgattcgtcgtcgtcggcccttccccttctaatccgtcccgtaggctcactcctcctcgatccgcttgtcgctccggtggtattccctcctcccgccgtgcctcgcgccgccccgccgacgcgcgccgctgtccgccgtccatctcggccagccttcgtcttcctcctctcgccatccgacgcggccgccacgtaggcgccacgtcggctagaccaagtcaacccgccagcctcgtccccgctcgcgtgcgctcggtccacggaaagcctaacggctgtgcgtgggcccgccacccttcggtccacccggtgcaccaaaccgcgcgccactcccatccgaaccctagcgcgcgccacatgcaccgctcccacgatgagccgcgccaccgacaagcgggccccactcgggaccccgcaaggtggactcggcccaccggccctctctctccctcactctccccgcgccccttgggccgcctctctgggccggccggcccattagtttggccgagccgcgcctctcctctcgggccacgcccaagccgcccgagggagtctaaatcacatccctccaatttctttccaaaaagggtttaataaattattaaatcctttttcctttgattagtaaatccaataaactttgaaaatccatatattcccaaccgctcatccgattgactccgttccacttccagtaattccgtaaaattgagatctatttaatggcactattaattaggctaaataggatctttcttttgggtcttgtgtaggttttcgattgtttgcgtatagttgcggttaccggattttcgtcaatcgtggttttctcggagattcgtgaagcttcgtgaagaccttgagcaaggcaagtcaccctttgatcaatttctcctataattggaaagtcattattattttgtttgcaacttgcattattagaatcactcacgtttaacttgcttggcctcggtttgcatgccaaaccgacagacctacctagtagtcgcactaattcctgtaggctgtactaccctgactccttatcgctccacctttgtggtaccacggtatccgtgctctctgagcgcgtataccaaatatcccacatacaccgttgtttatcgaaaacttgggaaatgggtttgtaaagccttgaaaacccgacatgtggtgtcggtgtgtttaaaaataaaatgaattgtgaaaactcgcgatgcgggggttgtgcctatgtggcactgtcccgtattcgcatataaggaccgattcctgtgggaaacgcatcgagcataatcaaagtgcaaccacaaggtggaatgggacaccctggctaagtaactagtcggttcagggaaacctcgcatgccaatagttgggaacgccagggcggggtcggttggagccaaaccgggttcctggtaagcaaggaagagaagcttgctgaattaccgatcgaggtggttggagtttgatttgtgaaaactaaaatggcctatatttatgtgaggatttgatccttctatgtggcatgaggtaaccctgggtcggcttgggaaaggctttgtcgcgagcctctgacaccggccagtgtctggagtaagttcgtatcttgtgggtaaagtgtacccctctgcagaggttaactaactgttcgaacagccgtacccacggtcatgggcgggtgtgaggtggttcccgttgcgtagatttgtttgcctgtactttgtgaaaagttgttgtggattgggaatcgtaaccagaatcagcctatgtggcagatggatgacctgagtggtcagaaacgaatctgtgtgattcgggatgtctgcgggcatcatagactaggcttcccgagtggaagcggattgctttgctgctgggcagctggactctgggagtccgagaaaatgaaaaaggctctgggagccgcctaatcaagtgaaatggctctggaagccgataagtaatgatctgactcggggggtcgatacattgccatttgagttgttgaaaagcatctcttaagtcgaatcgagacgcaagtctccttttcgacccaaacttaaaaagaaataaatcacttagtgatttcaaaaatgatttcaaacaaaggatttacaaaacaaccttgcctctcttctaagcttgcattaaacacctaagtccccgtgacttgctgagtatgaaagtactcaccttgctctatataaatatatatatagttcctccgccctgaagagaagatgaagtgaagtgaagaatagggtttcgccctgattcccagctgtcgcctgtggtgttgggtgttagaccgttggttccgctgctgctgttgttgttggtgtttgcctcgtccgtgtcgtcggttgtattctcgggctgtctgagctgcaaccaaggttaaggtaaataagtcctctatttattttaaggattgctatgattcatatttgttaccgtgggtaccagcaccatgtcctgggactggtaccgagaccgcggtttcgtaggaagcggttcgcgccgttttcccctacgacacgctcctgtcaggtgtcgttgtacgacggtaccagattggggtgtgacatttaatttcatatttccttttacatttataatttgttttatttaattttttcagctcttctttccaattctctacaagcgccactggtttgttttcattgttcatctggaagatgaaatgtttgtctttcttgactcattacatgaagaaggttctgaatatcaagatgaagttaagaatagattggtcagtttattttcaaatttttaaatatatgtattactgttcaatttgtgatttggaat

SEQ ID NO: 65890 - DNA, 1180 bp, Oryza sativa
tgcccgttctgttgaaaccatgcttggaattcgttgactttgatagtactcatacccttgcaatggtgcaatattcatcatctttctctaaatgaccatcaagatccatagctcatcttatttcctgaagtctttgatgcaactatccaactcaggccgttcttcatttcttggggctgcaattagaggttaaaaaaagactaatggtttttattaaatactaatgtatagtttgattcgggatgatgattggcagtagagtagggggaatttgaattggaagtgattgatatgataagtagtactacaaagtgataaatagtactctcttcttccctaaatataagagattttgattggatgtgacacatcttagtataagaaagttgtccacattcattgtactaggatatgtcacataaccaaaatatcttgtatttagagacggacaaaatatcttgtatttagagacggagggagtgtagtgtaaacattcttctttagatgcactatattatactcagtgcagtaaaaaaattgtatacttgatgtagaattgtggatacaagcatatataaggataaatatacccgagctggcaactgacgagttggcccaggagccacagtagtagtagtacaatacattgcatatgtgactattcctacgtgggcccacttgcaagagaccagtctggctttggcacgcacgggtgattagcttagtgcttaatcaccatgtactttgtgctaatcaaaagggattaaaactagcttcgattaagcacgcgcgtgaggcggggagcaccacgtccacgcggacaccgcgtagagcggcgtgcccttccaccccagccgcaccgtgccgtcgtggtctcccgccaccgtgtagcccagcccgcccggacacgccgcggccaccagctgcgcgcgcccgccgccgccgccgccggcgtgcgcgaacccgtgccgggcgagcacctaccgccagctcccgggcccctcccggccgttgctccgcgccggcccgccgacggcgagcacgttcgcgatctccctgccgagcacgccgtgctccgccagatgcctgctcgcgtcctcgccgtccggccgcgacgcgcccatggcgtctaacaccgccgagtagtggtgcagcgcggagacgaacctgtccaggaagc

SEQ ID NO: 65891 - DNA, 6218 bp, Oryza sativa
ctcatctaagtttaaataaaccgagagcttgacatgccagattatgaaaatgcgaagaatactagaaatcagttatgatactatgtagcagcaactagaatcctgcttagatcgtcagaagagatgcagtagcttaccccagccccatcttggacagtcaacaagcaactgaagcagacaacattcagttgcttgttgacaattcactgtcattcttaaatccatttgatgcagagaatacttaattcttactgctaattaagcacattatgcactaatgcaatccaaatcatggctcatgggtcttgtgatctcgtaggcttatcaaactaactgttccagatgcttaacagtccgattctaaccgagttaacactagtaatcaagcgaccaaccatgaaccatctcatgaacaattgaccaactattagacaaaatggtgctacaagttcagaaaaatgaatatgcagagaaacatcctctccgtgaatttaacaaatttaccactcattctgccctgtttgcagagcagaatatcctctaatcaatccttagtttgtacaaattgtcctctaatcagtactagtgaacatattaacaaaagcctgttatctctaaatgattttggcgaccaagaagccctctgctactaaattgtactcaacattctacatcatgcacacaatctaggaataaatcgtggcacagaaagtaaattcagcaccatcagtagtagcaatctatagaagaacaaatgacattcagacgatcatacaacatcgcatgatgaaagaaaacataaacgacctgcatctttcacatctagctgaaagcctgaaactgatctgtgaacagttaacaaactgaaatttggcttcggagaagaaattcagctacattgcaaatccatttcatgcaaagaattcttctatcaagaaaattaagcacggataattgggcacattttctcattgcattattattaactgcataaacaatgatgcatagactcaatccaagtactgaaagccaaaacgttgctgcattcatacaaatcatcagaccagagtccagagatcacatcacatgcattgcgttcatgcaagtctgactcagcaaggagaattatactgattgatcgagaattatcataccggatcaggaagactacatcatccacccaaacaagaggagaaggacatctcgaacaaatcaatagcgaatcatacctgtaccaggacgatcaaaactaacatgagcaatctcaggggagaagccacgccggcggtgagtagtccgacgggccttgctccggcaagaacttgtccacacgcggaacccccgccgcatccgccgccggtagccacttgccggtgtctctgcaggggtatttccccgcgacggcgcgagaagcgaacactgtcgactcgcggtagagcctcccgtcatccaggaagtagacgccctcgccgaactcgtcgcccggatagtcacccgcgtcgtacgatctggagcagcctcgcgcgacgaacagcatccgctcacccagcgactccagctccttccagccgtgcagggccttgttccgcttcctcggcggcggctgcaccatctcgaacaccttgaacgccgatgtcgtcggcggcgcggcaagaggagcaggaacgcgcctgaccaccatgaggagattgccgcgggactccaccaggtagcgagcaacgacgtctccgccataatcgcgccggccacgccagaagcgaagaatcaccctgggcgccatcttcatgttgccgtcgccgtcttcatggaaatcccgtgctgtgaaaacatggaggtcttcttctgcggtgaggaaaaggaaggctcccttgtggtgtatgacatcctccagagctggctcgtcgatggcactagggccatgccccatcgccgcaacctgatcctgggaagcatttgctgactgaacgcgccagaatgcgtgagtgcgtcgagcagcctggaagggccagtaggtgatgatggcggcggcgacacaatcctcgtcctccggtggcgaagagagcgtcgcggcgagcatgatcacaccagtgttagggacagggccgtctggccgccccaattcagcagccgtcttgtccgggcggacaaaaaaggggaggttgaagcgcagctgatggtcgcggaggctgaggagcgtgttgcggcaggtctcgccgaggaagatccagccgccgtcgtaggcgccgaagcagcgcgcggcgcgcgcgccgtccgggacgccgaggccgtgcccgccgcagccgcggagggcgcacgagaaggaagggccgtcggcgcgcgggacgaggatccacgggagcgggcggagatgcggcgcgttctgcagcggcttgacggcggcgcgccagtcgtggcagacgcgggccatggtgcggcggtcgacgaggcacgtgaggcggttgtggacgaggcggagggcttccgccatgaagtcgcgcgcgggcgccgccgcgtccatgggagaggcggaggcggaggcgggggcgggggcgaggcgtgaaggtggcggtggcgagggttgggcggcggcggaggaggtggaacgcgacgaggacgcttcgtcgttgtgcgccatgtttgaacttggcttctggaagcaggggaagagaggggaacagagtggattggtttggaagaagaagcagagaaggccagccttttgccagccgagcaagtggttgggcccaatttatagtgccggttttcttgggcctgaagtttggatcgctgctctttgctgagcgtttcttcttgggcctaaatgttttttttttttgagaacgtaaagttcggatgtacatatggtgcagaatcgtgtctagcagacaggagaaacaaatgggagcagggaaggttaacccttttttttttttttgagaaaaggcattcaagcaggttaacagttcagatggacagatggttattatcctacaggaaaaaaaaagagaaaaaaaagatagaaaaagttattggtccaatgaggtcatcatctttagtaacataggcacacatgttttctgtaggcgatatggttaatcttttcattagtgctgaactgaaggatgctcagttcacagctcgtcctttacagagagaaggggatgaggaaatgttgatacatacacaggatgcttatctctgaattccttgttcactttttctgaacttgtgcatcagtctgatggtacaacaaaaacactagattagacgctcgccaagccgtgcttttgccgaaaatatacagacatggcacccatccgacctcaaaacaaaaatatgcatggcagagctggcatcacaaacgaactcccagtttgaattttaaattcccggaaggtcacttatgaaaaagaaaaagtaaagccttcataaattttagcccatttatccgcctcaagatttggggcccaagaaagctggccctataaatgaggcccagtcccccatcccccttccaaaccaagcacatctcctccttcttccagaagcagaggaatccatcggttccattcctcctcctcgcctcgccaccggcaagccgcgcctccgcctctccaatggactcgccatggcgcgacctcgacgccgacgtgctcggattcatcctcaagcgtctcccgtgcctcgtcgaccggcgccgcatggcccgagtctgccgcaactggcgcgtcgccgtcaagcctgagcagccgcggccggggacgaggccgctcccatcgatcctcgtcccgcgcgccgacgggccttccttcgcgtgcgccctcgccggttgcgccacccacgccttccgccccccgctcccggccgacgcacgcaccgcgcgctacttcggcgcctacgacggtggctgggtcttcgtcgccttcggccaaatcctggactacgcgctactcagcctccgcaacggcacgcgattccacttccccgacacgggcacggacatggtggccgcgaccctctcttcgccaccggatgtacgatccacgcgttcatgtacgatccacgcgtgatgtacgatccacgcgttcatgtgttctggcgcatggagcatcaagttgtggagaaggcgactgctgttgagttcgtcaccacgtcagttctggaggatgtcatacaccacaagggaagcttccatttcctcaccagggaagaaaacctccatgtttttcctgtagcgggcttccacgaagacgacgacggcaatctggagataccgcccatggtggttcgccgcttctcgcgtggtgggcgagattacggcggagccatcgctgttcgttacctggtggagtccggcgagaatctcctcatggtcgtcaggctcgttcctcatcctccccaactgccgccggggacatgggcgttcaaggtgttcgagatggtgcatgagacgcccatcaacaacgacggggcaccatacgcttggaaggagctggaatcgctgggtgggcggatgttgttcgtcgcgcgaggctgctccagatcgtacgacgcggacaagtatccgggcgccgagttcaacgagggcgtctacttcctggatgacgggagactctacgatgaggcgttccaaatcttgaatccctttgcccagttcccctgcagcgacaacggcaagtggctgccgccggcggcggcggcggcggcggaggcggttaccggccgcgtggacaagctcttgccggagcaaggcccgtcgtactacacgccgccggtttggattctgccgtgagactgccatgttcttagttagattgtctgatgacttgttgtcgtgttgatatggtttgttgatttgtgcaatcgatgatgtgttctcgagatccatgtgtgcttgcaattgcttgatccatcatagcatctcttcagtactctgctattttcaccatgttagactaatgcagaaattgttggttctcatgactcagattgcattaattagtgaatcattatattgcaacgaacaatgattcagtgtgggggatcctgttcatgccaatttttcaggctaatcctcctcttccctcgccgaaagtcgcttaatcagcatccacagtgacagttatgctgaatcagcttgattcatgtcgaatttcccatgggtcaataacttgagactcgtattattttaattttctggagtctgtgagttcttatcactttttgtttattgagttccagactgaacagtaaagaatctgcaagtgatacatcgaagtcgtagtgaactgccaaaattttctcgtggttattgctggtgattaaccaaccaaccatctaaattttaccaacattttcttaccatcattcacaagatcctgagtgcaaattcagaaaaatgaacgggcaatgcagagataattatcctcctctccgcgtgtcaactttttctctcatttgatccactcttctgtagagcagggagggcagaagaacatcataatctgatcagtagttcagtactagtgaacagaataccatgacgcctaacatcaggctgtgttactgaagtaatgcctaaatgctgataactttgggtgaataaccatctgttaactgtttaaccattcttcacaacgttctaccttatgcaccgtcccgtactgccgaagcgccgccgccgtccgagaagggagaggcggtgtagcgaaaagaggggggggggggggaagggacgcggacgacgacgacgacatggagatggcgcggagctggaggggattgcctgcacgccgccgccgccgatccggtggggaagagaaaagtgagagaagggagagagagagagagggggaggaataaaggatgatatgtgggccccacatgtcagtaggtctcacatatatttttttaaaattttaatgctatataagcgtcacgtggcatgaagaccagatcaacacccccacgacaacaaaaccacccttcaaaattgctagagaattcaaattacactggtttcaatagttcggtcttacccgatattttagttaagggtcacgaattagatttgatgaacagttaaggaagttaaagtggatttttttccgaaggtaaaatgtctttctacatttgagcccattaatcttcctcacggggaagatgcacttgggggcttggggcccaagaaagctagccctataaatgaggcccagtct

SEQ ID NO: 65892 - DNA, 843 bp, Oryza sativa
gctgttgttttcgtaattgattttatttgaactcttttctaaaaacatctaggtgagtgcttctcaaacgacacggttgagacagtgcgtcccgtccggtcagagtatgtgcaatgtatcaatctttagatcttagaacaaggttggcacccggccaacagtttttcaaacggccacccgggccaacaacttttcaagtggccacccgggcctagctgatcccgtcagctgctgattttccaaacatcgaaccctttttcacaacagtaatttcacaagcagttgtcaaacaaaactacgctaggaatcacctcacatccgcccatgaccgtgggcacggctgttcgaacagtttgttaacctctgcagagggggtacactttacccacacgatattactaacccggatcacccagcccgtggggatcagccacgtcgggagacctccaagctttcatgacaaggcatttccaaagccgacacaggcttaccatatgccgacgagaggggtcccagaccaacaacaggttaggtcctagaccatactgtgccaggaagcccaggggtcctctctgacaccaccccggcgaatccacatgtctctcggcatcatggctcccctgataagctagttactcagccaggggtgtcccattccacccatgtggtcgcacttgtcctatgttcggatgtaattccaaagaatcggtccttaagtgcgggagcgggaaaaccgtacacccgtattgttcccgggtccgcggtttagaaattcatttagtccccagcaccgaccccagtgtcgggttttcaagtctttttgtaaacccaagtttacccaag

SEQ ID NO: 65893 - DNA, 9147 bp, Oryza sativa
  unsure (1)..(9147): unsure at all n locations
aaggatctacgtccgatgcaaccgaaaaatgctctggtcgagtcacaccagatcaccaatgattaataattagactatagtgttagccaaaaattagctagattaactatattattagcttagccgatggcatcgctgagcatttctttttcttcttcttctttagagaatcatgtgcaaaagcatgcgtcgcactatgtaattatcgccgtgttaatttgtcctatatagnnnnnnnnnnnnnnnnnnnnnnnnnnnnnntgactaattcaagatgatctttttgatggttcatgcagtgctcgtaatgtgatctgatcatcatcaggttaaaaatatcagcctctttgcattattttataatcacgctgaatgtacgacaggatgatgtttaattgcgttttattagatttgtggatgtgtggttttcaacggccaatgtacatatcgggttagttgccattacaaaacaatgtacttaataaagtaagtttgaaatcctgtaattatgcccaagctggaattgttgttttcagcattcaatcgacagggtggatgatgcaatgttgaagaagatcttttctgtgcgtgcgtcttaaatgtggttaactgtgaggcccagctgccctctttgtccacactttcaaatttaaaaaattgtaggaattttttagcacgaaaaagacaatacattgttttaataaaagagagaaaaactcggtcgacacacctaaaataattacattgtattaaaaatataacaagagacatgagtatactctatgtcacgccccgagctagtcccgactggaattagcccgtgacgctccaaattaacctgttaatcgataccagtcccaggaaacagtgctggtatcacaggaggatagaatatcacagcaacagaggtctctttattatagagtaggagtacagtcatgttgggctgtggacagatcccgagctcacaactgcattacaaaagggaaacggaagccgggacttggaccaaacaacacaggcgcgacttgggaactaggccgaaaccctaaaagtcatcgtaaccggcttgctcctggaagaactcctcatcaacagggtacgcttcatcttcatcagcaactggggggtatttatatagagcaaggaggagtacgggagtactcagcaagccaggggaaataagtgtttaatgcaggcttcaagggaaggctgttgttttcgtaattgattttatttgaactcttttctaaaaacatctaggtgagtgcttctcaaacgacacggttgagacagtgcgtcccgtccggtcagagtatgtgcaatgtatcaatctttagatcttagaacaaggttggcacccggccaacagtttttcaaacggccacccgggccaacaacttttcaagtggccacccgggcctagctgatcccgtcagctgctgattttccaaacatcgatccccttttcacaacagcaatttcacaaggcagtagtcaaacaaaactacgctaggaatcacctcacatccgcccatgaccgtgggcacggctgttcaaacagtttattaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacacgttaggtcccagaccatactgtgccaggaagcccaggggtcctccccgacaccaccctagcgaatccacatgtctctcggcatcaaggctcccctgataagctagttactcagccaggggtgtcccattccatccatgtggtcgtacttgacttatgatcggatgaaattccaaggaaacggtccttaagtgcaagagcgggaaaccgtacccccggtacgttccccggtccgcggttttagaaattcatttagttcgcaagcaccgacccaggtgtcgggttttccaagtcttttgtaaaacccaagttttacccaagttgtttctcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacggaacaacagattaagtgtgatcctatcaatgcataatattttgcaagcaatataattaaatttcaagtataggctcaagatgttcaaaggtggcttgccttgctcgagatccagagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaaacggatttacggtggggaagatattgaatttctaagattattggatttttggtctaaaggaaaaggatttaattaaatcctttttggaaaagaaaagaaaagaaaaagggagagggagggaatatagacttccctcgggcggttagggcgcggcccgagagaaagggcggctcggctgagcttaacgggccggccggcccaagaaggtggcccaaggcggcccaagacgcgcgcgcgcggtggaaggagagagagagtccggtggaccgggctcaccacgcgcggtcccgggtgggacccgcttgtcagctgctcggctcaccgtgcggagggagcacgcggcgcggcgctagggtggaggatggacgtggtgcacgcacgcggttcgcggtggacgcaggtgcggcgggcccacgcgcagcctcacggctcgcggtggaacgcgcgcacggggagggactgaccggggtcggctcgacccggtttaggctgagctggcgccgatgtggcgcctacgtggctgccacgcgggccggcgagaggtagacgacgacccggccgcgaatggacagcgggcggcggcggcgagcggcggagcgaaccacggcgatacgggcaaaagctagcacaccgggcggttgttcgtgatgaggggagacgaaccaacggctcggatttgccgggggttgctcgacggcggcggattgcggcggcggcaaccggcggcgggagaagggggaaacggcgacgaggtcactaggggctaattcccggcggcgagagcatctacgcggttacgggaatccgatgctagcgtcggattgggcggaactacgccgagcgaggccggcgacgagcggcgcttccgagctcgggcggcgacggcggcgagcacacggcgagcgacggcaacggtcggggcggcgccggctaacttcggggaggctactcgagctactaccgaaagctaaggaggggagatggagcgaggaggaagaacggagggaggcactaccgtgcgggacgggcgcggtgacgagaggccgacggcgcgggagtgatctctccggcctcgggccgaggaagaggaagaagagggcgcgcccggagtccccttccgcgtccacgaacgcaccggctctcccggcgcttggcgatggacggcggaggcgagacagagcacgggagcggcggcaatggcacggaggcgaatggaagaggaagggaaaggggaggctggggtttaaatgggcggcaatgtcggtttgggaaccgacttgcgcggtcaagggcgcgagctggcgctcggcggtcgcggccaaggcggcaacagggaggatgacgccggcgaggaggaaaaaggggaaaaggagggggagaaagggggcttgcccctttgccgattcgggaaaaaggaggaggtgagcgggggcgacgcggcagagggaggagggatgctgcctccgtcccttggcggcttgcgcgcggagtggcggggccgggcgatgacgacggcgatgacggcggggcggtttggagcggagcggcgacactggcgacaggcgcgtgcagaggctgacggcggcggcaaccgggcggtcggccaccacggcacgcgcgcgcggcttgcaatgggaggcgcggcggatggagtggcacggctcgggcacgcgcgctggctcgcggggtcaagcggctacgcggctgcaggcggcagggcagcgggaccgggcggcgctgacgcgacgcgacacgggcggcaaccacgcgggcgtgcgcgcgaacgagcgtggggagcggcagcgagggagccgagaggtaagactcggctcggcgcgggcggcgcggctcacgcgcttgcgcgcgcggcgcgcgggcgaggcggagcggagctgagcggggggagaagcggagcgcgccggggaggggagagggcgaaagagagagagagagcgagggcgcccgggatagagggggggccgggggagagatgggccgagcgggattcggcccatcgaccccgggggaggcaaaatggacttttgcggaggaatgatttggaaggatttggattcggaattgaactcgacgatagatcggggattgagatcttgagatggcacggacactagacaacaagcgaagaaacaaatttcgcaattagggtttttaggagataattttcccgctaggcgccacgacggaacgggcgctacactctagtaggagaaaaaaaacataaacatgaaagaaaaaacataaaaaaagagaaaaataaaaatattttaaattcctagaagaaattaaaccagaatttgttgtcgcggattcgtaccattggacgactagaccattggtcatttagcttcacccgataaaatacgaattaccagctgccatattcttttaagtctaagcctcaactaatgtaatttacgtagctttgcctttaattttctgctttttgaagttttaaagtacagtgctaatggatatttagattcatgtgtagggctgcagccctagctatcctatttttgtctctgcccctctgctagctatgacagttgcatttctgatcgatataaactcgtatcatatcgttgtactacaagtttgatatagttgaaatttatgaataattgatgggttattatatgaccgtatgaagtaacttttacaaaactaaaaagatattattcaaaaaaatttccagataattttatacagaaaatatataaacgaagaattaactttttacaaggttggcaagcttgaaatgaaaatctaaaataataataataaaaagagctgcacctaaataacagaaaaaaatcaacgcaacttgactacccgttcttggtcagctaacgatataaatctcggactgtgattgggtgtacgagtcgattgatgggatcatttccttggcttccactgataataataataataatctcccctaataaaaaccatgtttagccatcgtaatctccagccgaccacgccgcgtgctgacgccgccgccgccgcccccacgcgcgtggtctacctcatcgtcgccacccgaatatccccctcgcgccacgcgtcgacgccgcgccgcccctccggtttctatccgattccgcgagagaatttttgacttttcgccggttcgagactctcttgggttcatgtgcaccacaggattttggggtgtagcagatccggcgccgtagtcaatttaagattttcaaacttcatttttggatttttttttccgttcatttctatatttgatttaattttttaattacacgaaacgcgtgcacacacaccaacgccacactcacactcccacgaatatgtccccttaacacatgctctaataaatggaaaccaacgttacatccctgatctaactgcaatcctgttgaaaactcacttgaatatgcgtaatattcgtgtgcatcaagatttaaactctgatagatgaaataacatcattagaggtttcccggtattcgattttagtttagagccaataaaagtagaaatgtaaacttttatatcatgccttcgactaacgaaaatatgaaccgcaacaaataggctcgaacaaacaagtccattgactttgactacttatccttttcattgatttctatcataaataaatatttaatgttcagaataagatttagttaaacttataatattttgagaatcaaatctggtcctaaacatcaatattttttttaccttaaggagcattttaaggactatgatttttcattttgtaatgcaaaaatagggactaaagttttgaaaagaaaatagtagaatttaaacagggttttactgactttgaaacccttttttgctaagttaaaaaaatcaatatttttcttttgctagaggcacattctaacataaccgcgaataaacctgaatttttttaaaaaatcgtttcaaaattggcaaaagcctggatctaatatgcttgtcagttaagcttccatctagctagagtcctttgtccaaagcttcaaagtactaatcttattaaaaatctcacttaggactaatcttcctttgcacaaaggtgaaaggtcattattagttgatggcgtcccatgtcccatacacacgtgacagccatcagccacataacccttccaacccaacctaattatcccaggggcattcctgtccatctcccgtgtatatatactcaccaccacccttctcgaaccctgacctaatcaccacctcgctctttgcatttcttgatttctcctcgatcacctagtagttgatcgagcaatggcggccaaggtgcaccccaacctggccgtgccgtcgctgatccagccgccgatggcgccaccggcggcgatggcggcgggggacagcgtgatgaagacgaaggcggcggcggcgggcggggatgtggtgctgacggtgtggaggaagtcgctactgttcaactgcagggggttcacggtgttcgacgcgagcggcgacctggtgtaccgggtggacagctacgcggcggactcgcgcgcggaggtggtgctcatggacgccgcgggcgtgcccgtgctcaccgtccgccgcaagaaggcgatcggcagccagctcgggcttgggggcgaccagtggctggtccaccccggggaggagacccgcctcccgccgctctacgccgtgaagcggacgccgcagtacgtccgcggcggcggcagcgtcaagaccatggcgcacgtcgcgccctgcggcgtcgccctcggcgccggcggcggcggtggctacgagatcgaaggctcgtacctgcggcggagctgcgcggtgtacgacgcgcggcggcgcgcggtggtggcggaggtgcaggcgaaggaggcggtggggacggacgtgttccggctggtggtgcggccggggatggaggtgtcggtggccatggccgtcgtgctggcgctggagcagatgttcggcaagccctccctgctcaggagctggtcctcctaataattagcctgtttctttctttctctttttttttcttttttttttggccttgaatttccaacattgtttgggcctgagagcagaagagttgctcttggctgcctctttctctctgatcctgaaatgaaacctcaaattgggtgtcactgtacactgaaaagaaaatccctcttggtgagtatggttttgggtcttttttttagcagaaaaccagagggatgaaagtgtaaatatttctaagaagaagaagaagaaaagggggttaattaaagcaggaaattcttccctgtctatctttctcctccatttcttgttataagctaccagccttccactgttgcgaggcaaaattcccccccccccccaattaatactagaattaactaacaatatattgtacaaattcatccaagatccacatgcccaaaacatggaaaccattttaatcgctactactatgtactccctccgtctaaaaaaaaactcaacctaagaggagttcggggttccttctagtacaataaatctggactatttttatccagatttattgtcttaggagggagatttctcttaggttgaagttttttttggacggaaggagtacatttctgcatcttcttcacacagcgtctgaaaccacaaactgcatgtctgaattgtgaacatcaaaactgtctgttctccaccttgcagagactgtacatgccaactctgaaccagagagactagacctactactgtctctgaactctggaagagaaaaaaaaaaaaagggcgtttggtgccttgttcctttccagaatactacggaccgacgtcgccgcctcgccggccaagcactcactcgcaccagctcagctgcatatgagctaaggatgatatctgcaagcaggctgatcatcatgaggctggctcctcctcctctcccctcgccgaaagtttcgctcaaccaccatccatgacgacggacatggtcagcatcatcttctcggcttagtcattagcatcaccctacaaggattaatcgcgcacgaaaaacgagacaagtcattagcacataattaattgaatcgtaattattaaaagtttgaaaaatggatttatttgttttttatagcaacttatatatagaaaattttcgtacgaagcacactactttttaacagtttgagaagcgtgctaacgagtaccgaagaaaaaaaaatctttatcttgttagagtttagaaggagaccagcttttggactgaacggtttgcatcttgctcttgcgagcacgcagcaaccacgggcgcgttagtgcgttacgttggtacgctgcgtacgcacgtacgctaggagcaaacacggcgccggtattgccacagtgggggcagtggtgggctggtggccacttgttgctgctcgcggtcacggatcgcggcgaggctgggtctgttcgtggatatttagattttgagaagtggcgtgtgggaatttaaattgtgagaatatacaaaaaaaatcagttccatggactctgtaactatatcttctctgaacgaaaaaccgatttgtttaggagaaacttttgattctggagaagatgtaactgtctgaagctatcctaaacaaaccgatatctattttg

SEQ ID NO: 65894 - DNA, 16725 bp, Oryza sativa
tgaacggagtcaaacggatttacggttgggaagatattgaatttctaagattattggatttttggtctaaaggaaaaaggatttaattaaacccttttggaaagaaaaggaagagggaggggaagtagacttccctcgggcggctagggcgcggcccgagagaaaaggggcggctcggccgagctaaatgggccggccggcccaagaggacacggcccaatagggcgcggggaggggagagagagggcgccggtggaccgagtccatctcgcgtggtccggggtgggacccgcttgtcagcggctcggctcaccgtgcggagggagcacgcggcgcggcgctagggtgtggagcggggcacggtgcatgcgcgtggttcgcggtggacgcggatgcggcgggcccacgcgcagcctcacggctcgcggtggaccgcgcccgcgagcggggccggagggagcggctgaccggggtcggctcgacccggtcttggccgagctggcgccgacgtggcgcctacgtggctgccacgcgggccggcgggaggaaaaaggggaaaaggagggagagaaagggggcttgccccttgcctctttgggaaaaggaggaggggagcgggggcgacgcggcagagggaggaggagctctgcctccgtcccctggaggctagcgcgtggagtggcgggggccgggcgatgacgacggcgatgacggcgggggcggtgtggagcgaagcggcgacacgggtgacaggcgcgggcaggcgcggcaggcgctgacggcggcagcgacccggcggtcggccaccacggcacgcgcgcgcgggaagcaacgggcggcgcggcgatttgagcggcgcggctcgggcacgcgtgctgactcacggcgcagacggcgcaggcgcggcacgggcggcgaccacgtgggcgcgcgcacgcggacaacggcgtgcgggaagcggcagcgagggagcggagagggagggctcggctcggcgcggctcacgcgcacgcgcgcgtggcgcgcgggcagagcggagaagagggagagcgagagcgagagagagagagagagagagatagccggggagggaggggaagatgggccgagagagattcggcccatcgaacccgagagaggcaaaatagacttttgcggagggactttcgggaaggatttggattcgggattgaactcgacgattgatcggggatttgagatctgagatggcacggacactagacaacaagcaaagaaacagatttcgcaattagggtttttaagagatagttttcccgctaggcgccacgacggaacgggcgctacactgctggtcgccatcagcctggccactgacagcgaccaccttggttgtcgcgcagcctgcatcgcccgtgccatcctgatcgcgaggagtcaaggagcttggggagcgcgtgcgacgggatctgtagcggcaggagcatcgggagctgtgcctggtctgtgagcggccttggcggccatcgccgtgcgctcgctggcggccggaaggatgcggcgtgcggctccggtgtcgcaccccttccgccgcccgcgactcaaccgaccggccccttccaatgatgacatcgcgcagcgagcggcggcgtggtggaatatcctcagcgtggcgccgccgcccgtcatcatcctcatcatcctccgggtcttctcttctctgtggcggtgccctgcatccccgcctcgctgccgcccgtcgccgaggaggctgggttccgtcggcgcagcccaggtaccactggaaggtgcgcaccgtgggtatcgggcctcccgaatcagacaagtccgaggagggcagtccgctcaccccgaaagaaggcgagcggggcggtcctggagtccagtcctccatctcgtccagatggactatgacatgcggcagcctccccctcggcggcagcgcgatctcgtccggaagcggcggtgtgatgccggaggtgacacgcccagctcccggcgggaagaaggtggagagcactgttcatggcaggagatcaggattccgcatccacatccagcatgagaagatggccgtgttctgccactgaaccgacttatgctcgatgcgatcgaagaggcagatgggacccatgacgccctccaatcccgccctattccatgcgtactgcggcaatccctccaggcagagccgcacacgaaaccaccagttcgggtggtgcacatgcctgtcggcgctccatggcgtgatggtgaaccttcctccatccagagtgatgaagcctctccgcgctgccgcggcctgcccctctgggaaatcgaagaagacgaagaaatcttccgggtgatggcgcgtgactcgcaggtccgagatggggatcccaacctgctgggtcagtgcacgcgccacctccctgggggacgtctcctgtccctcgacctcagccgagatgagtgcgccatgatagtgaaggcgctccagctcgtgctgcatgagctccgtcatcggcaccgttgcatagccgactgccggccgttgattcggcagaccaggtatgtgatccatggtcaccgctggtttgtgcaaacgatggaaaaccgaaccagggcgggttgttgttggttgctgttggttcttgctgggaagtggtgggaagatgagtcgggattgaatggagggggcttgcttggggaaggtgaggcgggagtgaatgggttgctttgatttgtttgggcagcggaaggagatgtgtccactgcgtctacaagtatagcagcggatgggatccctgcaagctgctgcctggtgatctgaagcgaagcagcggaagcacttgccgtgcaagatctccttgaacttttctctgagatttagtggattgaaggaggtagctgggcgattgaagacgacctgagaggttgatgaagaaggattttggcgcttccgccaccaaaactttggttttaccgcttgccattttgatgaaagatcttgttcttctgcctcgatttgagacttgcttgtagctcttgccggggctactattatcgactttaatgttgctttttctctggccttcttctctgcatcttcctcttgtgccttttccggagggggcgtaatggcgctctgtccctctcctctctctgcagtaatgtcgagctcctcttcctggcttcgggcattgatttcctgatggaaagccttggacgccggagatggagaagctgctttgcgtgctttggcggtttgcggattgaatgtctccgctgaacgttggtgtagctccggagcaatgacgtcgtcctcatcctcctcggcatccgttccccagtcaagggcttggatagcagtggcgaggcctgacttgcttggggcgaaggcgtgactggggaggtgagcgcggttgtgcggtggccgccctggtcggagtgaccagaggcgcagggctgtgggcgccggtaacggttgccccgccgacgctcaggttgacgagctccccaggctctcgctctctcgtcatttctctcccctacgactattcgctattaagggttgccccaatttccttctcttcacttctcttgggtctccttctgtgagtgatcgaaaaagacgcaaacaattaaatatttatttgtatagtttcagtgaaatcaataggctaattttcgaaaatacgtatgaagggacatgtttatcggatatttgaaacactctcataattaacattatattgattgatatctggggagaagacgtgttctatatatcagcggtcgcaaaatttcaacaacaaaatgaattcaattaatgaaatcttaattatacaaaaggcagaaaggtaaagctactcattaatatcagtttccgcatagttgttttctcataaatttactttatactttaaaatataagtttttttagaggtcagctaaaatgatatggcttttggaataaagacaaacatacatgaaaaccctggtccacacagcacgacatgctggggaggccaacttacaatatgccttatgcaattttaaaatactactacctctgttttacattatactcactgcatgcatgtttggcgaatctaaacaacagatacatctattatgtgttttatagtctaatttatatgaatattagtgaatctaaacaagggatagagaggctaataaaatgcacacagttataatgaagataaacgaaaactatataatatgtcatagacaaaatataattcttaaatacttttaaaaaacaaatatagtattaaaatatattcaatgatgggtttaataagctagttcggtgttatagatattactatatttttcaaattttaattttaaaaaaattcaaaacatcttatatataaaattgagggagtcgtaagtagtgcgtttgctaataaaagtatatatacacacggaaataaattgaagtattaattcttagaggctggacctggacgtcgtctctcattgtcaccgccagttgaactctcaccgtgtcgtcggggttggtgattctgtaagtcatctccttaatgattccggggtttttggacagcatacttgcgaagccatgcatcatcccagagttgtatttgtcttggttttctgcataaacatcttatattatactcctaaaatatttagaaacggaaggagtatatagggacgcgatgaattatcaacacgtaatggcaatggtaactaatttgattagccgttgttgcatgcaggctgcagctagcggctagctttaatcgatatcgatcaatcgcgtgatgccgtgatcgcgtatgataattaattacagagatgaacttaccgatgatctgctccagcttggcggtcagtctcatcatctccgtttcatgcagggacgaggagctagccccaggcccagctgcagagaggacggaggacaagtagacgacgcccgagagaagcaccgccgcgtggacgcacaccgccaatgcgaccggacgcgcctgtatccccaccgtcgtccgggccgcatgaccagggctcccgcggcaaccgccgcggcgacggcgacggcgacggcgcaacgcggaggccggcgtgcgtaaggtttaagggggccgcgacgcgagactgattggaacttactatatatcgatcggtacccttttcgatcgtatattgtgtttgttggtgcgatatgttcccggatgggatgcgtttcgtgcgttcgtacgtagtcttggctcttgacactcttagagtttctgaccggccaaccgccgtgtccatatatgtaggggtacaggtattttccgactgcacgtccgacgagaggtttatgggaaaaatatgcgacagaaattaaaatgggatggctgatactgtccaatttcaaatctgagtctataaagaaatatgagttaggatatgagaagagttgcatccacccgtatatcccatgttatgaaatatatatgaaaatcccaaaatctttgctgtcttgatgatactatttctgatcgatttcatggatacacaagttactcggtcgtagcaagtaattagtcactgaatttgtttttgtccgttctatgattcattcatatacatgatgcagaatgttgagtacgtcagtaagcactaacacatagggatgggttaacgtttgagatgggttattgttccactgtgatcatctcactactactgaacagagaatgtcctgctctgcttcgacacaaggagaaaagctgatacacatagaggaaaggatgctttctctgaatttcctcgtttacatttcttaactttgaggcatcctggccaatggtgcagtaaaaacagttcattggagtgttcgctgcttaattacttatttggaacgccaggccgtgctgaggaaaatacatgaatatgcacccatacgagttaactagggcctgtttagttccaaaaacatcacatcgaatctttgacacatatatggagtattaaatatagataaattaaaaaactaattgcacagttaggggggaaatcgcgagacaaatcttttgagcctaattagtccatgattagccataagtgctacagtaacccacatgtgctaatgatggattaattaggctcaaaagattcgtctcgcggtttttaggcgagttatgaaattagtttttttattcgtttctgaaaaccccttccgacatctggttgattcatagttttggaacatcgaaaaggttctctctcttttcaagagaatgtgcagtctgacaaaatcacaaaatgtactgttagacagatgctacacgttaagaaaaatgcgtggggaatgcagagataagcatcctctccatgattctcaaatttgccattcaggtgttactgaaagcttcagatatcatcagataaataccaactcttaactgtttagccaattccacagctactaaattgtactcaacattacatcatgcatataatataagaataaatcgtggcacagaaagtagaattggtagcatcaaaagtagtactggtacagtactacagtagtacctatagaagaacaaataaaacacaaacgatctgcatctttcacatctagctgaaaagcctgaaactgattaactgaaatcagtccccagaagcaattcagcttcattgcaaatccatttcaggcaatgcacacgattttatcaggaaaacaaaagcacgaataattgagcatataattttcacattacattataatcgacttcaatataatgcagcattaatgcaatcaaagccatggaaacagataatttctgcactaatgtaatccatcagatcggagactaagcacatctcagacaaatcaacagcaaagcaaacctgtaccacgacgatcaaactcaacacgggaaatctcagggaagaaaccaagccggcggtgagtagttcgacggggcttgctccggcaagaagttgtccacgcgtggaaccgccttcggcgccgacgccagccacctgccgctgtctctgcaggggtattgccgcagatttggatccctgaacattgccacctcgccgtagagcctcccgtcgtccaggaagtagacgccctcctcgaaccccggatgcctcgccacctcgtacgatgtcgagcagcctcgtgcgacgaacagcatgcggccttccagcgagtccagctccacccagtcgtactcggcgccatcgttgttggtggcggcgaatgccgtcgatcgcctcgccatctcgaacaccctgaactccgacgtcgtcgtcggcgacggcggcgaggggcggagaggaccagcgccagcagcgatcctggccaccatgaggaggcgcccgcgggactccaccaggtagcggacaacggcgacgtcgtcctcgccgtagtggccgcgcccgcggcgagggaagcggcgaatctcgatgggggctatgtcaagctcctcgtccttgaagtcgtggaactcggatactcgaaacacgaggaggccttcttctccggtgaggaagtagaaggcatcgtcgtagtgtatgagatcctccaggcctgatgccgaccccgcgttgctggcgtcatcgccgttcgccaccatcgcgggcaagactcccatgcggaagaacgcgtagatggacgggttggtgacgtcggggaagtgggagaggatggccgcgccgatgcagcgttggtcctccggatgcgacgagatggtcgccgcgaacatgaccacgtccgtgtccttgtccggcggccgatcgtcgaggtggaggacgtcggggatgcccgaggggaactcgtcgcggaggatcgcgttcttggttgtctgggcgacggcgaagaagagccagccgccggggtgggcgccgaagcagcgcgcgtcgcgcgggatgtccggaatgtggaagcggtgggtggcgcagccgcggagagcgcacgagaaggagcgctccccatctcccgggaggaggatgtacgggagaggcctctcctccggcggaggatgcagcggcttgacggcggcgcgccaggcgtggcagacgcgggccatggtgcggcggtcgacgaggcacgtgaggcggttgtggacgaggcggagggattccgccatgaaatcgcgcgcgggcgctaccgcgtccatgggagaggaggaggcgaaggcgaggcgtgaaggtggcggtggcgagggttggccggcggaggaggtggtggaacgcgacgaggacgcttcgtcgttgtgcgccatgtttgaacttggcttctggaagcaggggaagcttggggtggtttggtttggaagaagaagcagagaaggccagccttttgccagccgagcaagaagttgggcttgggcccagtttatcgtgacggtttgcttgggcctgaagttttgatagctgcactttgttgagcatttcttcatgggcctaaagaactttggatctgtatgatgaagttaattggcccgtttattctttcgtaattatatatgccgagaaatgaatgttagctacagaggaatgttgtgctgagggaatgtttcatctcatcatcatctgagatccatgtgtcatgtatgcaggagtactaccttttcataacatctcttcagtacttttctggcatttttaccatgaacttcatgatgactcaatgtagaatggttggtgttcatgacttggattgcattggtggccgccgcctgctccactgcaatgcggtgttcttgtatgaacttttcaggattaacgcaattgtctcctggcatgaacgtgcagaactattttgtaccatcagagacatcagacagatgctactactttcagagaaatcagaaatgtaatgggcaacgctgagaaaaccatactcattgtgtagcacttaacttttttttctgaacagatgagtagaacatcctctgttcagtagctgtgattcagtgaacagagcaacaaagcacctatcacatacctgtatggctgtgtttcaaaagatgatgaccacattgaacaaataaccatctcacctgttactaacactcaactttttacatcatgtacatagtccaggaataaattatgtcacaggaaaaataaatccagtggtaacaataatagtaattgcagaagaacaaataacagacatattatttactactacgaggtaattaacttgagtgaaacaccatgcaattgatcacaaagcagctagtactatcaagaaagcaaagaaacgatcaaattcttgcaagatgacgatgttatctcagtatgacaaattaagaagctgagtgttgaaactaatttatagcatccaccaaggattcagaatttctgactagatctcctcagaaatgaattgaagcaactgaaagaaagctgcagaaacaattcctcttcattgaaaatacattctatatatgcagcatggtgcactaatgcaatccaactcatgaacaccaactgttttctgcattctgtaatcatgaagtatataatggtaaacataccagaaactcagaacgtactgaagagatgttatgataggtgacataggtcgatccttgcaagtatacaatggaacatcacagattgtactaactggacaatcaacaacaactgccatatctgaagttcagaactggctgaaagaaaaaccgaagaagttcagaactggaatgaaaacaacaactgttcactgatcactgatcagcaccacaacaacatcacacggacacgtcgatgtgaggcaagcacatctcatccagatcgatcggcagaaagctcgatcttactggagaaaccaagccggcggtgagtagtggttcgacgggccttgctccggcaagaacttgtccacgcggggaacctccccggcggccgccagccactttccgctgtctgtgcagggccagcaggggcatcgcggctcatcggcggcggcggcggcagcctgatccacgaacaccgccgcctcgcagtacagcctcccgtcgtccaggaagtagactccctcgttgaactcggcgcccggatacttgttcgcgtcgtacgatctggagcagcctcgcgcgacgaacagcatccgcccacccagcgactccagctcgttccaaccgtatggtgcctcgtcgttgttgatgggagtttccagcggcggctccaccatctcgaacaccttgaacgccgacgtccttggcggcagtcggggaggatgaggaacgagcctgacgaccatgaggagattctcgccggactccaccaggtagcgaacagcgatggctccgccgtaatctcgcccaccgcgcgagaagcgacgaaacaccatgggtgctatcttcagattgccatcgccgtcttcgtagaactcttctacttcaaaaacatggaggtgctcttgcgcggtgaggaaatagaaggctcccttgtggtgtatgacatcctccagaagtcgcccagcaatggtgttagtacaggtcgtcgccactgcaatctgcttccccatgcgccagaatgcatgaacgcgtggactatacaagctggcccggtgaaagacgatggcggcgccgacgcagcccttgtcctccggtggcgaagagagggtcgcggcgaccatgacgatgtccgtgtcgaaggctggtctccccgcgaagtcccagcgggcgatgtcgggtaggtagaaccgctgctcggtgcggaggctgaggagcgcgtggcgcttgatctggccgaaggcgaggaagagccagccgccgccgtacgtgccgaagtagcgcgcggcgcgcgcgtcgtccgggatgccgaagccgtgcccgcggcagccggcaatggggcacgagaaggaaggcccgtctgcgtcgcgcgggacgaggatccacgggagcgggctctccggcgggtgctgctcccccttgacggcggcgcgccaggtgcggcatacgcgggccatgcggcgccggtcgacgaggcacgggaggcgcttgtggacgaggcggaggacgtcggcggtgagaccgcaccatgaagcgtcgtccattggagaggcggaggcgcggcttgccggtggcgaggaggcgaggcggaggcgcgctgctgtgtgttggggattgattgattcctcctctgcttctcgaagcggaaggagaaaggggggatttggtttggaagaagcagaggtgggttgcttgggccaccaaacgatgtaggccttatatattgggccaattggcttgggccacgagttaagagaaaatgttatccacgccacacaggaataatgtttcatctgagatccatgtgtgtacccaatgcagaatggctggtgttcatgacttggattgcattagtgcaccatcatattgtgttgttagtaatgcgttttcctcatcatagaagagttctttgatcagttgcatcaaacggaatttgcagtgaagatcgatggattgcttcttgagactggtttcagtcgcttctcttatcgggatccaattagaatcctcagtgtatgacacaaattagtttcataactaattcaatcatactgacataacacggtgcatcggtgtcagctaaccagtcaacatgctgatgccttgtctttgttctcctgacatactagttgttttgtgatcagttgcatggggatagctagatgcagaatgtggtcatgaaaaagtagactttctacagtacagcccattaatctgcctccagaggaagctacttttgggccccaagaaagctggccctacaaatgaggccgagtccgatctcacagtggcccacccacttcttccaaaccattccaccatctccttccgtttcgagaagcagaggaaccattccaaaccattcccgccgcgcgcacacacagcgcatcgcctcctcgccatcggcaagccgcgcctccgcctctcagatggacgcgctgtggcgcgacctcgtcggcgacgtcccccgcctcgtccacaagcgcctcccgtgcctcgtcgaccggcgccgcatggcccgagtctgccacgactggcgcgtcgccgtcgcgccgcagccgcagccgccgccggggacgaggccgctcccgtcgatactcgtcccgcgcgccgacgacgggcattgcttcgcgtgcgctctcgcaggctgcgccacccacgccttcggccacccgctcccggccgacgcactcgccgcgcgctacttcggcgcctacgacggtggctgggtcttcgtcgccttcggccaaatcctggactacgcgctactcagcctccgcaacggcacgcgattccacttccccgacacgggcacggacatggtggccgcgaccctctcttcgccaccgggcgacgaacgctgcgtcgccgccgccatcagccattcctgcatgatgaacaatccacgaatccatgcattcgggatcctgaggcatcgaggtgtggaggaggcgactcatgatcctgctgagttcttcaccggccatgctctggaggatgtcgtacaccacaagaaagccttccacttcctcacaagagaagaaaacctccatgttttttcggtaccggacttccacgaagacgacgacggtaatctggtgataccgcccatggaggttcgccgattctcgcgaggcgggcgagattacggcggatgcttcgctgttcgctacctggtggagtccggcaagagtctcctcatggtcgtcaggctccttcctcatcctcccctctttccgccgacgacatgggcgttcaaggtgttcgagatggtggagacgcccatcaacaacgacggggcaccatacgactggaaggagctggaatcgctgggtgggcgggtgctgttcgtcgcgcgaggctgctccagatcgtacgacgcgggcgactatccaggcgacgagttcaacgagggcatctacttcctggatgacgggagactctacgatgaggcgttccaaatcctgaatccctttgcccagtaccgggaatacccctgcagagatcacggcaagtggctgccgccggtggcgccgccggcggcggttaccggccgcgtggacaagttcttgccggagcaaggcccgtcgcactacacgccgccggtttggattctcccgtgagagactgccatgttcttggttacattgtcgtggtacaggtattgcttgcttgctgccgatctggcatggcattgtgcttggcttacagcgaattcaccgtctgatttgatgtggtggttgttgatttgtccagttagtgcagtcgatgatgttttctcgagatccaagtgtgcttgcaactgcttgatccatcatatcataacttctcctcagtaccctctgccattttcaccatgttagagtaatgcagaaattgttggtgctcatgcatgaattagtgcatcattatattgcaatgaacaatgattctgtgtgggggattgcattagtgcacatgcatgctttggatcggatttccagtgaagacgaaactgcttgtgcagcttgctttcagttgcctcaattctcttctgaggatctagccagaaattcagcttgcttttagcgctgctcgggccggaggctgagaagcgcgtggcgctcgatctggcggaaggcgaggaagagccagccgccgctgtacgcagccgaagtagcgcgcctcgtgcgcggcgtccgggtctccgggatgccgaagcaattatttttattaatttttttaaaaaatattttttatgtttaaaaaatattatttttttcgctttttattcgccaatacttctctgataccgtatcgcgcgagtatcggccgtatccctgtatcagatacgtatcccgtacgggaatggcaacaaaatgccgtatctgtgcatcatgcagctcggcgcatgaacagaatcagaaatcgttttatcgttgttgttgttatccttttcctttttcttacataaaaagaatcggcataggcaatttggctttacacttgtgcctagcgatcttgtacttgtaggactattatagctgatcaacccagatagtagtacttaactgtctaattataatcatcctaacactagtaatgaagcaaccaaccatctgaaacaagttaacaaattcgtacctccccgctaaaataaaaaaaaaatcgttcattagacagatccggcaactgcaagttcagaaaatgaatgagaaatgcagatttaaacaactctcccgtggatcaatatttactctcattttatctctcctgtcgacaagagagcagatcattctcataccaataccagtgcgttactgaaaaaaattcgatcactttagatcaataactatcttaaccagttcctctgctgctacaatatactcaatattctacatcacacacataatctatgaacaaattgtgtcacagaaaaatagattcagtaacatcaatagtagtgccatcgcaagagcagataacacaggaagagtggcacagctagtagcaagaaagcaaagataaatgatctgcatcttgcacagccagctgaaaccgatgctgaaaatatctcagtacgaatattctgagaagcttggcatggcaattatgaacaaatgaagaagactagcagttgagttatgaaatatatacaatccatgtccctcaaaacagagtcccatcttggacagttaacaagagactgaaagcaggctgtagaagcacaatcaataattcaccttcaatgcaaatatatttcatgcaaaacatgcttctatgtggaaaattaagcactgctaattgaccacattttcacattgcattataactgacggcaatacaatgatgcgctaatgcaattcatgtcatgaacagcaaatttatgacttcatgtaattcatcagatacaacacctgttttttgattgtcctatgataagatatatttggagtgcggtgcattttacctttggcattcgtccactgctcaatatgtctcatcttcttggtagttggctaaatggtgttaatcctaggctaaaatatcgagtttttgtaggcatagcggcgttgtgctgggcggtgtggttgagtagaaatgatgtggtctttaatggatcaaatgcttactcctttttgcaggtgattttcagggggacatattgggcaagactttgatccttgttgcttaaggaagaggatggcactttggtgaaagaatactgcaaaatgttagagatgagagttttagagttctactccaactatggctggaacttcagaaggagaattcaagattaggttggcacttcgtgtctgtttgatgtggtgtgcctggatggtggttttactgttttgttggttgttcttgactctttttgtggtccaagttattttgtttttgttacccatgtaatgggtggagcttcaatgcttatgtctgaacttggttggctgtgtacatcccgttggatgtagaggccgggtttttaacccattatctaaaaaaaaattcatcagatcagatatcaaattgcattcatgtaaatctgatttggaagcgttttctgctacggactatagagtacaacagcaagcatacctgtaatagcaagccttaagaacaatattaatactccttgtatatgtcatctcattgttaattatcagtaaattcagaacctgttggaaattatgaacaggtgaaaatgactgcatagtatgaaatttgtagcacccgttgtaaggattaacaatgcaaatgcaattcatcttcgttgaaattcagttgatccaaagcatgcttagattaggaaaaagccaagtgctggtgttaactaaacgcattctcacactgcagaatcgactgtaatacaatgatgcactaatgcaattctgaaaattagcagaaggtacagaaaacatgaccgagcaattgcaagaacgcatgggcctcgaaggctcgaaatcgaatgaaacatcatagattgtagttactgcacaaatcaacagccgccaaatcagctcactaatgaaaatagcaactgttaaaactcgctctaagctaagcagatctcaacaagatcggcagcaaacattacctgtgccacgacgatcaaactaacatgagcacgctctcaggggagaagccaagccggcggtgagtagctcgacggggcttgctccggcaagaagttgtccgcctccgccgcccccagcagccacttgccgctgtctctgcaggggtagcgccgtccggtgccatcgaggaggaccgtgaactcgtcgtagattctgtcgtcgtccaggaagtagacgccggcgctgaacccaaccccgggtaatcggccacattgtatgattttgagcagcctcgcgcgacgaacagcatcctcccacccagcgattgcagctcgttccacgcgtactgggcctcgccgttgttgatggccagctccaccatctcgaacaccttgaacgccgacgtcctcggtggcatttggggaggatcagagacgaacctgaccaccatcaggagattctcgcgggactccaccaggtagcgagcaacgtcgcgtccgtcgtaatcacgcccatcatgcgggaagctgggaatcttcctgggtggtatatccagatagccgcggcggcctactcggaactccggtaccgcgaaagcatggaggcgctcttgcgcggtgaggaaatagaggctttcttgtggtgtatgacat

SEQ ID NO: 65895 - DNA, 20744 bp, Oryza sativa
  unsure (1)..(20744): unsure at all n locations
ctatcatgaccatgtccctgatgatgctaggattcaggtcgagcagacgattccgggggatgctgatgcagtacttggtgcgaaggttgagnagnccgtcccgcccgtgcccgcgggtgttgccgaagtcgaggaagagccagccgccgctgtacgtgccgaagtagcgtgcttcgcgcgcgtagtccgggacgccgaagtcgtgtctgcggcagccgccgacggcgcacgagaaggtagggccgccggagctcggcacgaggatccacgggagcgggcgctgctgcggcggcgccggcgccgcgacggccgcgcgccaggacttgcaggctcggcgcatgttgcgccggtcgacgaggcacgggaggcgcttgtggacgaggcggaggacgtcggcgttgaggtcgcaccatcgcgcgtccattggagaggccggtggcgagaggcggtggcgcggctggccggcggcgaggaggcagaggcgcgctgtgtgtgtggggattgattcctctgcttacttctagaagcggaaggagagaattttggtttggaagaagtagaggtgggaggcgtgggccaccaagcgatgagactaggccttatattgggccaattggcttgggccacaagttctctcccttgagcgtcgcgtgaagagtgaatgttatccacacaggaatgtttcatctgagatccatgtgtgatgtgtgtacttggattacataatggctggtgttcatgacttggattgcattaattgcttcttgagactggtttcagttgcttctcttctcgggatccaatcagaatcctcagtagatgacacaaattagtttcataactattaatttagtcatgactaatttttttgaacgactcacgtaagacagtgcgaagttcatttgatagagtagaaaaaaactacaagattacaaccctaaaaggtcgtaaccagaaaaaaggaaaaaaaataccaccacccacacaccgacagcgccaaaacacaggttcgggagaaggctagcaccggaccggccgccgctaagtgtgaccgaccgccgctaggccaacaaaggaacacagacgagaacgcccaaaaaaatgccattacaatcaacacaaagcccaactctatcctagagcgtgcttgcaccaattgttcgagtggtttcgacaggaggatgtctaaacgacgtcaaacgacagaaaaccgctgagtcatgactaatttttgcaagttgaggtcctggagtggagtagcaggatccttctagtcacaacattttctctccttttctgcttatagctgatgtataaagtcctcatacaaagatatgcaaaccttatgcatattctcaaataatagcttcattcacgtggaatttcctttcggttaagaacttaccctggagtctctgatgcgagtgcttatcagttcatcacttttgtttatcgagttacggcctgaacagtaattaaacaagttattacctaacttcccaattttaatcaagttaatactagtaacgagtatccaaccatcagtcatcatcagatgctgcaaattcagaaaaataaatgggcaatgcggagataaacatccacctctccgtgtcccaacttatcctctcatttctacacttaagtagagcatttagcagaaaatcatctgatcagtattagtgtacagacctactaccaatctaccatcagccatcaggctgtgttactgaagaaatgctgatagcagaacatcatctgatcagtactagtgatcagattaacacgatgcctatcatctgtgttactgaagaaatgctgataacttgggatctgaaggaatacctcttgacaagagaaatatactcaacattttacattatgcacataatctaggaacaaatcgtgccatcctggcacaaaaaaaaaattctgtagcggaaacaagtagtccctaagaagatcaaataaaatccagatgatcgtacaacaacaggaaacaaaaagtaaacgatctgcatctttcacagctagctaaaagtctgaaaccggtgtgtacaagtaatgtcagaagcttggcatgctatattatgaacaatggaagaagattataaatgaatcaaggaaaatatatagcagagattgaaaattcagctaagatcctctaaagagtggcaccatcctaccccagttcatgttggactgtcagcgaggaactcaaaacaggacgcagaagcaattcagattcactgtaaaaccgtttgatgcaaaacatacttctatcaggaaaactaaccactgcaagttagttaaacattgaattgtttttttattgcggcatagcatatattaatgcaatccaagtcgtgatgaacggcaaccatttgaagcatattgcgttcttgattcactgcagcatcagatcacacaaattcatagtttcatactgcgttcatgattcacgtagttctgacttgaaaacattttctgctataaaaggagaaattctccagcattatagcaactaccaatccatgattatgacatcaaatctggactgaaactgaaactgcactaatccatcgcagcaagaggagacgggacagagtacaacggcatcaaatcgacagctgatgcagaggatggagaccgccatgatcaagcacagcgagcagagcgcacttggctctcgaagcttctggaagcaggaaaggccgattcggtgggcccacccaagccgtaacgcctctctcttcttcgtcgagctgctttgccgccgcgcgcgcgcgcgcggaggacatcgtccacctcgggcctcctctcgaagacatggaggacgagctgggaggcgctcctcttctccatgagcctccacctccgccccagactccgccccgccggcgccgcaccggcgtccccgtcccaattctccacggcaacaactgcaacagcgacctctatttctggctgcctttggtcgacgcgaagggagtccaccgcggagacctgcgtttaccggacgttcgcggcatcgctgaggcggtccgcgacggcgccagggtcgtgtacgccgacgtcgtcgatggcctcggcggaggtcgcgtggtggcgcgcatccggggacagctggtgctacttgaggtagcccctctggctgcctatgccggtggagatggcggcggcggcggcgacgacggcgacggtttgcaggtatgcgcacacaccaactcgcatcgaaatgcttgcaaccattgcttgttagttctgtgtgttgaattgacctcgtcgtcctcctccgtgaagatgtatgttccgaagctatctgcggagaattgcgagcacttctgtcaggcctccatctccaccaagagcaagagaagatacagaagagatgatacaaggaggagcagaggaggaagaggtgctggagcctgacgacaaggaagctgatgcccaggagcaaggaggaaaaccagacttcaagactaagaagaagcaagtaccagtccagcttgggccaagagcaaggaggcccaatccacgctacaagggggaccaatgggtccagtaaacaaccagctagcatgagctgtctgagagagagatcagccgaagctatgtaatataaacatcaacgaagaacaagtagaagggggctaagaactggaatatgcgcggtggcgtaggcggcggcggctcgatccttcggggttgagaaatcttatatgcgcaattcgtgattaattccagttcctgagagataatcgttgggagttcctaacaacttcttctgggtccctttcgtggacgagatcggcaccctacgagggcacgtgccgtcgtcagccctgggaggcatcgccgacgcggtccggggcggcgccagggtcgtctacgctcgcatcggcggcgtagacatatccatatatttgagtcggttttaagatcgttcacttttggtaatatataaggaatcatataagaaatatgtttaaaaaaactcgcatgctaacttgggacgatcggactcccaagtacatctcatgattttctaaaaatatatatatccaagcgaactcccacgttaaatttcattttaactaaaccaaatatataagattaaaatagatttcacccgttgcagcgcacagacatttttctagggaataagttcactttgggtccctctattcgttgttcagtccgattttcgtcccttgaccgcaaaaccaggtacgacccgtcccccaacttatgaaaaccaggcaaacgaggtccctcaacggttttggctgacgtgacgcctacgtggctaatttgactcggtcttcatctaacgtggcgcttacgtgacaatttgatctggaaaaataataaagctgtgggacccacatgtcattttcacacataaaacaataaaaaatagtgggacccacgtaggccccacatgtcatactcaccccctcatcttcctcctacctttccctctcccctctctccaactctctcccctcctctctccagcctccaagcaccacggcccacggggtcaggggaggtccggcggtggcggccggcgacgcgacagccgccgccggcggcgagctccacctctcggcgcagccgtgcagacgttcagtagagctccttgttcacgtcgttgagtacagcatcagcatcgagaccatggacaagatcagacactttcgagggattccactgggggtactcgtgccagttcggtagcttgctcactcctggccaaacttgctcatttggggtgcccagcaacctggaaccaaacaatcaagataaatcaccaccatgaatacacgattatgccccttaagtttgccagcgaacacaaagaacaattgatgaggaaacaggcacagtacttgaaaatgtgcagaagctgctgaacctcggaatctccagcgaaaagaggttgagtagtgaccaactcagctgaaatgcacaagatatatcaacactgtcaaggcatgaatcctgaagaaataataatttacagtggctaaaatatcagttcaccataccaaaaaatgcagcccacagaccagatgtcaaccggagtggagtagtgtgttgcgccaagaagaacctcgggagccctgtaccacagtgtcaggatctgcgcaaaacaatccattcatcagagagagatccaggaacagaaatcacgcctgcgaaacagatcgtcaagcagatcagagactgctagtaggaagtaggaaccggacgcctccgctggttcacccccgccgccgaggttgcctccccttcccccaaccctaggtttcctgttactcgtgttctgtgtgttcatccgcacgcgtcgtcgtcttcaggtggatctctgcggccacgcgacgctggcatccgcccacttcctcttcaccaccgtcctagcgaagcagcagcacgccgccatggtcgagttcgtgaccaggtccggcatcctgaccgccaagaaggttcctgctccgcgtccgccgcggcggggtcagaaacgcgcgcggcatccgaggaggcgccgggaacggctgcacggctgcgccgagaggtggagctcgccggcgacgccggctgtcgcgtcgccggccgccaccgccggacctccccgtgaccccgtgggccgtggcgcctggaggctggagagaggaggagagagagttagagagaggggagagggagagggaggaggaagaagatgagggacatgtggagcccacgtgggtcccaccatttttttattgttttacgtgagtcccacggttttattattttttcggattgaattgccgccacgtcagatgaagaccgagtcaaattagccacgtagacgctatgtcagccaaaaccgctatcaaaactgtcaagagatctcgtttgccccgtaagttgggggacgggtcgtatctggttttgcggtcaagggacgaaaatcggactggttgacaaatagagggaccagagtgaacttattcctttttctagtgattaaaaaaaagtaaagccttcatacattttagcccatttatctgccacacgaggaagctacggagtactcttggggcccgagagagtggaccttttaaatgaagcccagtcggatcgcacggtagcccacccacttcttccatgtcctcctgtgccgagaagcagaggaaccaatcccggcgagggcgcgcacacagcggaatagcgcatcgcctcctcgccttgccaccggcaagccgcgcctccgcctctccaatggacgacgcgccatggcgcgacctcgacgccgacgtcctccgcctcgtcgaccgcagccgcatggcacgagtctgccacaactggcgcctcgccgtcgcgccgcaacagccgctgccggagacgaggccgctcccatcgatcctcgtcccgcgcgccgacggcccttccttcgcgtcttgatttgatatggtggttgttgatttgcccagttagggcagttgatgatgcgttctcgagatccatgtgtgcttgcaattgcttgatccataataacatctcttcagtactctctgctatttttcaccatgttagactaatgcagaaattgttggtgttcatgactcagattgcagggaagacgaaactgcttctgcagcagtgcagcttgctttcggtttgcttcaaatctcttctgaggatctaatcagaaattcagaaattctgcattcattgtttacttttctcaactttgtggcatcctgtccaatggtgcagttaaaaccagttcattgcttaattacttactgggaacgccaagccgtgattttgaggaaaatgcattcatattcaagcatgcggattcactaggttgattcatatggacacatgggagcatgtagagttggacagatggttattggtcctcccggccaaaaataaaaaagagaggaaaaagaaaaggagagatttattggtccaatgtgatcatcatctttagtaacacagatatgatggtaaaactacccgtacagattaacagatatgatgcctaccaacctaccatcagccatcaggctgtgttaccgaagaaatgctgatagtataacatcatctgatcagtactagtgatcatattaacacgctgcctatcatctgtgttactgaagaaatgctgataacttaggatctgaagaaatacctcttgactgaagaaatatactccacattttacattatgcacataacataggaacagatcctctgaagagaaaaaaaaaactagaatattagggaaggacctaatatcaaataattaggaggggtgaggctttgaatccaggtcgtctagcccaccaccttgtggagctagccggaagacccctgggcatttctcgatcctctgaagagtggcactagcctacctcagttcatcttggactgtcagcaagaaactcaaaacaggacgcagaagcaattcagattcactgcaaaaccgtttgatgcaaaacatacttctatcaggaaaactagccactgcaagtgacacattgcattgttattgactgcagcataacgatgtactaatgcaatccaagtcatgacgaacggcaaccattggaagcatattgcgttcttgattcactgcagcatcagatcacacaaattcatagtttcatactgcgttcacgattcatgtagttctgacttgaaaacattttctgctacaaaaggagaatttctccagcatcatagcaactaccaatccatgattatgacatcaaatctagactgaaactgcaactgttgactgaaactacactaatccatcgcagcaagaggagacgggacgggacaaagtacaacggctgcaaactaaaccacatctcggaggatcaaatcaacagcgaatcatacctgtaccaggacgatcaaaagtaacatgagcaatctcaggggagaagccaccccggcggtgagtagtccgacgggccttgctccggcaagaacttgtccacacgaggaacccccgccgcatccgccgccggtagccacttgccggtgtctctgcagggatatcgccgtcgccgccgccgagccgtgaacactgccgactcgcggtagagcctcccgtcatccaggaagtagacgccctcgccgaactcatcgcccggatagtcgcccgcgtcgtacgatctggagcagcctcgcgcgacgaacagcatccgcccacccagcgattccagctcgttccacgcgtacagggcctcgatgcgcgtccccgacggcggctccaccatctcgaacaccttgaacgcggacgtcctcggcggcgcgtgtagacgatcaggaacgcgcctgaccaccatgaggagattgccgcgggactccaccaggtagcggacaacgatgtctccgccataatcgcgcccacctcgcgagaagcgacgaatcgccctgggcgccatcttcatgttgcctttgccgtcttcatggaaatcccgtactgcgaaaacatggaggtcttcttctgtgatgaggaaaaggaaggcccccttgtggtgtatgacatcctccagagctggctcgtcgatggcatcggagccatgacccatcgccgcagcctgatccgggaaagccttcgctgactgcacgcgccagaatgcgtgagtgcgtcgaccagcctcgtagggcccgtaggtgatgatggcggcgccgacgcaatcctcgtcctccggtggcgaagagagggtcgcggcgagcatgaccataccaatgtaagggacaggccgccccaattcagcagccgtcatgtccgggcggacaaagaaggggaggcggaggcgcagctgaacgtcgcggaggctgaggagcttgtggcggaaggtctcgcggaaggcgaggaagagccagccaccgtcgtaggcgccgaagcagcgcgcggcgcgggcgtcgtgcgggacgccgaggccgtgtccgccgcagccgcggagggcgcacgagaaggaagggccgtcggcgcgcgggacgaggatccacgggagcgggcggcgatgcggcgcgtgctgcagcggcttgacggcgacgcgccagtcgtggcagacgcgggccatggtgcggcggtcgacgaggcacgtgaggcggttgtggacgaggcggagggcttccgccatgaagtcacgcgcgggcgccgccgcgtccatgggagaggcgaaggcggaggcgggggcgaggcgtgatggtggcgagggttgggcggcggaggaggtggtggaacgcgacgaggacgcttcgtcgttgtgcgccatgtttgaacttggcttctggaagcaggggaagagaggggaacagagtgaatgggaggtttggaagaagcagagaaggccaagccttttgccagccgagaaagtggttgggcccaatttatagtgccggttttcttgggcctgaagtttggatcgctgctctttgctgagcgtttcttcttgggcctaaatgttcccctttttttttagaacgtaaagtttggatgtacatggtgcagaatcgtgtgcgccatgtttgaacttggcttgtggaagcaggggaagagaagagacacagagtggcttggtttggaagaagaggcagagtcagagaaggccagcctcatggtggttggtgttcatgtcttcgatagttcgattgcattaggtaatgtttggttggtggaataggatgggatgggacgggatgggacgaacttacttttagaggtgttttgttgaggggcgagtggaatgggttggtctctagagaggaatattcctcccagatccgggacaaacccatccggcaaaattggccggacgagctcgtcccacttggacggagcacacagtgtctcctcggcgaccgccggcgctccgccacgaccgcctgccaccacctccacgaccgccgacgctcctccacgaccgccgacgctcctccacgaccccctgcctcaacactggtcgccgccacgagcgagatgctcggcaccatcccgccactcatcgcgatgctcgacgagagcggctgcggtgatgtcgacgcggcgggctcgagtggcggcgaagcttggaggtagggagggcggcggcggcagatccagaggagggggactcggcggcggcgaaacttgaaggtagggagagcggtggcggcggatctggcgcaggggatctcccgatccagccgcggtgacgacggtgggccagcgggttgggtgctccggcggtggtggccgtcttgctgctgccgttgtgcttgatccggttgttccacgcgtggatgcaggtggcgcagtcaacggtcgttgacggtgatggcaaacagcgtccatcccatttctccctcatcccttcaaccaaacaaaaaaattgggattgtcccatcctacaaaccaaacatgtgagtggaatcatcccaaccccaaaattagggatgaatggtttcatcccatcccatctagtcccgaaaccaaacacatgcttagtggatcatcgtcgtgttgtagttagtaatgcattttctgcgatgtgtttactcaacattacttagcgttttttctgttaaaagaatgcattgcattgcatcaaaaccgatttgcagtgaagatcgatgaattgcttcttgagattggtttcagttgcttcaattctcaggatccatttaagcggatgctacatattaagttcataactattaatttgctgttcttctccacttatatcttttaaattactagaaaaaatgcatgtgcgttgcaacattgcaacaggtgaatgttattttaatcctattattgttatacgatttacatgggatgaaattcactgtgtgaattcgcttgaatatttttttagaaaatcatgagttataattaggagtccaactttactctcaagtgaccatacaagtttttttaaagaaattttttatatgacttcttttgtattttctaaagcaaacagacttaaaatccgactcaaacatggatatgtatttccaaaatagaacgaacttaataaccgattcaaatacggatgacttaccaaaataccggtaaaaacatcttcaatttttataatagtagagatagagatatattatttttaacatccgtttgacctattgtactccgctcaaaatatgtgataaaacaagtccaatatttaatatatttaaattattttaaaattgtattcttgttcttagctcttatagcagtgtagttactttagataccatgaaaagttactttcttacagcaatatagttatttctagtaacgtggggtaaatatttgcttttattttgtttttagagttactttcctctagcactgagttacttctaataccgtgaagagtaacttctatttctccagacttgcttttttttctagcaatatagttactctagtaatgttaaaagctacttctatttcttcaaagttttttctaatcccataaaaagtacttctatcttatcagttttacttccctctagaagtgtacttacatctaacaccataaaaagttacttctattctttttataaaaagattattttcttccaagtgtgtaattactttgaatacctaaagagttattttctatatgacgctaaattactctttacaaaatatttatagtgattacttccaaataaagaaaattactttctcctctcaatataattactttgtatttagttaggagtcttttctatattttacttcgcatagtttcttatttcaacatcattcaatatgtttcctttcaatgctactcaaaagtgccggttcgttaaaaaagtgctacacaaaacactagacatggcacccatccgacctcaaaacactaggcatgacgagttggcgtcacaaccgactcccctgttttagttttgaaattttttattaggattaggaattatcttagacgagaaaaattatcttagacgaggctgattcagagtaggaaaaattgcacacatcagtaggagactaggaggacatgatactgatcgtctgatccttctcgcattgggcgttcatggcctcgtgggctacataaaaggccatctaaaagcccatagagaataaatgaggcccattatacatttgagcccattaatctgcctcacgagggagatacacttggggcccaagaaagctagccctataaaagaggtccaaactgatcgcgtgctggcccacccaccttcttcttccaaacgaagccgtcatctccacccgcttccagaagcagaggaatcaatcccacacacacctcgccaccggcaagccgcgcctccgcctctcgccctctccaatggacgcgccatggttcaacctcaacgccgacgtcctccgcctcgtccacaagcgcctcccgtgcctcgtcgaccgccgccgcatggcccgagtctgccacaactggcgcgtcgccgtcaagccgcagccgcagccgcagccgccgccggggacgaggccgctcccgtcgatcctcgtcccgcgcgccgacgggccttccttcgcgtgcgccctcgccggctgcgccacccacggcttcggccacccgctcccggccgaagcacgcgctgcgcgctacttcggcgcctacgacggtggctgggtcttcgtcgccttcggccgaattctggagtacgcgctactcagcctccgcaacggcacgcgattccacgtccccgacatgagcatgggcatggtggccgcgaccctctcttcgcctccgggcgacgaacgctgcgtcgccgccgccatcagccattcctgcatgatggacaatccacgaatccatgcattcgggatcctgaggcatcgagttgcggaggaggcgactcatgatcctgctgagttcgtcaccacgtcagttctggaggatgtcatacaccacaacaaagccttcaaattcctcacaagagaagaaaacctccatgtttttcctgtagcgggcttccacgaagacgtcaacggcaatcttgagataccgcccgtggaggttcatcgcttctcgcgtggcgggcgagattacggcggagccgtcgctgttcgctacctcgtggagtccggcgggaatctcctcatggtcgtcaggctcgtcaccgatcctcttctcttgccgacgaggacgtcggcgttcaaggtgttcgagatggtggagccaccgacgaggactcccatccacgacaaggagcccgcattcgcttggaaggagctggaatcgctgggtgggcggatgctgttcgtcgcgcgaggctgctccagatcgtacagcaagaacaactacccggacgctgagttcaacgagggcgtctacttcttggatgatgggagactctaccgtgaggggttatcgttcttggctcccgattccccagaatacccctgcagagacaacggcaagtggacggcggcggcggcgggtagcagcatggacaagttcttgccggagcaaggcccgttgaactactcaccgctggcttggcttctcccctgagagtgctcatgttagtttcacctgtctgaaatgtgctatagtgtagtttcagtcaacagtttgatgtttccgtcaagattggtgtgataattgtcggttggtacagttgctactatgctggagctacctagtaaattctccttttgtagcagaaatgcagtgtggtctgatgaattacatctatgcagcaatgatattgcagtcaatagtaatggaatgtgtaattttcagtgcttatttttcctgatagaagcatgttttgcatcaaatggattttacagtgaagctgaatttgcttctgcaccctgctttcagttgcttgctagcagtccaagatggagttagctgaattttcaatggctcccacacatttcataactttattatctattcacttttccataagttagctgaatttttaatgggcttctcaaattgctgctgggaaacatgcagattgtttctcttctctttcttcatactagttgtttcatagcaacttttttctttgagccagttctgaacttcagatatgacagttgttgattgtccggttacttcagtctgtgatgtttcgtccatgtgtgcagtgtacttgcaattgtttgatctgccataacatctcttcaatacttcacttcatgatttcagttgctgtccagaaaatggttggtgttaatggcttagattgcatatttgcagcagtgcttcggatcaaacggattttcagtttccgtataagaagtagatcgtttatctttgctttcttcataggactagttagttgctttatgatcagttgcatcggggtagtaaataatctaccttgtgttatttgttcttctgtaggaatagatcgtggcacgggaaaaacaaattcagtggtactatcagtatagtaccacacagatacatgtatgttgataactgtttcattaatcagttcactgctactgaacagaggatgttctgctcatttggtcatctgctctacaggaaaaattggttgctcatttggtcattctgaaattgtagcatagtctgatggtagtggtaccaccaaaaaaaagttcttcagacggttgtttcccctttctcagtacctatatggtaaaacgccaagcaatgcttttgccgagaatgacacattgacacccatctccctgcttgagttttgaaattttgattctgaataatttgtgttcacccggttgatgcagaatagcaatggtcaccctatttcagtatttctgtttcgttttactccgaaaaaatgcgtgttgaatttgagagattatgatacgagtacattggaatatgggttttgaaatatcgagcaggctggccctattggcccagtgaaaaagtaaaaccgtggggcccacgaaaactggcccaataaataatgcccagtctgatagcttcgttccccagcccaaccccctgcctcttccaaaccaaagccacccatctcccacctcccgcttcgagaaacagagcaatcaatcccacgcagccacatcgtcgcaatcgatcgcctcgcctcacctcgcttcgcttcctctccaatggagtcgctccaccacgacgtgatccgcctcatccacagccgcctgccgtgcctcgtcgaccgccgccgcatgggccgggtctgccacagttggcacctcgccgtcgcggagaggcagcgcagcaagctcccgtcgatcctcgtgccgcgcgcggacggcccgtccttcgcgtgcgccctcgccggctgctgcgccacccacggcttcgcccacccgctcaaggacgacgcgcgcgccgcgcgctacttcggcgcctacgacggcggctgggcgttcgtcgccttcggccacaccgtgggctacgcgctcctcagcctccgcgacggcgaccggctccacatccccgacatcggcatggccgtggtggccgccaccctctcctcaccgccggacgacgaacgctgcctcgccgccgccatcaacctctcctttctgattgacgatctacgcactcacgcgttctggcccatgcggcgtcaatctgcggctgcgccggagaaggcggcgaaacctgcaaaggtcatcagcggccacgctctggaggatgtcgtacaccacgacgacgccttccatttcctcacgagagaagaaaacctccatgtttttccggtagcgggcttccgcgaagacgacgagggcaatctggagataccgcccgtgnaggttcatcgcttctcgcgtggcgggcgagattacggccaaaacaacgctgttcgctacctggtggagtccggcgagaatctcctcatggtcgtcaggctcgttccccatcctccccaattgccgccgaggacgtcggcgttcaaggtgttcgagatggtggagccgccgctggggactcccatcaacaacgacgaggcaccatacgcctggaacgagctggaatcgctgggtgggcggatgctgttcgtcgcgcgaggctgctccagatcgtacgacgcgaacaacaatccgggctccgagttcagcgagggcgtctacttcctggatgacgggagactctacgacgaggagttgatgctcggtgagcccgatttccgggagtatccctgcagagacaccggcaagtggttgccagcggcggaggcgaatccccgagtggtcgagttcttgccggagcaagccccgtcgagctactcgccgccggcgtggcttctcccctgagattgccgtcgagctacaggtttttgcttgctgtcgattcgatcccccgagatgtggtttagcttgcagccgttgtactctgtcccgtctcctcttgctgcgatcgattagtgtagtttcagtccagatttgatgtcataatcgtggattggtacagctgctacaatgctggagcagtggagattgtacttggtaaattctcctcttctatcagaaagagtatgcaagccagaattacatgaataatgaatgcagtatattcaactcagcatgaatatgtgatctgatgaattctacatgaattacaatggttgccattcttggcttggatttcattagtcggtaagattgcaatgtgtaattttcagtgcttatttttcaggatagaagcatgttttgcatcaaatgtattttacagtgaagctgaatttgcttctgcagcctgctttcagttgcttgctgacagtgcaagatggacttggctgaattttcaatggctgctacacatgttcctaactgaattaactattcacttgttcataagttagctgaatttcagttgcttgctgacagtccaggatgggctgaggtagtgccactcttcagtggattttagcagaattttcgatggctgctacatattttcctaactcataatgtagcatgttaagtttaccaaattactgatacacatcggtttcagctagctgtgaaagatgccgatagtttacctgtttgttcttgatactagttgctcggttctgttgttgtataatcgtctgaatcttagtggagtactattgattctactgaatttatttactgcaccacaatgtattcctttattctgtgcataaggtagaacgttgtgtatgttttagtagcagaagaatggttaaacagttaacagatggttattaatccaaagttatcagcatttaggcattacttcagtaacacagcctgatgttaggcgtcatggtaatctgttcactagtactgaactactgatcagatgatgatgttcttctgccctccctgctctacagaagactggattaaatgagagaaaaagttgacacgcggagaggaggatgattatctctgcattgcccgttcatttttctgaatttgcatgcaggatcttgtgattgatggtaagaaattgttggtacaatttagatggttggttggttaatcaccagcattaaccacgagaaaattttggcagttcactacgactttgatgcatcacttgcagattctttactgttcagtctggaactcaataaacaaaaagtcataagaactcacagactccggaaaattaaaataacacgggtctcaagttattggtccatgggaaattcgacatgaatcaagctgattgagcataactgtcacggtagatgccatgctgattaagcgactttcgaagagggaagaggaggattagcctgaaaaattgaaaaattagcatgaacaggataatgatgcaatcccccagactgaatcattgttcgttgcaatataatgatgcaattaatgcaatctgagtcatgagaaccaacaatttctgcattagtctaacatggtgaaaatagcagagtactgaagagatgttatgatggatcaagcaattgcaggtacacatggatctcgagaacacatcatcgattaactggacaaatcaacaaccaccatatcagcacgacaacaagtcatcagacgatctaactaagaacatggcagtctcacggcagaatccaaaccggcgacgtgtagtacgacgggccttgctccggcaagagcttgtccacgcggccggtaaccgcctccgccgccgccgccggcggcggcggcagccacttgccgttgtcgctgcaggggtactggggaaggggattcacgaattgggacgcctcatcgtagagtctcccgtcatccaggaagtagacgccctccttgaactcatcgcccggatacttgttcgcatcgtacgatctggagcagcctcgcgagacgaacagcatccgcccacccagcgattccagctccttccaagcgtatggtgcctcgtcgttgttgatgggagtccccagcggcgtctccaccatctcgaacaccttgaacgcccatgtcgtcggcggaaagaggggaggatgaggaacgagcctgacgaccatgaggagactctcgccggactccaccaggtaacgaacagcgaagcctccgccgtaatctcgcccaccacgcgagaagcggcgaacctccttggccggtatctccagattgccgtcgtcgtcttcgtggaagcccggtaccgaaaaaacatggaggttttcttctttcgtgaggaaatggaaggctttcttgtggtgtatgacatcctccagaactgacgtggtgacggactcaacagcagtcgccttctcctcaacttgatgctccatgcgccagaacacatgaacgcgtggatcgtacatcacgcagctgtggccgatggcggcagcgaggcagtgttcgtcgtccggtggcgaagagagcgtcgcggccaccatgtccgtgagcgtctcgacgtcagcgaggggtaatttctcgtcgccgcggaggctgaggagcgcatagtccagggtgcggtagaagcagacgaagacccagccaccgtcgtaggcgccgaagtagcgcgcggcgcgtgcgtcggccgggagcgggtggccgaagccgtgggtggcgcagccggctagggcgcacgcgaaggacgtcctgtatgcgcgccggacgagtatcgacgggagcggcctcgtccccggcggcggctgcggctgcggcgcgacggcgacgcgccagttgtggcagactcgggccatgcggcggcggtcgacgaggcacgggaggcgcttgtggacgaggcggaggacgtcggcgttgaggtagaaccatggcgcgtccattggagagggctcgagaggcggaggcgcggcttgccggtggcgaggtgtgtgtgtgtggggaatgggttcctctgcttctggaaggaatttttttcggatttagatttttttttaaatatttacagaaataatctatcgaccaaaaaaattgcagaaatagcccctgccgcccacctctggggcggcaagctgacgtggcaaacgggggaggaacggacggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgagagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagagggaggattctgacaacgagcgtgtagaggaagttgattcgtcagatgatgagacggatattaatccagcagaatgggctagtgaggatttttctaggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgg

SEQ ID NO: 65896 - DNA, 864 bp, Oryza sativa
aacccgacacttgggtcggtgcttgcgaactaaatgaatttccaaaaccgcggaccggggaacgtaccgggggtacggtttcccgctcttgcacttaaggaccgtttccttggaatttcatccgatcataagtcaagtacgaccacatggatggaatgggacacccctggctgagtaactagcttatcaggggagccttgatgccgagagacatgtggattcgctagggtggtgtcggggaggacccctgggcttcctggcacagtatggtctgggacctaacgtgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaataaactgtttgaacagccgtgcccacggtcatgggcggatgtgaggtgattcctagcgtagttttgtttgactactgccttgtgaaattgctgttgtgaaaaggggatcgatgtttggaaaaatctgcagctgatgggatcagctaggcccgggtggccgtttgaaagttgttggcccgggtggccgtttgaaagttgttggccgggtgccaatcttgaacaattctaaagactgatacattacacatactccgaccggacgagacgcactgtctcatccgtgtcgtttgagaagcactcacttagttgttttcagaaaagagttcaaataaaatcaattgcaaaaacaacagtctttccttgaagcctgcattaaacacttatttcccatggcttgctgagtactcccg

SEQ ID NO: 65897 - DNA, 3974 bp, Oryza sativa
caggatggacgacagacttaattgaccaacttgtcacaatctggaccgccactcagacactacaactagaagagcaagaggatgacaaaataacatggaagcttaccagccatggtgaatacacggcaacgtcggcctacaatgtgcaactcctcggcaccacagccaccaactttaataacctaatttggaagacctgggcgccacgaaaacacaaaaccttcgcatggctaatcatccaaacagagtatggacctccgacagactagcaaccagaggatggccaaacggttccatatgtcccttatgtcgtcgatctcaagaaactgccctacacctcctcgcgggttgtagatacacaaagagaatctgggaggcaattgcggaatggacggcgtgtgaggggttgaaaccatgtcggtggcagcaaaccttcacggtgttagaatggtgggaggctaccttaaacatccaggaggcacccaagaaggctcttcgcacactgatcctgctggtcgcatgggagatctggactaagagaaaccgcagaacctttcagcaaaaagagctatcgaccacctcccttctagctaaaatcaaggaagaggccaaaacttgggccttagcgggcgcgaaaaatcttcataattggctttcttttagttagctcggaccaaaggtcctgagctcgttttcgcctttgtacagttttactcctctattcaatgaaaattggcagcttgccttttcttcaaaaaaaaagaaaagaaaaaggcaagtgctggtgttaactaaacgcattctcacactgcagaatcgactgtaatacaatgatgcactaatgcaatccaagtcaaccatttctccattctgaaatcacgaagcatcgaaaattagcagaaggtacagaaaagatggccgggcaattgcaagaacgaatgggcctcgaaggctcgaaatagaatgaaacatcatggattatactaactggacaaatcaacagccgcaaaatcagatcacgaatgaaaatatcaactgttacaactcgctgtaagcagatttcaacaagatcggcagcaaacattacctgtgccacgacgatcaaactaacatgagcacacgctcaggggagaagccaagccggcggtgagtagctcgacagggcttgctccggcaagaagttgtccgcctccgccgcccccagcagccacttgccgctgtctctgcaggggtagcgccgtgcggtgtcatcgaggaccgtgaactcgtcgtagattctcccgtcgtccaggaagtagacgccggcgctgaaccccaaccccgggtaatcggccacctcgtaggattttgagcagcctcgcgcgacgaacagcatcctcccacccagcgattccagctcgttccacgcgtaccgggcctcgccgttgttgatgggcagctccaccatctcgaacaccttgaatgccgacgtcctcggtggcatttggggaggatcagagacgaacctgaccaccatcaggagattctcgcgggactccaccaggtagcgagcaacggcgcgtccgtcgtaatcacgaccatcatgcgggaagctgcgaatctccatgggtgctatatgcagatggccgcgacggtttactcggaactccggtagcgcgaaaacatggaggtgctcttgcgcggtgaggaaatagaaggcttccttgtggtgtatgacatcctccagaattggtccgatgacgccctcgatagcagtcggcatcacagcgacctgacgccgcatgtaccagaacgcgtgcatgcgtgcaccattcatcccgggcgccagtacgagctgatggcggcgccgatgcagtgctcgtcttccggcggcgaggagagggtcgcggctatcatgaccatgtccctgatgatgctaggattcaggtcgaggtagacgattccggggatgctgatgcagtacttggtgcggaggctgaggaggacgtgccggccgtggccgcgggtgttgccgaagttgaggaagagccagccgccgctgtacgtgccgaagtagcgtgcttcgcgcgcgtagtccgggacgccgaagtcgtgtctgcggcagccgccgacggcgcacgagaaggtagggccgccggagctcggcacgaggatccacgggaccgggcgctgctgcggcggcgccggcgccgcgacggcagcgcgccaggacttgcaggctcggcgcatgttgcgccggtcgacgaggcacgggaggcgcttgtggacgagccggaggacgtcggcgttgaggtcgcaccatagcgcgtccattggagaggccgaaggcggaggcggaggtgcggcttgccggtggcgaggaggcgaaggtgcgctgctgcgctgtggggattgatttggaagcggaaggaggaaagtttggtttggaagatagcagaggtgggtggcttgggccaccaagcgatgagattaggccttttatattgggccatttgtcttgggccacaagttctctccgttgagcgcctcgcgtgagggaaaaatatctgtgggccaaaatgttgtaaggcggaattgaggcgaccaatttcatcaggatggagtaggcctaatttggtttgggggaatggccgaatggaccctaatcctggcctgtgatttgcacgccttggacggatgatgcttcattgcatggcacggacgcacggtaaaccaaatttgcttagttcgttcgtacacgattaccaagaaatctatagaaaaattatcttaaaaagtattaattcatttttaaatttttaaagctaatacttagatactatttgacatttcacgatggatttgaagtttgtatattaaactgtagtgatataaattctcatattttatttaaaataaaaaatagattcatacatgtattatcaatgtaatcgtaaattcagatccatagattcatggagttaaaaatatccagctctaaagtattttcgattcgaagctatgtcaaatataatcttaattaatcatgtgcttatccattatttcattttacgtagcgtatttaggaatttcgtcgggttcaactgacacaggggactcggtaactgtaggtctgtagcggtgctgccgccaaggaggcaatgcgtacgagacacgaatttaaggataacaggataagtcaatatttagaagtattttctaaaaatttaagctaatattgcattgaaagtaattcttgctatgttaatttcatagttgtcaatgagagattcaaaactcaacattaaaataacgtgtaaaaacctaatgcaccttatattttatgaaccggtaaatacatcatctccgatctaaagcatgaggccagataagctggttttataattgcgtcaaacattgaatttagtaattataagcattaattaactaaatatgtcgatcatgcatagcaagagatcaagtcgtctttgcgcatcgcataataatatttccacgaactctttatacaactcgtaccacatttctaatttcaaaagtaaaattaaggcacagagttcaaagctgttttctcattctctagtcaatttcgtacggagcagcagttaaacatggtaattaagggctttttttttctcggaagggcgtatttgccatcgagctaatcttgtgggctaatctgcaaaaataccagaagagaatcgcactcgctctatttatatcgaccttcctcctctccaagccaagcggcttcatatcatccggcatccagagaaaaatatagcaacgaaaaaaaaggagaaaaaaaaaacagtctctcttccggtaatcttctcgatctcacctcgctttgaactctccgctcgattttttttctatgatttctccaatctggttaacttggattgttccctacccccagaaatctgttgtagtgtagatctggtaaatttgtttccctcacatttttgcgctct

SEQ ID NO: 65898 - DNA, 1205 bp, Oryza sativa
gctccatttcctcaaggctgcttcggtgtttctgagcttttgacttagccgccaagtggggtgaccttcctggataggctcgttccaagcctaggttacgacgcctaggaaaccttccactctaatctagaaattttcaaatcggaacctcagtttcctctttggttcttgcattggtgctagcagcaactggcagtggtctgagcaggatgtggatagtgctagcaaggaatgcccagagaaaagaatatctccctcactattgctcagaatcctatctaatttgcttagaatcgggtttccctgctcattactccaagtgaactgcctgttttgcaatctattgtcttttagctccaaagtatttaaggttgacctgaagcgccccattagacgtctgttcaaattctggttattcttatccctagcctcgtatatgatgttgaagtcccccatgaccaaccatggcgtgtctgttggtggcttggctgcgactaattcggcgaggaaattttccttgtcacagtcttctgagggtccataaactactgtgatgatgaagctgaggttatcagttatggtcattccatcgccgaaagatggtgtgttccttgggagaaattcgccatgttaacaattgtgtcatcccagaagatggcaattcctccacgagttccattggcaggaaggaaattgaagttcgacaacctgtttcccccaatctctttgccgatccattggtctatactacttaattttgtttcttgcaagcacaggatgcctgctctggccagctcggctgcttcgaggactgcctctcttcgtgctgggttatttagtccgcgaacattccaactgagaattcttagatgttgtaacatttgggcgaagtataacacataattttttccaaaaggatcgatcccatagtgttttccaaatgaattagttcataagcagatagagggctacatattttcttccatgacctacaactacaaaccaaacatgaccatgtagaagcaatttcactatcttctagcctgtctactctgctactaaccagctgaaggccggtgtctaccgggagcgctattcgcatcaatcgactaaggagctccggcttaaggccgttgctacatgggagcgctagtcgcatcgaccatacagcgagcagcggcttaagaccgcaaagaaatgtaaag

SEQ ID NO: 65899 - DNA, 523 bp, Oryza sativa
taagacgaccttttcacgttcaccttctcctccgtggatggcctgagtctggaccgtggcctggtgttgctcctcgcagtcggcctgctgcaccagggtgggctggtctcctgtgaaagcttgggcctcgtcatcttgagtggactgagcgaggaggtccatcttgggggcctgctgcgtatctgggctgagatggcccatcttctcctggcccaacttagctgccgacgccaccttatcctctcccagtatcggttcttccccacccgtcctcttcgtctcgttctccgcctcccgtgaagacttgggagcgatctctgctaggagtggcagcatcgggtcgtggttcccctgttcgtctgagaaggggaggagaggtaaggagcataggatctggatcagagggtcggggagactcacgagagcgtcgactggctgcttgtcacgccccgaactagtcccgagcggaactagcccgtgacgctccaaattaacctgttaaccgataccagtcccaggaaat

SEQ ID NO: 65900 - DNA, 1524 bp, Oryza sativa
aaaccaccgtatcctgttttccttggtaataaacacggtaaaacgcagcacagtagagtaattctacggtccttgaggatgtactaaaaatttagtgtaaaatttggtacctcatgatacctcataatacctaggtatcaagagataccaaatttacagtataaaaaatagtacctcatggtacctcctcaagaaccgtaaaattgctctatccaaaagagtaattctacggtccttgaggaggtaccaaacatttagtgtaaaatttggtacctcctttccctatagggattgaggctcctgttctatcactctgaatttatgggcaaaacctcaacaatatgacgaacagatctgcattccatccttaccacctttgtacgtattatgtaggagtatgtgtgtcaagaggtgaacggtgtaccataatgttttaccagcattccatccttaccacctttgtattatgtaggagtatgtgtcaagaggtgaacaatctaccgtaatgttttaccagaatggtaaaagcataagcatgaatgaatgctcacgcttctcgtatggaacaaaattcagctgactgctttgttattttcaatcataccacgagtctcttactgcctgccaggtgaaccactcgctggtctttctaaccaactaactgggctctgtaataatctttgctcagtggtgtgtcggtgcctgtttggatatatattgattatactgttaatttggtatcttttggtaactaggtagaacaaaaccatttttaatggattctacacatttttcttgatttactgagacttgagtgggattaaacggagctcggatgaattagttatgaattttagaagattcactgtgtttattactataacaaaaatccttaaataatttatggcgcaatattaaccagggctgacgtcagcacgggggggagtgcggcgccgacatgcggggcccactggtcagcgactcaagggtgagcggttcaccgtggaccgggaccacgcgggtggtccatcgccggtccacgggaccgacggcccagatcgccctcgggccgatcggacggcggcggtggaggcagccgccgggctcggctcggcatcaaagccgaccggccgacccggggctgacggcggcggcacgcgcacatcgcgttgccggcgacggcatccggcggcggaggcgacggcgcaaaagcgacgcgaaagcggcggcagtggacggcggcaacgaccaaaggcgacggcaagcgcggcggcggcgacgcacggagaatcgaggaagtaaaggaaaggggaaggagtcctcaccgaaggggacgacggcgtccggcgacgaggagcgacggagggaagtcgacacgcggcggacggcgaccgggacgacctaaagaacgaaacgaaagggattagagaggaagagaggggccataggaggcggggatgccggccgaaggcgggggacatggagaccctcaccgtcgcacgactggaacggttcttccgcgac

SEQ ID NO: 65901 - DNA, 1037 bp, Oryza sativa
aaacatatggtccagacccattgtttatctctctgtcaacttttcctcccatggaggtaaatgcaaacatggagttatatactctgatattgtccatgtagttcctcgatctctttcctttttctttgcacatcagatttgaaaggtaagtaggtggtttctttagtgtaggtaagtcaaccttgccctgtttgcagcataagctaaaagaaggtggcccttttcctttgccacgagttctttcttcataccaaaaaagtgcaccacagtgttgacatgtgcatgtaggcttgccaaaattccattctttcacgcttgattttttcttcttccttggtggtacagcaaccttattccttgtaatgtttccttccttacttactcgatcattcatcttgagactggaagacaaatattttttttcataaaaaaaaagtgatttaaaaataaactgaatgacgatatcatttttataatgtggttaacatacctattcgtttccatgttggttgatgggatctgatatttttcttttctagacctgattttattcatatcacagtcagtgtttattcttaaataaggaaaaatttcctttctaacaattttgttgattttctgtatgtttacctttcaatgtgatttgctggatttgaacaggtcgaactgttgttcaatgtagatccgcttcttctaaggtcaagtttccttttcctgttcagtcttgataagcgtgcgagttccgttgagtttacttcagcagtgaagttcgagctgtgaaaattggatgtcaaaacagggagataactactttttttgactgattctgatgtattgtgcctattcggaaattaattgttattaaatacatacgcttgaactgttaaacttggatctgaaaatcagttcataattgttgcggttgaaataaattgttattaaatacaggaccttcataggtaattgtattcttcgcctataattttacctttgcaggggatttcctgtgtctgcgcttgactcattgttgctcattt

SEQ ID NO: 65902 - DNA, 626 bp, Oryza sativa
atacaaaagtaatcctcaaaagttgtgttcactgttcgagctcgtttctaaggataggcgggaaaacacttctttccggcctatccccgatcttgttcgtgacctaaggtcacaacagtggcgccgtccgtggggacggaaagtctccattgaattgggctcaaacagtaaatgcgacgttctcaacgacagaagactgtgccagtacgctatacaggagcttttgcaagcgcgacagctgcactcgagagagagtgggaaaaggcagtggaagaaagtgacttggtaagagcaacggaaacacttgacaagcagtgggcagagatggccaagacatccacagcagcaggaggtaatgaaacaactcaagaagaaagaattgctggtgcggtggtggaagaaacagagaaaacacccatgagtgatgtagagcttgctgaattggtccaagcgcaaggggctgtcatggtgagtaaaggacaatatgaggaattgcaaaaagagttacaaagattgcaaaccctacacaatcagacagtaggagcaggaggatcaagtgatcagtgtgcaataccaggggctagggaaaagcaatcagatcaggcaaaaggtgatggactacttgc

SEQ ID NO: 65903 - DNA, 7455 bp, Oryza sativa
actgatcagatggtttatcacctacttcagcaacaattgaagattgttgctgctccatcccatccataggagactcatgttgccccattgtttgcgcctccaaagaccttgttttcctcctagtataaacttgtagattttcttcttcacgtggccttctccaattttgctcatgaatgggttcactaacaggatatgggattgagccaaccacaaatttcatgcttcttgattgtgtgtcttcttcagtacctgatgagccattctccccctcttgtccatcctcatcaataattggattgtcaagatcaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggtctatgatctctgacaaaacaagtacacccaaacacttttggaggaacaatgaattcattcttcccaaacaccatttcatatggagtcttcatcccaagtattcgtgatggcatgcgattgatgagatatgttgctgtcatgactgcctcactccatagaaactttggtacattcatcgtatacatgagtgaacgagttacctccagaatatgttgatttttcctctcagctactccgttctgtggaggtgtgtcagcacaagaagtttgatgtactattccttctgctgagagaaaactcctaaattcatcattcacatattctcccccattatcgctcctaataacttaacacaagtgttaattgattcctaacccaagcatagaaattcttgaaacatttcaatacttcactcttgcgtcttatgagatatattcaagttattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgattttgtccaccttactcatctcatcaggaaataccttagacatagtatcaaaggacatatgtcccaattgacaatgttttagaatcaatttagcctcctcttcacttgtgctagctaacaaagcactacatagtgctttgtccgtccctcttctatctagataccacaacccattatgcctaacgccggttccaagctttcttccagttcttctctcctcaattagacaattctctcggtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaacggacaacaatagccaatagcaccaaatccttctctgttgatcctacagccaacagctgcgcgtctctcagccgctgtgctccctacagcttgtgctgcaccaaatccttgcgcagctcaaccagcgagcgtgcgccctgctcctccttcacgctgctcgcgtcgagaacctctgcagcagccgtcgccgcctccgccgtcaacactgccgctccgcctccgctgtccgacgtcgccgctccgcctcagccgtcgacgtcgccgcagaacccctctggtcacagcgccgccgccgactagggttcgcgtcggcgaggtcgccggtgacccagctctgataccatgtagttttgtgatttttcctctagaagcttcacttcatttcctttctcatctactatacatatacattggtggaatgggccctattgggctgaaatacacacgcctacactcaacagttaaagatggaaaatgtaacagaaaaaggttttggagttaccaaggtgccaattgatcattatttcttgtgatacatttcacttgtcccatggcatctagttccagcaggggtgacatttgcaatattatactgatgttctaggtgttcacaatagagctcaaatggcacagcatattccaactcttaaataactttgtgtatgtggtgtgctagtgcagaatgatatccgtaaaaatccactatttagacaacagttccatgagatgtgtgcaaaagttggagtagaccctctggcttcgaataaaggagcttgggcagaacttctagggattggtgacttctactatgaattgggttggtaacttaatttaagctatcttatttattttgatcctggaagtttctttcttttattattggaccatttatgttctgcttagcatctgtgtctattgcaccaggagttcagattgttgacatatgcatagcaaccagagcgaccaacggtggcttgattgacttgctagatctccgtaaactcctgtgtcagaagaggaaagctgatcttggatccttaacatcagatgattgtttgcgtgcaataagtaagctgaaggcaagtattttaaggaattctacagctacatatttttttggaatcttataattgcattcatgccagttttacaagatcgcactcgaatcgattaattcttggacagatctgttaattcttctgatccttcgcttgtgaactctcaggtccttggtagtggttttgaagtaatttctgttgggaagaaaaagcttgtacgttctgttcctacagaactgaataaagatcacaatgggatacttgagctagctcaggtttgtaatcacagcttttaatagtgtataatactacagtacacttaacaagtatgtggatgctgtcataaccttatcatgcttgcaccgaacaagtatgtggatggtgtataacctttggttggaagtcgtaaagccctatatattccacataaacacttgttttatcatgcttatttcagtcaacatagagacatagcacaaaactatgttaagccaaagctttcaaattgctgccttgctcaatctgtcaccttgccacaatatgaccatacctgcccagttataacatcattcacatgcaggctgaaggttttgtcacagtagaacaagtcaagagaaagttctcgtggtcaactggccgtgccatcgatgtccttgaaactttgctcaaggtaaatcctgctcctgcatttccactctttaggccacctttgtgcttcatttccgtgcccaaagaaaagaaaactgacttcctttgatgcaagttatgtattggtgattagaattctctctgttgaatccacgcttaagccattgcaggattaccttctttttgagctgccatgtataaataaagtacttttcttatgtgcatctctattgacacttgttatgaacgtctttggcatctatatgcaactctgatctctattacacaaacaggaagggcttgctatgatcgacgatgggcacagggatggcaagcgcagatactggttcccgtgcgccactctcagttctgactcgattggtgccgatgccaagtcatgacctgttccactccattgttgtcacctgtatccttttttccattggttcatttctgtacagctctggaagaatcacgagatagcaatacactttcagtgctgggctgccggcaaaaatgttacattgtgattcgtgcatcaggcaggattctgaacgtatttgtactagtggtctatactatactagttcttctttcacgaaattctactcgtaattgtaaattttcaatgctaatggcctcatctttcctcatattttcgcttatgtttatgccatcagctagaatttgaatttttcaactttaaatttagagttgattttgagggtttttttcattgaagtttatttccagccacgtatataaaaattctatttataaattatttttcgtttgtaaatatgggtattccacgccgtaagttgctaatgtgagcaagagaaatgctcgcaataaaaatgattaataaaaaccatattcattcggcccacgggcctcagccctcaaggcttctaccaatgacaattgacagccggacaggagtaattggcaagaagaaataaaagggaaaaaagaggcggaaattcatttttgggaaatggccaccacagaggcgaagcgccggcggtgattcctcctcccctactccggcggccgccgccgactcgtcgttaccgtcgctagatctcatccctgacatagcccgccgcttgacgtccctggaggatttcttctccctgcgcgcctcctaccgcgcgctcctcccggcgttgcgccgcctcctcgcctcgcagtccccgctcctcctcgtctccctctacccctccttctccgaggcgctcttccacccgcgcctccgccgcctccaccgcttccgcctccctcccatgggggcaccacctgcccccctcacgctacaccctcctctacgcccacggcttcctcaccaccgccgccaacaactacccgccaaggctcctcttcacctgcgagcagctccgcctccccaaggtcttcgcacccttctcccgcgtcatcctcacggcggacctcctcgtcgtcatcttcttggccggccgggccaccgtccagcactgccaccccggggacgcgctctggcgcgtggcctccgcccctgcaccccaagtgttcgacgatttgatctctgtcaacggcaccctctacgcgctggttggcctccgtcttgccacgctcgagctgtcggagagttcactggagctgtcatttctgggggggagagcatgatgacgcgaacaggccggagggggatcatcggttcatgctccgggagtgtggaggtgaggtgttgctcatcagcgtggagcatgaggagagggttgtgtaccgcgtgttccgttgggtgtctgacaaaaggaagtgggagatgatcaccaacttgggcgggcggtcgctatttcttggcttggatggatttgcagcttgcgttgatgatcatccaggggttcgagggggctgggccacgcttgggtgagtggcatgagtattccttggctgatggaatctgtgatgtctgcaatgctgactatccaggctcaccacccctgaacaaacagttcactcatcagaccatcagtttggatcttccccagcttgtgctgatgcaagcctgagaagggttcatcctagatcaatgttgaagtcctattgctcagttgctcacaagagaaaaaaagaatggtaatgcttgatcattagcttgcttactaggtcatttatgtaaacaatatattcatacggtgatcagtacttgcatcttattcgaccagtcaattgttgttttggtcgatatagtgaatacttttccttaggattttgaccacaggagcaaaataattttgttcccagcattgctttatgtgctatgcaacttgttgagatattatgaagcttcttttgcgtttattttcctttgatactgcagtaatagtgagtaaatcacataatatatcaaggaatatgctagtaccataatgttaattggttatatttgactatgtccctgtgcagaatctggaatttgcatgattgtaacttttgtagggtaggcagtagctgaattcttaaccctgtttgttttgtgatttatacaatgctgcaaatcctgcggagttgtcacagttatttcagtgatagtgagaaataaggccaggaataacacacgtccaatggacaatatcataaattatagttgatcatgtttttgatttgtactcctaaaaatatgacatatgccaggtcttagaaccgcttatgtatatgattttccactcctataaggctataactgtaagtttcattcctgatagaaacctgtggtgtctgacctccaaatagtctacgcaatcagtagttggcagcaagcagatgtgaaggggttgggcatgctcttttctggttcatcagtttacgctttatgtttaaagtgttcttcagttccgtgttttaggaccgcccttcagtttattcttttttcgggtctcctgtctctcccttccttgttcttgttgagtgctgacacaagacacaacttggttctcttgtggttgtctgttttgctaggtcccttgctgtttctctgtcttaatacgaagttaagccaggcttttgcgtgcttcctgtatttcagaactcctcttattatctaaaaaaaaaactcttattattgacttcagagggatttggaacaatttcaagtttgaaagcatgattcgctgtacatatggacctcaaacatatgtctgtgcaatgttacctggcatctcattttgttagcacttgtaaacatgaagtctggttacctgcaattcttaagaacggtcttatgacctctgactcgtgtgcaggttttcaagtttattttttgacctttggatggtatttgcaatgagattcagtcatatttccttttacttgattcagtcatgtttccttattacttgaaagttgaaactaactttgagaatgatcaaaacttcaaatacttgagatcaaaaaaaaaaaaacttcaaatacttgctctacctacttggtgtattgatatttgcatgtgtgcccaagaatgttcaagtgcagcatcaatttgtgccaggatgccagcgtaactgagtgcatgtttgcgatttcaagtctgtcgatgacatacacccaaccagagggcctgcatagttctgcattattcactattaagaggagtcttatttaccaatcatatactcccttcgtttcgaaatgtttgacacc

SEQ ID NO: 65904 - DNA, 1007 bp, Oryza sativa
gatatgggattatgtgtataattgtttactgtcaaaggagacctagggtctcatttcagaggaaccatgttctaacctcgagttaataaccaacctgctgatggaaaagaaaatcaagcgagtaaccaaagagacatttgtttggactaagagtttcagatgtgtctttttcggatcaaaggcaacgatagttagtatagcttttggcgaaacacttcaaggtttcactgaaaggcagcaagccaaaggacctcatcgtccccagaagcatccacaacccacattaaagagtaccacctgttagagataggccgaaagatgattgataaaagagattggcaaagatgttctctagcaggaaagaagtaggccgaaaggtgattgataaaggataaacagaaacatgctctgcatcgctcaaggaatacccctgatagtaattgccccgcaacagtcaccttgtcattgaggtaaaaaaaaatcatcatgagtaagcaagatgacctaggtaaaagtgttttcatgaaggcaaggagtgaaatattcaactcggtatcagatgctacacggagtgaaaagtgcaggcaccagttaccaggcaatgccatgtcttgggagatgatccaatgggaaggaactcatcaaggtcgaaggtgtaaaggaatacgttgaatgctaaatgatgacaacatgatgagaatagtggaaagtacactgaacataaagaaagtgaatccgagttgtttgttcgtgggagctattcccagttatgaaccaagtgatatgttcgaagatagtctacagaggtcagattaaaaacacatctaacaacgaagctttagatttggcaggatcacgatcagaccataacaagtctagcagtaaagtcatttggggagacgtcaaagcatgtcaagtgggataagttggttctgttgagaaacatagttcaaaggcaaagttaccgacccttgcatcgaatagcagaagtaactagcacccggaga

SEQ ID NO: 65905 - DNA, 2670 bp, Oryza sativa
ggcggagttttgtggaaatggagcggtggccggtgtgcggcaaagagcggcggagccgacggtgcaagcggcgcggccggcggctacagcgacggcggcgcgcagccggagcttgccggaaagcggcagagcgtgggagcaacgaggggagagcggtagggagtgtagcgggttcgggaaaattggggaaaagggggaggatggcacggggatcatttttataggctcggggaggagaaatcgtggccggacgtggcggatttgaagcggcaacggccggcgacgtgggtgacatcgtgggcgaagtggggctcgattcggcgccaaaaattggggaaaagcgggggaggaggtggaggagaggggtggttcccggtcccatgcgagagagggctcgaggaggccgggaatggtggcgacgtgggcggttttcggcggccatggcggcaacggcagttgccggcctgaggttggggatgacaggtgggcccatgggtcccacctgtcggccaaagaggagagggaggccggctggggacgcaaagtagacttcggggaggagagggccgagcggcgagctgggccgagggagagagagagcccgagaggaggagggggattgggccggggcggcccaaaaacaaagacggggaaaaaaaattatttgttttctttttattttaattgatgcaatgatctttgtgctattaaaactatctcttgagctccgaaaattcactagaaatttcagagagtattttagggcacaaagaatattgcgaaatattcccggccaaagatttttttaaaggaaatttttaatttcctctataatttcacttgattaaattgatttaacttttaatataatttctagaaatgcattattaattgatttttattcccgaacgaaaatcggggcgttacataaaacccctatgaaacccttgttggcagtcaaaaggcaagctagggattatggttataaacacgacttagtagatcaaacttaactgatgctacactaagtatgaaaagaaacacaatatctaggcaatcaagccgttgactggtttttaaggtggtaaatgccttagctaatctaatctaatatagttaaacaatttagccaataccggcagaaaccctaaagcgagagacaaccgatagggctaaattgagatactaagactagattaactaagacatatgataaataggcaggcaaatatatcatccaaaccagagcaatccaagagattgaatgtgctgatgcagccttgaacgacgccgacgtagatgatacaattgtccggggcggtggaacattggacttaccccttcgccggagatcggaaagcgatgcagcgccgcgtcaggtgccaagtcccgccggacgatgaaatagagtagaaaagataaaaggtggtgatgcgctgaattgtattgatcgtggagataaaatacaatggccctggtgtacatatttatacccatggggagatactagtccttgtaatccttgtagaacaagaaagaagctttcctaaagataaaaggaaaacataaagtccttataggatactaaacacactaaactaataaactattcctaattaatagataacttaccataccgcatcctacttgaactcggtcacttctggataagcttcctttaatagattaatttccttaaccgaatatagcaggaatccgactattggtgatgtgataattctcttaggggaataccaaatttcactgttaacatcagcgcaaaagatactaagggcccatttgaatcgtaagaatgaaaaaaactggggaatagaataaacatatgattctaataggaatgtaagtgtaaagcagatgattgcaaaacacagaaaaaacataagaatagtcgtttgattggaccacaggaaaaatacaggaatcggatgagagagatagactcaaaggatttttactaagaggttgaacctcatgctaactttcctcaaaacctacatgcattaagccataaatcctttaatcctttgcggaatcgctaattcgcgctgacgcgccagatacttatctcgctcgcccgcggcaggccaactgcgcatgcatgcatgcacctttgcatccacccatgcattacacacacatgcatgcaccttggtcccacacatgcatgtgccatggcgtacacccagcgcatgcattacacacgcatgcatgcatatataggatctttctttcttttttttcatcttattaggatgtagtgaaagttatccaaatttctattataagatatttttattagaaaatactttttataattcaaatttaaaatctcgagttgaaagttttcaaatctgagttaaaagtattcaaatctgagttgaaagtttccaaatctcgagttgaaagttttcaaatctgagttaaaagtattctaatctgagttgaaagtttccaaatatcgagttgaaagttttcaaattttattgtaaaatttaaattcaagtagaaaataattttaaaatttgagttgaaaggttttaaaatttgattttaaagtttaaatcttaagtcgaaagttttcgaatctaacttgaaagttttcgatttattagaaaaaataaaaagttctcttaggtactaattataatt

SEQ ID NO: 65906 - DNA, 18677 bp, Oryza sativa
atgtgctaaaaagtcaacggcgtcaaacatttcgaaacggagggagtatatgatcgattgatcgatcgatgcagctgtggatgagcaaaacgagtacgtactagtcgtcggggtcgtcggcaacgactgcgtcccgctcgcctcgccgtcaccatctaaatatccaggttcagtgatgggattcagaaattgctaaaaaaacagtctaaggtaaagattaactaatgaggtgttaaatttgtacgaaatttacatagtaatttaattttttaaaaaaacattatttacaaatggaacactccagccggccagagtccagatcttaacactcccttcgtttctaaatatttgacgctgttgattttttaaaatatatttaacaccattcgtcttattaaaaaaactctcaaaaactaaactaaactcttaaactcttaaaaactctcagaaactcttaaaactaccagctgacaactatcagctaatcccagctctatgtgtcctcgagcttcttgtcctagacttcagctgctctgctaacatgatccaacagtcctacctcctcagcgtgtcctaatatcttccgctgcaaaaggtgagaaacaatttgaaaagggagcattagtggtgagtaaaccaatttagatctaaagatcatattattcctagtagtccagaggacccaacatacagcttcccctctcatattcagggatggccggaaaggcacatctgcggggtttctggcatctggaaattgctcaaccgtctatcactctgagacaagaaatgggcacacatcagccacatttgagatttggcacacctcaacttttttgtaaagcaggcaatcatagtgaaagcagcaggccaaccactcccatatactacctccgttttttaatagatgacgctgttgatttttttctcacatgtttgaccattcgtcttaatcaaaaaatttacgcaattataatttattttgttatgagtcgttttatcactcatagtacttttaagtgtgatttatatcttatacatttacataaaatttttgaataagacgaatggttaaacatgtgagaaaaagtcaacagcgtcatctattaaaaaacggagggagtatccaattagagttcaccaaggaatgagacagagagatctagagggttcatgtaaagatcataagaagaggtgaaccagtataataaacagccagagcagaaagcaaacaacctttggaaaccaaaatgagtggtgataggagaactagctaactaggatcatcttcttcattatacagttccaaagatgatcaccacctacatggcgatctagagtctagacacaccatttcatgtacaaacaaagctgggatccatggctgaactagtagggtacgcctccagcgcgaggggactgatcaagatgatcatggccaccgtgcagacggcgaagcggaacaagaagcagtgccgggagctggaggagcgcgtcaggatggtctccgccgtgctgagccgccaccgccgccatgagctgcagccgagcacgacggagacgacgatggcggcgcggctgccgccgggggcgagggaggcggcggacgggctcgacggcgtgctccgggaggcgcacgagctcgccgtcgcgttcagccagagcggcggcggcggcggcaagaagacggtgcggcggcgcctcgtctgctgggcgcggcgggtggtcggcgcccggcgggacgccgagaggctcgccagcgtcctgagcaggatcgacttctacctctcgctctaccccgccattgcccacgcagacacggcgtgtcgcgtggaccggctgctgtggacgaccaccgtgaatgtcgtcgtctccgccgccgtcgccttcgccgggtttgttgttgtctccatctccatggtttcacgcaagaaataatctgatcgacggacagtagtgcaaaccctggctgatatgtattgatacgtatgtgtgtgcaaaagaactctcagtgtagtcgctttaccgcgagttgcatgtgcagttatgggaatatctatacatatttcccttttttattaggatacgataaggccaatagttctaatgagcatctccgagagagatagtcagccgtggcgatgagatcgataatgatgacatcaaacaggtaagggcggaacatgaccagaatataggaccaagcataatgaaggcggttgaagagatcggaggaggtagcactacgaacaacgcagcctatgcacatggggatcgtggatatgccgcgccagggaaaagccggtgagcatggtgtgacgccgtgaatgtgcatggccgaggacgacaaggtcatgaacggtgaatataagttttgcgactgtggtgtatgcaaagacacgtacaatacgtgcgaagtatgactatatatgcacaagtagtatacatgtggggccagcaattggaggttggccggcctaacacatggggccaattggccccttcttaggttaattggccacccctttgttctgccggccatcctgccatccattaatacggttgtgactttagacggcttggcttaactcttgacgtggattggatagtcggtttgaacaaatggtcagggccggctggacaagagatgggccgtcagcctgtgcagtgtggttagccagcctaagcggctagcaggggcgaatctagcatgaggtgacggggactcaagcctccactgttgacaataggaccatgataggtcccgtgaagcacttactagaactttttgtcatataagaggatctaatttattcagacttcttattatttcaccggtataagtggtggtaccctatgggaattagcttggatgcattaactcgttaaaacaattgtctaccataacgtgtttttaatccccgagacagaaatgtttgctatggtaaagtactcgtaggatgcaaatacgcaatcctacaacccgcatagcaacctgcttactagcttattttctattttctactataaagtttagaaggaaaaaaagtaactaaaattatgataagcggtaaagaaaaaataaaccgcttcgccacgctttgcttccgtacggtcatactttgtgattataaactctgatggtgacgtgttaagccgttgaaacagttgtgtacagagattttaggttatttaaccaagcacttttggctagacaagcttggagaattatagatagaccggagagtctgtgtgctcgagtgctgcgggctaaatatttcccatctggctcgctagttgatactaaatgcttcacccggatggagggcaatagagtatggccttgagctactgaagaaaggggttatttggagggttggcaatggtcaacagatcagaatttggcgtgatccctggatgcctagatgccattctcggaggcccataacgccgaaaggtacctgtagagttaagtgggtctcagagctaattggtatggatggcagatggaacgaacaaatggtaaaccaaattttctggcctattgatgctgagatgattctgaaaattcagctaccgacgagggaagcagaggatttcctagcttggcatccggatagactgggcatcttctcggtaagatcggcttacaagctgggcctttcgcttgcaaatgtggatagcagttctagctcgtctgagattgagaccagtaaggcctggaatctgatttggaaatgcaatataccgcaaaaagttaaaatttttgcatgaagagctgccaccaattgcttagcaaccctggagaataaaaggaaaagaaatcttgcggtgtctgatgtctgttgtatctgtggggtagagaaagaagatgttgcgcatgccctgtgtcgctgcccccaagctaagagactatgggatgttatggaagttgcagggaagaaagcgaaggatattgtcggaagttatacaggtgcaagctggattttggatcagctacagttagtaccaggggaggagcaaccgaagttcctgatggtactttggcgtacctggcatgttcgtaatgagattacacatggtaaacgtccaccccccattgaagcttccaaaagattccttgaaagctatctctcgtcattactggaggttaagcaacatccccgagcggatttatcgaaagggaagcatgtaattcagtatggacagcagcagaaaataaacctcctaaaaggaccaatatcagctccctgtcgctgggataagccacctcagggatggatgaaactcaatgtggatgggtcctttgttcctaacactgggaaagggggcattggcgcgatactaaggaatagtctgggagaggtaatcttctctgcctgtgggtaccttgggcgatgcaatggccctctgtaggcagaactactggcatgtaaagagggcctcaacatggcccttcaatggaccttcttaccaatcatgctggaaacagattgcctagaagcaaagaacttgctttgctcctccaatagtgagagatcggaagttgcttttatcgtcagtgacatcaaggaactgatgtctgggaatagggaggttgtcgtcaagaagattcaatgaaatcagaacaggattagtcatattctagctaacaggggccgatgtgactctgtcacggagttctggccggataatagttgtaactttattgatctccttgctacagaggagatgttagctgagtaatataatcctgttttttcccacaaaaaaaaaaaacagttgtgtacagtagccccgaaataatgcgaaacaatttatgaaaaaggaaagaagagagttgggccatgttgagccagtgggcttgggctgctttggttggaagagctagctagcaggtggatcatgcgtgcatgcagcaaccggccttttgccttggcccatttcgccggcagcagcagcagcaaagcaatcagcagcaggaaacgatttttttgtttttatatttattttttaaaaggttccaaaaataaattcccatttcaaagttttacataaatataaatcatcctacagtaggacaatttatatgtcgtggcacctcacgggggaagcgtgccgtggaacaggtagccccttctcaccttcttgtaggaggatttatcatcggaagggagccaccttcaaaattatcatggcgcgtcccatacatcaccaactaaattgcactataggagaatgagaaaggaccgcatgcaaaattgctagtatatcacatggcctgtcctaccgtaggacgatttacattcctcatcataggtcacataacctaccctaccgtaggacaatttatatacccaatcctagggtacagcgggagtatatttttttaaaaaacggtaatttatattcataaatctttttaaaaatcaatataaaaatagaaaattcatcgagcaacaccagagcagcaacaacatcgtgctgtgatatttgtttttagaccgtgggagtagttccctagtcacggtcacccctcagtccctcaccactgcgtagaaaaggaagaggtcacgatcacggacgttgaatgttcaagggggttatggcacctgtcactctgacttatcacttcacttctcatttctcttatttttttaaagataatttctcatttctcttattgtcagcataaatatgaattccctccgttccaaaaatataacatggattatcttatatttgaggacgaataagtatcttagaagaattgcaaaatattgcaaccaagaagaaatatctcaagctggtattggtattatcacatcaaaggtaattaaacgctgaaagtagggaaacacatggcagtatttacacatggaagatgtttacacacaaacacacttctttgggttgtcgctagcccttgataggagccagcaggctagctgacacgtaccggtctctggtagtactaacagagacagcaagctactaggaacagagtaacaagataagatagcaacatactagataattaattacgtattagataaccacaaggaccagcaaacgtggcgtgacagagagatcgaccagcctccgatcaatgggattatttagttcagcgatggctgctcctggtctcgtcgctgtacagcctagatgatgagaagatgaacaggtcaatatgatgattcagttcaatttaccaatcatatatatggagatatagatcgatgcagctgtggaatatatggagtattagttcggtcgaaatttttcaaaatttttaatttttttcgtgaattttgataatatttgttcaaaaatttcggtgagatccgatcaaaccggctaaaccgaaaggtttaaccctgtgcagctgtggatgagcaaattataagcaaagcgatggataccagtcgtagacggtgggggagttgggctgcgggcggtcgaagaggttggcgccgaggctcttggtggcgaggttgctccccgggtggaacacgctcctccacacgttgctgccccgcggcgtcgtcgtcgccgtcgtcgtcggagacgaagacgacggcgtcaccggcgtcgtcggggtcgtcggcatcgactgcgtccgcttgtacgccgccccgctcgcctcgccgtcgccatctaaatattcagaggtttagtgatggatcggagtcagaaattgttaagagacagtctaagatttctacgaatttatacatggtaatttaaaagaaaaagagcatgatttcgaaggtacaaatggaacactccggccggccagagtccagatcttaacactcgttaatatatataagcaatatttctggttacgacgctcttttaaatttgttgccgtccctgcttgtttgcttaataaaggtaatatattttctctgtttcatgttatgagaccgttctttattttgaatatcttatatatagtccaaatttatattgatgttaatcaatctaaatgaacgacgaaacgaccaaaacgtctcataatttggaacgaaattatattagcttgttagttaggagtagtaagcatctgtacaacgacgtaagctacctttgttgatgacaagggggcgggttgtagcggccttgcggagcttctccaggccggtctccggtcgaggcccggccaccacgtcgtcccacagcttctccagcatcttcctgatctctgcttccacgcactcaacaactgatctctctcttgcaactttacaacaactcactgcctcccaagtaattgagctgagtgtgtgtgcccctccttaaatcattgagtggatatgaccaggcgtcaccgcaccggctggtcgtcttaccgcaacaatcacacccagtaccttccacacgattttggccgtatgcatcggattggatgtggaggctaaatttatcttttttttaaaaaaaataacctttcacgtttcaagtataaccatatttgtaatcttctcttcatgtactaattatgatcacacgataactataaagatgctattatgtattatcttcgtcctaaaatataaatataaaatattttacggttgaatatagttattaaaaagtaaatagaactaaatgttaaatgtaaaatggttgtggttgagctagaagtgaatgtaactagatagatgggcaaattgaatggtggatgatgataattatgattggctggaaaaaaaatttggtggagaaattgttatattttaagataaattctaaatgttaaaaattattatgttttaggatagatgatgtaatttttttatacatttaggtgtatatattgatttccaatttagatgggggaaatagataacactgctttcagaatgctgtatataccagtgtgttggcttagagcaagtctagtagtacagtccactactagctccaattcatttatagccaattcatataatagttgcttgctatactattaatatatggtcccacctatcatatacacagtgtgtcttgaagttcgtgctgcagctggctacaaatctgtagcccgctactcttctctctcatcgtttatctcatcaaaatatggttatagttggctaatagcctgctattatacctgctcttattacccatagaaagagactaatgatggggctactactgtggaagtgtggagtggccactgtcctttggaagtttgttaatcactgtcaatgtggttagctgcaccgacggtgagcagaccgaaagcacatcttcaatgatgactcatcgttaacggataaggatgaagcttttgggtcccaccccatggggatggcccacggcccgagagtgatgtttccgatctgacgaaaaatatctaaactgaagatttcagtatttcttccggctccaaaatatggcaacataataattatgcagatttgtactaatacgacttatcgcatctagtactcacggttgataatatcgtttaaacttatcattttagataaatgcacgatctagaaaagataaattttatcattatattttattacaatatatatagaaatattaaattattgatgtactttataagactaacctatgcatttagtcactatatttctaaccaatttttttttaaaaataatagtaataaaaataattatgtggtaaatatgggtttaaaattagagaaataggaaggacactcttttctggagtgttcagaggtggacgttgttacgttgttacggagtctacatgcggacgtccaccgtgatttcgtaatggtcaccgaaattttcgatcgactgatcgccgtttttatataaggggtatcgttttcgattgtaccgtttttagctatttataaattttattttgtctactatattgagtagtttaaacgataaatatggtcaattaccgatcaatcgaacgttgttttcgaaaagatgctaccgattccgaccgttttcacatacagctgcgggtgtttttttcaaaaactgatagtatcggactgataattgtctgatagtacaagaaagggaatcaaattcgaataatttctcttggaaacatataaacaaatacataccagtaaggctgtgttcgggaggggttggaacccctcctcccggcacgcaaaataaaacatctattattgtatgattaattaagtatttgctaattttttggattaatatgagttttttaaacaacttttatataaaatttttttataaaaaacacaccgtttagcagtttgaaaagcgtgcgcgtgaaaaacgagggagggaggtagcgaacggagcctaagtatggtatccggtggacactggaatcagtcttgttgaagttagatcaacaagattgaccaaatttgtgattccactgtccatcggacacatcacaaattacggatgttggatcaacaagaatcacaaatttggatctaacttgttgaagtttttcaaacttttttcataatacagtttagaatccactcccatctcgcatcacacctttcatttcataaatcattgtgtgcccaagccaagccaatggcgacgatccggattttggtctagtaggggtcgtcggtatcaatgtctgtaccggacacaaactagccccccccccccccccccccaaaaattaagaccgtcgctcgctgagctccacgacatgctccggcgagcatggcgcgcgagctcgtcgaactcgatcgaattgtgcagaaacgggtctcatctgatctgatcatctcgtgtgttgcgctgggccgcgcgcgccctaagcgacgcaacgatgatggcgacctcttgctgcgtgccacatcgaccaccagtcaccagatggcgtgtgcgtacgcgcgcgctcgacgtgtttgcggaaatgccaggccggcgcgcgccgcggcgcggccggggtagcaagcacgtacgcgtcttatgttacgcgctagcttaggagctaggtgcatcaggaaattacgtacaaaatgcacagcggcttactctaatactcgatccagtcaatttcataattcaggaaatttaattatatcgatttccaggacaggtttttcacaaggacacagggggcgtacacgtataatcgtatatgcgatcagagtatatatacgcgcgttttagcatctgcttaatcaggtcagccattttccttctgtttacgaccatttcttttgcttaatagttaatcagtttctatacgcgcgttttccatttcttttattttgctaccacgtcgtgcgtggacgatgccatcatagtgtcgtcttggagctagtcaacctatttgtgtcaccgctatacatgtactattataccagttcattagattcacgatgtattttctatatgaccgaacaatctattatataattaaagtaatagaaaaaggagcctccatattcgctctcacggcttagaaattctcacattaatcgaaagaaaataagagaaaaaaacaaaacaccaagtgtattaggattagaattctcacattaatcgaaagaaaataagagaaaaaaacaaaacaccaagtgtattaggattaggtcatgcaaacggacaagaaaaattaaaagttaaaacggacagaacaaatagaaaaaaaacaaaggatattataatgatagtgtgtaaacagataatgattctttggaatccgtatgagagaaccaaccataatcatattctgcatgcccatatgcgtgggccaccatgctatttatattattaaaggaatagaaaaaggagcctctatattcactctcatggcctagaaattctcacattaatcggagaaaaagaaaaaacagagtccatatagaaatacaatttagaaatagctgaaattcggaattaaaaaataaggaatattagaagaggagactagagtctatatagaaatacaatttagaaatagatgaaattcggaattaaaaaataaggaatattagaataggagactagagtccatatagaaatacaattaggaaaaaactgaaatttgggaattaaaaataaggaatattagaagtagagtatagataccatatagaaatacaattaggaaataatataaattcggaattaaaaataaggaatattagaagtagtgtatagagtccatatagaaatacaattaagaaaaaaatagaaattcggaattaaaaaaataaggaatattataagtagagtatagagtccatatagaaatacaattaagaaaaaaaatagaaattcggaattaaaaaataaggaatattagaaatagagtatagagtccatataggaatttaaaactaactaaaattcagaataaacataacaaaattaaaagtagagtttagagtccgtataaaaatacaatttacaattaactaaaattcaaaattaggaaaaaacatgggaagaagagtttaaagtcaatataggaatacaatttagaagtaactgaaattcaaaattaaaaattaaaaataatgaaagatgagtttagagtccacatagaaatacaattagaaataataaaaattcagaattactagagtccatgtaggaatatatataatttacaaataactaaattttgatattaaaaataattaataactaaaacatatataaaatacaatatgaatattacacatcagtagtttcataaagttattgcaaaatttaaaattatgttgtcatttttatatatttgaataatataatgagaaaacatatatactattatatgagagaaaatataatgatgctagccgcgcaatctgcgcgggccaccatgctagttctaataaaataatgaagtttatacgctccccgcaaaaaaaaagaaaaaaagaaaatgaagtttcacgcgtaaaatatttcaacacacttctccaggatgccttaattccgaattatccagagtgatcatcagaaataagagatactaactatttcttgcaagatactataatcactggttctagcaaattaccaagaaacaacataacgctttccttgcctcaacaatcgcgtatcgctacatacatatatatacacatatatgacaaatgtttctgttcatgtgtaaatagttgttccggcaatttaacctgtttgaaatcaagtctcgagaatttgattaggatcaacaaatcaagatagaaattaagtttgttttgatcaatggagacccttagcctggtgagcggcgtgaccaccatcgtcaagctggcgaacgacatcgacggcgcggtcaaggcggcgagccggagcaagaagagctgcgagaagctcgccgagcgcgtggccgacatcggcgacctcctcaagggggtagacacctcctcgccgtcgacggcggcggtggccacgaggaggctggtgggcaggctggagagggcgctccgccgcgcgctgctgctcgtcacctcctgccagtccaccagccgcatctacagcctcgtcgccggcgggtggcaagccgagcagttcgacaaggtgaactcagagatcgaccggtgtctcctcgacctcagcctctccagcctcgccctcgtctccaccattgatcacaagctcaacgccgccgccgccgccggtgaacggaacaccgtcgaggtcgtcgcgccgcccccgccggtgaagtgcagtcacgatcatgatcaggatgacggcgaggacaagatggcggccggcggcgcggctgagaagaatggcgagcttatctgcttcggcggcgagcaagacggcaaggctgagacggacgccggcgaggtcaccaccaccaccaccaccatcggtgtgccggcggccacggcggcatacatgcactaccatctgtcgcggctgccgccgccgcggtgttacggataccacttgcattattgccactgcacccatggccactgtcactgcgccggcggccgccactactcgccgtcgtactactccgacgacagcgctgacgtcaggctccggcatatgttcagcgatgaaaatcccaacgcttgctgcatcatgtgactctgagctctcaaacgtgataggccaattagttagaaaactaggaaggtcgcccgcgcacatgcgcgagcaccttatttaatgctgatttagtttttattacgaatgtttaattcttttagatatactcattttattagtcttactaaaatgtttgaatgtttctatttagaattaataattttttgttcaatttacatttcctttcatctcttttttgggagaattccactctatgaagcatccttgaaatgctttgatcactgtaattcgggatgaaaatatgtgggttgatcccatagcacgacatggggtaaaggtatccattctaagttatctctttccaattaagtaagaaaatttaaaatagaggtcatagttttttttagcaaattaccacttaactgaagtgtcatgtaacaaatacacatttctagattgttctatgctaaatgttaggaattcatgatgtaccgtagcaagtttaaatggacattttttaattcctatatggaattaacttatatattgctaaggccacaacatggttatttcactgttaggattccttggtgtagccaatgtgcttagtacgatcaatatgatattcaattggtcatgcgacttcatatatcacatatataatttagatgctatgatcatcttaagattatttatttatctcttaaaatatcatttattgataaaagatcaatatcaaattgtatgggtaaatagctcttatatacatgcttagagaaaaataattaagtcgatggaaagtcattagatgtttaatggaatataagtactgggtctaccagttttatgaaaatttaaggtgggatattttgatttttagtgagaaattttagaattttcttttatttagtggaggcctcaatatggaagtgggtccagaatgtaaatttttgttagcaaaatatagtcaatatggatattaagttattgatttcatataaaaaaatatggtaattcaaacaaatcataaggggcatagggatagctggctagacctaatatgtggaggttcaattgtggtcttttcttcaaggtcaaaaaaaaattgtggtcttttctttgcccataaagataattttaattttaattgttatagagatagaaaaaatagaaaaaagtaatgccgcacaccgcacatgaatagggatggagggaaagttgggatgtcttttttaaaaaattgatctatctaatgatctgaaataatgtgttgatgtttaagtcaaaaccgatggttggatgtttttattttttttcagatttattaggattttctgtaatttaagcgagattagtagcagcttagtaaagcatttatgtactttaatgtcctaattgtttgggatttttttaaaaaaataaatctaataacaacgtaaaataatgtatcaatcgatttaagtaaaaaccaatggttgaatgtttctctaatttaagagtgccacacaacggttagaaacgtttatagtatgtttaatggacatatgatgtctatttgtgagtcttttttccataaagataattttaagtttaattgtgattaggatgaaaaaaaaagaaaggagcagaggtagcgtacaatacgtgtgtgctgcacggaggtgcggacatttataggttttggtttttttaaagatacatctaacattctaaaataatcggtccaccgatttaaagaaaaattgatggtcagatttctttattttattagaataccacgtggcggcttaggaatatttttaggctgccacatgacggcttgagagcgtttgtaggaagtttaatgggcttttagaatataataatagaaatatgtaaagataaaattagggtgcgtaaaaaaacaattaggacatgattatttgattttaattattgcgaacttgaaaaatggatctattcaactttttaaaacaactggcaccttatataaattgtcaaaaattttgtggcgttaggattgtgaatattttgaatctgtccattgatgaaagaatatgaattttaattataaattcaaattttatctttgagctccgtaggatatataatttgctgacagcgtcttgtatgtaggagatataatttgctagtcctgtaggagtaactaatctggcttgcttttgctaagagatagatttggtatcttatatgaaagtatcaaactaatctacgtgagatggatgcatcgtgctgggctgcacatgtgggtcctcgctttctatacacaagaatacacgatgcatcgtacggggctgcaaatgtgggtcccgatttatcttgttgtgccatgtggcggcttgagatcgttttgaggatgccacatgtcagcttgagagtgtttataggaagtttaatggacttttagtatataataataataataactaggaaggtagctcgcgcagttgcgcgtgcatattatttaaactatcataatttttgttgttattagaaagaatttagggtttcctttgtaacacaggatttttagaaaagaatagaaaatggtatataaatgattttgagaaaagaaaagaaaatggtatataaatatgatagaaatgaatgtttaaaatatagtatggaatagaatggatgtttggatagagtgtaaaaaatttaaaatgtattaacccagttagatcaaattatcatctggacaaataataatcaaacaacctttgcattagtagcttgacgattgtctcgatggtaattttttaaaattctgttatatgcaagatatatatcttgcatgtacgtacagatatcgtggagagacgagtgattatgtacgggagggaggtggaatggatttgtatttttaaggattggtctatcggatgtaaataattgttttaccgattaaagttacaatggtcatattttttttcttatattttatatatgttttttattttgaaaagatataatgtaatggtccaaaataataggtctaagattttaaatcatgtgatagcgtaggattttttagaagcatgtgtaaaatagaggatagagaaaagtggttatctgaattattaacacatagattattaacaaaacaaattacataatccgcatataaactgtgagacaaatttattaagcgtaaataatcggtcattagcaaatgtttactgtagcacggcattgtcagatcatggcgcaattagttttaaaagtttcgtctcgcaagtacaggaaaaacagatgattgttaaattttgttaatctatgtagatgaaataattatgcatttgtgaaaaaaaaactgcacttaaccaaacaaattttgcatcactttgctttgactaaaatactaattagtagtaggcaactaatactctgtaactctgtctaagctaattttttttgctcttcttttctattccgctatacgagtatacgtatggatagcaaggagagagtgacagaagaggggaaaatggaaaggatgaggtctgaggggaagggcggacgaggagggcggatggcggatggcggatggcggatggcgcgggccggaggtgcgagcggagagctttgggcaggggggacggcggcgcaggcggcagggatggcgtgggttggcggcgtaggcggcggggacggcgtcagacggcggggatggcgtgggttgctggcgtaaatggcggggacggcggcgggcggcggggatggcgtgggttgcgggcagagagcggtagcggagagctgcaggcgctgtggacggggggacggcgacgcgggtggcggggacggaggtctcgatctgacgtgcgctcccgcaaggttgtggagtgcgaggccgagctggttgcgccgccgagctactgcatcgccaaccgcttcactcgcgattgggctgtacaacgggcgctgtcctcaggtattgcatcgtgcatccctgcatcgtcaatgtgtactgcactaatgtcctgttgctctgttcccatgtctttgctctgtatcgatttgtctctgctttacgttcaagttatccctcttgtactgcatatttgagattttttggcccatcatgaagggtgtctgtatggctctgtataattgagctttcgtagttaactaattgtagtaaaaaaagcttgtaacttcaaagtaaaaaatgctttcaatttgataattttatatataattaccataccagaccttcacaaaacttcatatggtaggaggcggggatggcgtggtccgcgggcggagagcagcgagtggcggggacggcgtgggtctcctgtagtttcccgtctccctccctccagtggctgttgcaggcttgcagcgccatgtccatatccacctcccatgttccgtcctcacctcaacatcctccttgaattatctcctagctcagtgggtgggttggcggctgcggtgtgtcgacctctctatcttccttcgtctgtattggttatgtcctctctattttccttgattagtggatttggcatcagctgctggggtgttcgccaggggacaattggcagcaatggagttgttgttcacagctctatggaaagacggtatgtgcataatacgaaagattgcggaattatgatgtgattaaatggctcattggctgtgtacatgtattttggatgtttaagcctgtttaatccattgtctaaaaaaataaatggttcatggatgtttactttctggggaaaaatgttataatagaaggaaaatgtaattatcctataactttatatctctccatttctttttgtttgacgccggttagttcaaaattgcactaatcaacgtcattcatttgaaaacagaggtagtaattattgaatatagtacaaagatgaaatatattgtttgtgaaaggaagatataatgtttgaaatatcatcctatttcagctggtaaaaatactcactgtaaatggtaattttgaattgcagcctttcgctagagtatgttgtagcacaatcaatgttgtactggagagaagcaggaatagagcagctgcaatgaatatttacaatgataaggtacccatgagtagtttgcaacatagtttgtatgatcaatatagatgaatgagaatgatataataccttctagaaaatctctttgtacactatgttcctgaccatatgttcacctgggctttcattgtcatctagcattatccgtagcccatctcgtcttgtaactctggagaacgctacgtagagctgcccatgcgtgaatacttgcttaggcagatatagtcctaccatgtttagagactgtccttggcttttattgatggtcatagcgaagcacacactgagtggatattgtcttctttttagcaagaagggccatcctgactctgttggcgtcattattattctagggatatataccttttctcctacatgtgttcctgttatgatctgtgcttcaatgaatcttttcccgagctgagtaatggtcattcgtgtaccattacataaccctgaactttggttaatgtttcgcagtagcatcactggaaggcctagtttcagtttcagcacatggtttggcattccagggaagtttagactatttagaaat

SEQ ID NO: 65907 - DNA, 7006 bp, Oryza sativa
ccacacacgctactctctctttattgccacgcccgcgcacgctgtttctgccgttgcacctcggatgggacacatgcctcgaccccccgccgctacgagttccgaggaggagatcaagaaggaggtggcggccgtggacgtcgtcgtcgccgcaccggacgacgatgtggccgccgatcgggaggaggaggaggaacagaagaagaggaagcggaggaaggagaagaagaagaggaggaggagggcgccgagcgaggaggaggaggccgcgctgaggtccgtgctccgctgggcgcgccgcggcgaagcgggcgatgaggaggcggacgggcagcgccccgctgcgaccgggaggcggcggccgcgcgtcgcggttgagctgcacgcgcactcgacgtgcagcgacggctcgctctcacccgcggcgctcgtccagcgcgcgcaccgcaatggggtaagcagtaagcacagcaccgaaatgcccgcgaacacgaacgatctcggtcacgcttgcactcgtcgtcaccgcaaatcgtcgcgtttcctaacgctaatgcccttgtgatcagcgcaggtgaaagtactcgcgctaactgaccacgacaccatggccggcgtccccgaggccatcgaatctgcgaagcagtgctccatcaggatcatacccggtgtcgagataagcgccatgtactcaccaaggtaaccaaaacatcgtactctctagtctctaccgccttgcacatacacagtcctgcatgtctgatcattgccgtcttgccgatgtcgttgatcttaatcagtgatggaataggagccgaggaacccgtccatattctcgcgtactacggtagtctgggccctgcaaaaccacaagaactcgataggtttctcggtagcatcagggatggccgctatacccgtgcgaaggggatgctgctgaagcttcggagcctcgacatgcccatggagctcgaagacgtgtgcaccattgcaggggatggagtggctccaggccggttgcacgtggctcgcgccatggtagaagctggatacgttgagaacattaggcaagcttttagcaggtacttgtatgacggtggacctgcttatgccacgtgagtatcctcctaatttgtccatgatcaatgtatgtctttgcaactatacttatcaggtgagtagtttgatttactcgtggtgtggacgtgtgttttttcttctgttcatttgcagtggcaatgaaccagcaggggagtctgtggtgcaattagtttgtagaaatgggggtgtggcagttttagctcatccatgggcactgaaaaatcctgtggctgtgataaaggatttgaaggctgctggcttgcatggcattgaggtttacagaagcgatggcaagctatcaggtatgaacaaagatgctcgtaaaaataaactcttttaatcactcgagtggaactttgattcgatggaataaccggggactgtatcttcgacaggattaagtgatctggcagatacatatggtcttctgaagattggtggttcagactaccatggacgagacgacaaggatgaacctgacgtaggaagtgttgatcttccggtcttggctgtttctggatttcttgatgcagctcaaccaatctggcacaatgctaccaaggaaattctggcaaatattactgaaagggcacctaatggctcaaagggactccaaaggactaactctgcaaaagatttatgtaacttgcgtcttctttcttcagacctggaggtaacagattctacggaggttgaggtcctccaaacagaactttcagatgttgtcctcagtaactgaggaccataagacacatattgaacaatgagcagaaatcaccatccctctagaccctctccagtcacattggctggtctggagcagttcaatctaaactgcaattcaatctgctcatattcttggagagaatacaaattgttgcatgtgacgccgttttatattattggctggctggattggaaaagtttcaaacggtaagagttgatcatttgcatattacgtaaaatcattttaggatatctgtaacatttcgtgcacttttttttcatcacttctccaaagtccaaatgctaacaaataaagttggaagtgttatatggacatgggtgcaagcgtatattatatcatctactccctccgtcccaaaaaaagacaaaccctgagtttccgtgtccaacgtttgaccgtccatcttatttgaaaaaaatatgaaaaaaattaaaaagataagtcacacataaagtattaatcatgttttatcatctaacaacaatgaaagtactaattataaaaaaatttcatataagatggacagtcaaacgttggacatggaaactcaggtttgtctttttttttgggacggagggagtacgcacttattttgcatatttgtagagctaagatcatttttcaattaatggttgtgtgtctaacggtataggctggagatataacccatttacttattatctcaaactaaaaaaagatcgttttctactaattgtctgcggatagtttgttttatcaatttccagcgttttatggaatatagagatctgagctttgagagcttccgagttcaaatttcagaaagaatattctgccgcttaagcgtgccatcttccgtttgtgccaattttgcagcccattctgatagattccatggaccggcctatgtaagcataacagcacgtgcatcaaataaggcttggccactgggccctgtgaaacgctcatgatgcgcacgatatatagatgaatgaattttatacattatagaaatgatagaaatgatagatgtatatgtttgaataatgtgaaaataatatgtaaataataattttacattaattgcatattgaattttaaaaatacaataaagttgtaaataatatgtcatgtttacatgatacttaaaataccctagataataaattgctagtgtatgatgatgtgatacacttgcacgtgatttaaaaaactctagataataattgctatttagtgatgatgtgacacacttgcatgtgaagctttagaaattagtgggcatcaactttatactaaaatactgtatgattttgtgtcgcgttagattgggttgtacttgtactagtcaaattcattacaacccaattcagttaacaaaagaatatgagcagcaactatatccagttaactgaattcgtttgctaactgaattggaaatgaatgtgtgtttattatataattttagtccaattatactgtcagtagaaaaaaatatacaatcaataattaagatgatagtataaatagatatgattgattaaactataaatgatttagattgatttactgatagtagagactagagagaacttgaaagcgtcgaaagcgcaagcacgaatttttactctagtatctaaatcacattaacctttttactcatttctaaacgtggcataaaatgtcagtagttcacattgcggcgtaaagcccctttcacccttttccccgtgaaaaataaaaaggaactgcatggcgatcttctggggcccaaccatggggaccgccggcgacgcgactgtcggtcataaaaggaggaatatatcccaaggagtaataatgctagagatcatcagttcatcacaatcacataaggataaactactactgtcatggcaggctaacacattatacctggtaatttcaggacataattctagagaagatgggtcgtgattgctgaaatattccagagagattgaaggatcccatcgcaattcacaattcacgggtacggttgaaacacttgaaacgtttctttcttgagctgtagatggacttcaagaacaggttcccggagtgatttgatcgatgctggcaaattaacaaatgtgtgattctttaagagtaagagagatttcaaatagccatttgtaaactttgtttcttctccgagaagaattctttgttagtttttgaaaacttcgcgagaataaatcttgcaagcaaggaagtagacttcttgcaaaaccagcatcattcatcttagcgtaatgaactttacaagatccgaagcttgtaaagtggagatgatgttctcccttttctgtgccatattcacatataatttgacgctgtagagatttgtgctccttttatttcttggaacagatgctcctttcagacatgcaaatctcaaaacaagtacacgtgattcatccgctaaggttttcaattccaggacattgcttttaatggatgttaatgcatttttcttttgtgggggacgtgtttgcagttcattttttaaaactacaaaaataaaaagacgctatctgcagactgatggaaaccatgtgcgccatctgtggtttgcagctgaaaagatgatacggtaccaatctcaccagcctctttggaaacacattggcaaacgcaccctaatgatggatctaactgccatcatgttgctaactgctcatggactgcagctttaacaaatcgcagagtcaaggaactgaaagcacaactgtagttgccatcgttacgaatagctcctttattttacgaaatgtggataatttgttatatatttgtctaaaacatactccctccttaaaaaacttcttgtgacgatgttaacataagcctataactagatacataactagaagttaatttttacgcaccgagaaagtattattattgttgaaaatatagtcatatatcgtcatattttaatccaaaatattaagacaataatcatgacatgaacaatgtggggtgatctagtgataaaataaaacataaataggagcatgcttaagatagaataagcatcatcatcatacatagaacgcaatagcattgtgactaacagaaatatcaaaaaccgaaataacaatagcattgtgactaacagaaatatcaaaaaccgaaataacagtagagggttataccctgtgaaagtctctccaatggattgtgaggcagaactacctccattggtgttatcgatcggtgcaccagctcccgggcagacatgggtgatgcagacgaacaatcgaaaacgaacagaggacgaggagcagtcgtgcagaagcactccccaaaaacccgcctacccggtacagatctcaggcgaaggtgtagttccggaggccctgctcgttccgatctcttgtgcgcgcaagcgatcagaaccggtgaagcagtagcagcacaggcagcggcgcgaggaggaggaagaaccagtgtttggaaagtaaccaacctcggcccggccggccagctcggctcggcgcgcgcgcgtggctttctgatccccacctcaaccggtaaacagggagcctccaataactccctatttaagttgagatactcctcttttaattcccagggtggtattattatccttaacatttattatggccccttgagatttaatagaaaaatcgggcctagcccatttattctaacaattattcactaaattatagctatggacaatctatttggatattgagataaattaaacattttgagaaacaaacttaatagatagtttgaatgatgtggccagaaaagagatgtatagacagtcccaaagacggaattgcttgagaaaccgttcttttgatagcatggagcaaataatcggtgaataggccgaaaataacatgtagtcagagcggtggctttgctgcacattgtataaagagggtctgctcgaaattaagttcacacacgcaaagtaagtctgatgaagattaaattcacacatacaaaagtgagaaaactattagcgcgtggttaataaaattttaattattataaaattgaacatggatttatttgatatttcagagtcaattatatatatgaagttataaaacatactccctccgggctaataatacttatcgttttagataagggtgaagtcaaactttagaatctttaatcatgaatcatttttaaaatatttatcttttaaatatggtgactacatgtataaattaatcttaaaaaatactttaataaaatcatatatttgttaacacttttatacatattatagtagaaaataatggtgaaaattattttttggagaccgtgctcatgtttaaaagataagtattatcaatccggagggagtatcgtttagtaatttgaaaaacgtgcaaacagaaataagatagaatctgtatcttaattgttctgttaatcggaaaagaacgggaactatccatgattgttttgctatgatccagtccagtctacctacaagtcacaaattaaacaccatgagactcgggctcgcaggacacaagagactatcaggaggtaagcgggcaggagcatgtgcctgcacgctgcacagtttctctgaagatctgaagcaggagtgcgtgcagttacttctactgttactagcctacccattatcagtattctgtcctcgggtagctgaagtattgaagagggcagacaggagctcatgctttcacgggcacaactacgactacaccactactgtccctttgggctcttcctgtatgggaggaagatggtggagcactagcgagtagcgtgccatggcgcagaagccgcgtttcaggactcgcatcttggaggtgccaagtcaaaaactagatgaactcgcatgatagtatggcactatcacccgaccaccaaccctgtaaaaacaataagaaatgccaatggagatagagatctactcctattatgtaaaacataattgttacgtgaagcatttcctattttggtagttacttcacaattaggaaaatgctatatgtactaatcttattttaataactcttactaacattgacatgtcatgttgttagcacacctgattttcttttaatgtccgtgtagttaaggcttgtttagtttcctaaaaacttttctcaaaaatatcacatcgaatat

SEQ ID NO: 65908 - DNA, 678 bp, Oryza sativa
tgatatttggcacgccccttcgtcttcctcgctcatccccaactgctctttgcttccggcgatttagggttttgctctcagggtaaatccaacaaaatagccccttgattctccgctcctccagccattctccgtcttcctcctctgccatgtcccagtcaacagcggaattcgtgccaatcctcaaccaaactgttgcctgggctccgtttacagtaatggcggggaatctggagaaggtggtggcggagggatacctcccctgcaagcgctcatcaactggtgggaggacgtcgaggaagatttccccactccaaacaccaatgagattgtagtcttcctccccttcttccagttcagacttgggctaccgaccggcaatttcttccaaggtctgctacacttccatggcatcaatgtccatcatctcaatcccaactccattcttcagattgccatattcaattacatgtgcgaggggtattatggtatctacccgcattttgccttcttctgctacctgtaccaactgaagccccagcctggcaagaagaatcccactgtggttgggggaagcggaatctagatccggccagataggaagtcacatctcgtgggttgtgtctactagtttcgtctccctgtctcctccggggatgtccaactcgagatcctcga

SEQ ID NO: 65909 - DNA, 865 bp, Oryza sativa
tcctcatgcccaactagtaagtagtaaaaacaagttgatttataaagatcaaaattcatcccaaaataaaatctgtcttatgtagtgcacgtagtgaactgctcgaaatccctctaatatcaaaccactggttacaaaattaaagttatactcctattttacacgacttgtggtcttgtggatatgagaaaacacttgaaactgctcttatgtcagttttgcgtatgttggcatgactggtaaaaaatggaatcgctcgaaaccattctaatatctctcactactaaaaaatgactttcctagacgagctcttcaatatgttgagacggaccataagtgtcctcgtctacaaaaatcgacccatcattttcgtatacggctccttaagagacccatatgcaaaaatcaattttcgtaggcagccctcttaagcaaccgcacgggaaaataaggctatttgtcgggtcccagaactaattacttggatctgactagattaatgtatcaatccctagatcagtaaatattgatacatacaatatagctagttcttcattgcatacattaaagttttacaatactaaaggttttacaataatagttacttacatagttaatcctacgtagatctaatatacggcggaagtttctatacattctgactagggaggtataaaagcagtaataaacaatctggaagtgttatagcaagaatttataaaaatgtagactttaaatttctaaccagggtaccatatgagtcccggtactcaattccatgagtacggctattcgaatagtttcaaagatattctactgcagcagatgtacgctttacccgcagtccacgacttgctgataatca

SEQ ID NO: 65910 - DNA, 1622 bp, Oryza sativa
tcgggaagggggctaaaacgatagaacgaaggatggggatcccattttataggcgtggggagggagccgggccacgggaaggagcggggaacggtggcggaaaagccggccggcggccatggaaggtggccggagttggcacgtccgttcccggcgattgggggcgccattcaagggggaattaagggggaaagagagaggagggaaaggggattaattccccctaatcaattttggaattcccggtttgaatcacgtggattttggggaggtttggcgttaggtttccggggagagagagagcaggtcgtgcggaaggaggaagacgaccgcacgtgctgcgcgcgtgcgggaacggctcggtgtgggccaggtggctgggtggcgcggcttgggccgggcgggaaggagggaggggaggggcggcccagaaggaggaggagaggagggagtgggccgggaggggaagaggaggcccaagagaaggagagggagagaaagagagggaggagagagggacttcagccgggggccgagagggagaggggagaaaccttgggccagacttggcccaaagggaaggagagggttatttttaggtttttctttttaataaactctgataattgttgttgttgtttaataaatatttttggtgctctgaaaattcaagtaaaatttgagggctccttttagaccaaggagaatttaacaaaaattctccggaccacattcgaatttttctggcatgtattttagtgtttgtcaatttcttttcgaattttaattaattctattattccttttagaaaatgatttttattttgggatgaatttatcaggacgtgacaaatccaccccccttacaggaatctcgtccctgagattcgaggagcctagcaagaagataggttgggcggtcttctcttcttgcctgacttcttccgttccgtcttctataacaaacttgcctagcacaacttctccactctggactgcttggctcgatctcctgttgcagatggaatcttctcttcacctgacttgtccctggttgaacctttagctgactttgactgggttgcggcacttgaagatgggacttcagttccagaacttctcatagttcatatctttggcgtcaacctcatacaagttacccacttcatgttatgcgtcgatatcagcttgtcattactaggataccatgcttggagcttccttccagcttaccaccaaatgcttcagtctaagatatcccacttaccaaggataccctgtttgacgacttgccactaactgcatcatattagctttccaggtctccgggtgctagttacttctgctattcgatgcaagggtcggtaactttgcctttgaactatgtttctcaacagaaccaacttatcccacttgacatgctttgacgtctccccaaatgactttactgctagacttgttatggtctgatcgtgatcctgccaaatctaaagcttcgttgttagatgtgtttttaatctgacctctgtagactatcttcgaacatatcacttggttcataactgggaatagctaccacgaacaaacaacttggattcactttctttatgttcagtgtactt

SEQ ID NO: 65911 - DNA, 13852 bp, Oryza sativa
attgcaagacgaatcttttgagcctaattagtccatggttagccataagtgctataataatccacatgtactaatgacggattaattaggctcaaaaattcgtctcgtggtttccaggcgagttatgaaattagttttttcatttgtgtccgaaaaccccttccgacatccagtcaaacgtccaatataacatccaaaaattttcatttcaccaactaaacagggcctaaattaaatggccgtgattattgtttgtgacagtttttaagaatctttaagaatgcaatactgagagagagggaaaatactctctcgccacacacatctcacaaatttttgttgttttccatgccattttacggggaaacgattccaaactcttgattgaatattttccattttttgcatgtcgtttatatatttataaatatataaaaaatttaacaaaatagattaatacgtgaaagatcgttccacaaatatgtagggtaaaatttaacttctaagtaaaaaaataaatttaattgtacatatacattaactatagttttacttgttcttctcattgcaacttgtaaaagttgaatttattaatttgcatgtttgtgaagtgatatatcacatactattaatctatcatctcatttattttatttttataactatttcaataacttactaccgcatttgtttaatagatgatgccataaactttaggtttgaccattcgtcttattcataaaaaatacataattataatttattttatcgtgagtttttttatcactcaaattactcaggcatgatttacatatattatacgtttgaaaaaactttttgaacaatacgaatggtcacatatgtgtttaaaagttaatagcattatatattaaaaaacagaataaatataaacaattaggatatctcttcgatagtttaaaatccactcactttaagagaaaacgattctaaactccggagaaccattgattgcgtcggcgatcaccgccgatccacacacgtccacatcgtccatattgagtgcgtgatcaggccgccccgtatcgcgtcgcgtggagtagaagggagctttccattaggccccgcgtctttttgactcgggcgatgctaatcacgcacggttagccaacaattgcttggagcattgcccatttcttctcttgtgctgctctccctcatcacctcataccttattatagatggaacatgactgctcttttctcgtattcgaattatactatacttttcgtttggcatatgaacatcggaaggagttttgctcagataagataaccaaccattcgctgaacctgaaccctctagtcaaagagggatcgtagcacgtattttcagctacgtgaagcagaagcacgccaatagccgacagaaattcgcgtacgtgtaaagctggtagataacctgattggtgaggacgagagctcgccaactgcggcgcgctggtgtgcgtgcgtgaacaagatgggtgcggtgaaaaaaggcgtcgaggaaaacaccaaaaattgacgtgaatcgaatgattgggggcgcggcacgcgcatcagaattggattggattccaggggaggggaggagctcacctacacaaaaatgctcgccgtctcgtaccaccacccgtccaccacttgccgccatccaccacccaaaaaaaaaaattcctcctcttcacatccatccatccaatgatccaacgcaaccccaatatctgcctctaatcgacgcaattactgtactagtataggagttcttagttaggttaattttggaaggactagtgagtgtttttgtcgttgagctagctcatttcggagctccattgtccacaactttgtaaattggagagctcacacaggactaattaaacaagtatatcttaattaactagtgtctgatggagattagttttgcgtcgaaatgatgcagcagtttttttagtgcccgatgcctatcttctcgatcagcagcgctcctagattaattcgagggatatctttgattagtgagttcggtagtgggagacgctagcattcgttgtatatatctctatataggctgatgcaagtacagtacttgcagctacttctattttgcaattccatgatccagatgcttctggcagttcattagcccctcgtcttgaccttgcgtttccacacataaatacaacgctacagccagaaaaatgtcacatctcatcttggctacgcatggatcgattaatttacattgatgcacacataatcattactcagagcgaggttacttgatagccctgaattggtgaccaataattgttgttaagtactatatcaccttgctttcgatctcatccactaatccgtggcatggacgagaccactcgatcccgtggtgatcggtggtcgtagatcggtctgactattcgtgcgtaaacatcaagcgcaactttctttcgtgccaccgtaagccacccggaacgaacaatttttcgtcctcctcctcctgtcctgtcctgcagccgcgaggcgatcgacgatagatgacccgtgccgcgcgaacgagccgagcacaccgggcgtgcgcggaaatgctacggttttcttgccaaaaacgcggagatccccgtgcgatcgtcgcggcccaccacctcgcgcgcgcgcgtcgttgcgttttttttttgcttcgcggcctcgcgagacgctgacctcgcgcgggcgcggccgggaggatccatcgaaaacgaaggcgtcgcgttgcacgacgacgtacgcagcgcttgcccacgtggatcggcatcgatcgtttcgagatctccggctccaaatcggcggggcatctccccgtctcgtatgctctcgtattctcatcaccgatatgcgtgtcaacgtccagctccgtgcccacggttgtgttgctcgcgcgggcgctcaacttgcaccagatttttttgttcgccgggatcgatattagaaggcgctgcaacctgtcgtgcaggttgtgcttgtgtgcttatagtacccttcctatcggggcagattacttggccattctaattttcgacgatttgaagctggtctcgatcagctggtggataatcacaaatgcaggagatggattctaatagctcaaatggacatctacccatttattacatgtcaattagatagttatgaatttttttaaaaaaaattgataagatatatcaatatgtaatatatcactccacagatacacaagtttaaatttaacttctacaagttataacaaatttaattgtaaatatacatatagtaatttgagttttgtttgttatttttgttacaacttgtagaagttgaattttaacttgcatgtttgtggattgatatattacatatttatctattttgttcatatttttttatttttttcataactattttggatgacatgtaaataaacgagtagacatacacttaaactgttaaaatagtttccgcccacatgtggttttatatgtactgtgagaatgtatcgtacgtgtttgactcgtgtaggtttgatttgctagagaaatcgcacggtttggcaaaatcaaggcgtacacatatcgtactccacaatctctccggatgatataagtgtccccgaaattaaagctccgaataggtgtggcgttataatcttcggcaacatcttcccgtttgtgctttaatgtgcccaacacgcatttgcaccctagcttgctgctttttcagtgcataagcaacggattaattaattccctgcttctaacggccttctcttcagcttgcatcatcatgtaatttcagattgaacaggtgaaacattacaatcagcacacttgtatcacgaggattaaactcgaaagtccaaagacaaccacgtacagtacatacagacgcatgaatcagctcattgaaaggttgattgtaaccagcaaagtttgaaaaaactattcacctcgccattttttcctccttatgttgctatccaagaattgatgtttgtaaaattttcaccataagtttttgaccaaaatgcattattgaggggctccctactatacgatcacgtggctgtgttgaccgatggaaaacaatttgccaataataaaatcacggctgtacagcgcttgtaattagacctgcaaataatggcgatataattgaggaggcactagaaatcaataatgtcctttttcatgtctaaatcaatggtgcccgcttctccaataccaagaacagttcaagctcaaattgtttctaccaattcacaccactgtttttcttgtaacgcaacaatagcagttctggatttttttcccccaacccagcgaaagaaacaaggtgattttaaaataagaagaatatattcaagatatggtagtagaggcaaaccatcaaactacgcaaagtaaagctgaaagagaatgaatgaaagaataagaatccaacatatcttaatttacagagtaaatgccagtcattgaatacttttcaaaactgtaatggcctcagatggagaaggcttttagcccttggcgcaatccaaaaggcgaattcccctggacaaagggcagcaaaatttgaagtcaatccagcccaccatcagtccatcaaccaactacaggacgccacgtaagcaaaacacagtgtggcgacgtgcacacccctgtcctgagcacacgtggggcatcctcactggctgcaacttgttacccccgcgtgctacctgccgtggcctgacggcatgggcgaaagctacagcttatttgtactagtaattcacatttcaaaaaaaaaacccttttattttctttttgtatattttgtagagaaagattggcaatgaacagagaggaagagagatgcttgccttcggttgcgttgcgttgcttgcacggccaaagtggcgctatataaaggccatggtgtgaggcctcttcttcctcagagagacgcctcaaccccaccccaagaacaccaaagccacatcccatcccatcccagtccacggtgaggttgagcgatctgaaaaaaatcatcagcgacgagcagcaacaggtttgttctctgaacttctctgatctttttagaagcaggtaacacacaagaaaggtcctgtcccaagaaggtacttctttcgggtttattagatcgaaagaggagttcttgtgcgtacaggttctttctcatcccatcaacttctcctaggaggaacagagatccagagaaccttttttctcttctggattcttgccgatttttaggcttcctttgcttttctaaggccagaaagggttgttttgcaatacccttctagttcatcctctcaaatttttcttctttctattcaaaagctctttctttctttgcaccctttgtttctctacttttattgaggaacagggctgatttttcacttcttgcatccaaaaagcaccccttttttctttcctgtttttaagatttccatacccttgccatcttcatcttctacctccatccagtcctcatggccgcagcaatagacatgtacaagtataacactagcacacaccagatcgcatcctcggatcaggagctcatgaaagcgctcgaaccttttattaggagcgcttcttcttcctccgcttcctccccctgccaccactactactcttcttctccttccatgagccaagattcttacatgcccaccccatcttatcccacttcctctatcacaaccgccgccgccaccaccacctcgtctttctcgcagctacctccgctgtactcttcgcagtatcatgctgcttcacctgcggcgtcggcgacgaacgggccgatggggctgacccacctgggcccagcccagatccagcagatccaggcccagttcttggcccagcagcagcagcagagggccctggccggcgccttccttcggccgcgtggccagccgatgaagcagtccgggtcgccgccgcgcgcggggccgttcgcggcggtcgccggggcggcgcagtcgaagctctaccgcggagtgcggcagcgccactgggggaagtgggtggcggagatccgcctcccgaagaaccggacgcggctgtggctcggcaccttcgacaccggcgaggacgccgcgctcgcctacgacaaggccgccttccgcctccgcggcgacctcgcgcggctcaacttccccaccctccgccgcggcggcgcccacctcgccggcccgctccacgcctccgtcgacgccaagctcaccgccatctgccagtccctcgccacgagctcgtccaagaacacccccgccgagtcagcggcctccgcggcggagccggagtcccccaagtgctcggcgtcgacggaaggggaggactcggtgtccgccggctcccctcctccgcccacgccgctgtcgcccccggtgccggagatggagaagctggacttcacggaggcgccatgggacgagtcggagacattccacctgcgcaagtacccgtcctgggagatcgactgggactcaatcctctcataaacaagcagaagcagctactactagtctattactagtactagtagtagtcttcgtcaagctagagtcactcaactcaactagctgtgtaatcttctctgaattccgtggcttccatggctcggtggcattttagacgtcggccatggctgctgcgagtagcagtaactagtcagtactcagtagtagtaaggtcgttggtattacgtcgtcgtgcaagtgtcgttggtgtactcagtgatctgatctcctggttgagctgccggttgtttttttcacggcgcggccggtcgagaattaagctgtaatcccttgttacatgttggaaattcagtagcttatgtaactatatgtacctttctcacgtgcttgtctgatctatatgtgtgtagttgtgtactctcgagttgcctaatcagttgtcatgccttctgattgtgattattatgtctccgatgctactatgctagcctgcaattgcttaccatcagatactgagctgtgttaatccacatagaaaggttaagttttcattcatctttgaaaaagaattaaactttgatgagcttgtaaagtattcatggctgcgaaaaatagatgccctactaattcatacctctcccggctcttctctcaggctatcagctgttcagatattcagagcagttcagttttttttcactcctgcaacaaaatgatccggccgccatccaccgtgcatcaggcgtaaactgcacacaattgattggaggagccggagcctcagagatgagttcatcgttcgttggcatccaaattcccagctcacctcctgagctgtttcagttaggatgcacacgaaagcgctaacatcaccggggcgtcacaaaaatggcgttttgtttactacaacatggcaatttgcaacggatgcatccggaatctcgccgaaccccatgatgcaagcgcccgactagccgagcttatcctccgaaaacgacatgcgggtcaccccgggccggccagccctcatctcatcccatcggcgtctctactacggccttagccttacccttattcgcccccactacacgcatttctttattaataatccggccatccaagtcgatcgccggtgaaagctaagctaaggaagagcataaagaggccggccggagggaggtgatgagatgaggcatcatatcatgatcgtccattcccaaccaaccttaccctctcctctcctctctatgaacctattttcatccctttgttctcagtaatgcctaattgcacatcactttgcgagggataccagtaatggattaattaaacgggaatgctacgtggcagaaatttggggataaaattttagagatgttggatcattggaaccgcgccaagatttgtgcttgggcttcttctcccctgactccagcgagttctccctatttttcgacaccaatgacaccccccaattctgactggtgacctacagattagggtttggaattggagttgtcacatagatagacctttaatttaagctttatttggttagttccacacctacatctttccaatcacttaatcactttcttgtaggggattaacaaaaacaagccctagcaaaaaaaaaaaaaacctaaaaacctatacatactccaaacaaatctttttaaccgtttgaaactttgatgtaactatataagtagttaaaaaattctagatttactcagagcatatcacgttagcgtttctaaaagttttataagaaaaactctgcaagtgttaacttttccttcataaaagacagtagctttaaaagaaaagtcaaatcgctttaaattacctacacttatattataatcacactttacatttagaaatttacactgtaattagtttatattgttattttctaaatgcacataggattaaacataattattatctattcctacttgaaagagaagataagaaagatagaagcatactcatttttaagagagagaacaatgggaaaaagttattaaaatcaaataaaaatatggtgctatattttaagaaaaaaaataaaatccttttagcatcaacggctttgctttcataggggagcaactgcagcggccagcggccagaggccactcgtacatagctccagccaaatcctccctgtttataacaactaagcacacctgttaattactcagcacctttattctcccttgagcatcagaagaatgcggcaaggaacacgcaaaaaacgcacgatacgattctatctgattaggatcgacaataaatctcaattactagcgagactagttctaatgtaatattcttcttttggcgttgccgtttggtgtgtagagcaggaggaggagatgggacaagagttaagatatgggctggatttgatgagagggaaaaaagtggacgggcatatgatgcgttcatatcagcggaatctgtagctcgcagtagcagtagtagattactgctacctctgtttcaaaatatttagcaccgttgactttttagcacatgtttaaccgtttgtcttattcaaaaacttttataaaatatgtaaaattatatatctacataaaaatatatttaacaacgaatcaaatgatagaaaaaaattaataattacttaaatttttttaataagacgaacggttaaacatgtgctaaaaagtcaacggtatcaaacattttgaaacggagggagtagaagttaagggtcggtttagaaaccttatgttggctgtaatttctcataaaatctccttatgtaagaagctctccaaataatttagacttttattaagattttaaaaaattatagttatagaattaagaggttttcgagcttcttcaaatttttaacagctactccagttctcagaatctattcgcgaacaggacgtagggctcgtcaaagtcgcggaaagcgccatcaccacgcaccattgcggatctgccgtgctgctgcctgcccaactctcattatttggctggctcactctcgctctcgccctctccgtccactctggattcgtagagcgatggaatccgccagcctgcgaatggagacagagcatgctagctactcgtttcctcctttttcagtcaaactggttctagaagtgcattagagcaggtcattagtttctcggcaagttgggggcgtgaatgcgacatggtaattacttgctccgatagtccgatcctactcctacctgctgatgtcgtagtagtatctgtgtggtggtaatttaacttaaacgtactgagtgactgatgaactgacctacagggcagggtgaaagtttggaactttagctgttgtcctacatttttaagcccagtggcatctgatgattgacgcctccgttctggaacttagctagtagtaaagtctgattaggtttaactaccatgcacgcgtgccacacatactactcctgatagcctgatcgtccctttcctgcctggctctggcgtgacatttggcctatacccattgtacacggccggtaaaactctcctagagtggcagccgttttcctggtcggaaagacccgcgtgtacaaaaaagcgagtctttacgatggaaattacgcgccttctccgtgcccgtgaggccaggccacacacacgagatacacaagcagcaggagcacgactgcacgagtgtttgctactgatgcctgaactgaagtagcccataaatcaagcctggatacataggccaggccagactattccgaacactttaggctcgcggacccggctgtttctcccactcgagtccaccagcagcttgccccgatgccctgtgctgcgtggccggccgcgcgcgggccgcgggggccggtgggctgagctgcatagtggggtacgtttgcacgtcgccggattctctcgagcaggccgcgagacgagcggcctgacggtgggagaagccagcgattcgcgtacaatcgcttgggccgaacagccgggagtatggggcgttctcgacctgcggtggcctcgccagcccaagatgaagaatccgggtaggcctcagtgtagctggacccgattgacaggctgcgtggaatcgcatcgtaagccatcttggttcttgcatgatcaagcgtattccgtccggcctgccaagcataaattccataggtctctctttctccactcctgaatccacgatacggtgggctgcaacttaaagccatgatgtcatacgatcagtacacaaaacagggatgatacgatagaagaaaaaactaactacgaagtactctagagcatataaataatactgtagtcaacacgggacttgcacgaagtgattccggaagaactaacgaagatacagctcgccaataactccgtacagtgatcagaccctccacgcatagcaagttgcgcctgcgacattcgcggtgaggttgtagcctgtgtttagttcacaccaaaattaaaagtttggttgaaattaaaatgatatgatggaaaagttgaaagttcatatttataggaaagttttgatgtgatagaaaagttaaaagtttaagaattattttgaaactaaatacggccgtagtcaagaattatagcccgcgtctggtcttctttccaatggaaagctgcacctgcaagaacctgacaggagaagccgacccccaatataggagtactagtaaatggcaggggcaatcgatcaggttcggacaagccactggctgcctagccggccgacccggcccgcttttgacgagcccgcgcatgtgagtttcccggcacgagtgacggcacgaggcctgcaggctcgctgccaactgtagtgtactgtacatgtgcaatacgggggcacttagaaatgtttgacaccgttgattttttaacccatgtttaaccgttcgtcttattaaaaatttttgtgaaatatataaaattatatgcttacataaaaatatatttaacaataaatcaaatgataggaaaagaattaataattacttaaattttttaaataaaacgaatggtcaaacatatgctaaaaagttaacggtgttaaacattccaaaacggatggagtatattctacatgctcctatactatatgcccatgaaatgacgaaatggaatctcgcacatcctgcgtgctgtttctagattccagcggctcgagctctgatcctctcgtccaagcagaatccggtcaaagtctagattctctcatccccgactacgtgcgtgccccacgcaaagcagcatatatctattgcttagcttagctaacccctgcatgcaaagaccaagccagtaggaaatccacccagccgtatgtgccatgcatgtgaggccgcatgctggggttgtgagagagagattattggttggcgattcactcgagcaagcaaggtaagctaagctagctagcgaccaatctcctgccgttctttgctataaaatgactcgaggaaaagaagggaaccttttgggccacgtgaaatcgaaagctgttgcacatcccatcgttgccgtgcgcgatgcctgttgctttatggtgtcccccggtccatttgttcttttataactcgacagggttactgggataggagtagctagcatgcaagtatgcaaactcttacaagtacgcaattatagagaccactagatcatgcactattatgggtttactgattggtgcctggctgccaatggctctccccttcctctcgatctccacggccgaaagctgattgcagcatctttcttcgaagataagtatatactgtactgcattagcagcatacggattacgttacttttccacaatactatgcctctttccagtactacagctattcaacctgcaggcagctgagggattctctctgcattgttaatataaactttctattctctattgcaccgatttacatgctatattactgttaagtttgtctagaaatggcaaagtggctattatatatgtatgttgatagttaaaatatatatacatgtggcgcggcagtcctagtcaagtttctctctaaaagcaaatgcgtgtgtggatatatattgccactactgttggaatactcgtattattggttatggatgcgtacttcctcctccaatttccatcacgccgcacgtagaaattctccatgatcggaactgcacagtgcatagcatgtaagggctagtgactgtttcagattaaaagaacggaatagtacggtagtatgcacatcaccatcatttgagcgaggcaccaattaatgtttcagtcaaaataatagtagaagaggtaggataacatggtcaaaaggcatgtaactatcaattttgactgtcatgagttgctccaaaattcatgcaagcaagaaactttatcacaagtcccccattcttcgtgcacgcatatattacttgcttcgtttcaaaataaaccaatctagaatatcacacgggttacatacgaatatattgtactagataatatcacatccaattctaaattaatttattctgggatgaaggaagaacatatttagtccatacctatgaccgctactatcaacccccaaccccaaccccctcccccacacgcacacgcactccttggtccctcatttgatcttccaacactccaccacgacatcaccttcgtaattaaacatgttgtactgtggtacatatatgcccccgccatcaattgaatgcaccctttatacttatccataaagttgtttttagcactgccagtctggcactataggatggataataacctgataataatactagaaaatcagtgcgcctattggcatgcttgctagttagcccataatgtgtgtgtaaaaattgaacttcagtaaagcgtcattggtttttgtcattcgtttttgctgcatttgcaatagatatattatcattctaaaacttttttaacatggtagaaccgtatttctatcactcaataatacataataaaatagacattgatttttttagtattgttatttttgtggctcttgatttcataaataaatcttatattaaaacagttcatgtattgcataatgcactctcagtaactacgtgtagcgcccgttccgtcgtggcgtctagcgggaaaattatctcttaaaaaccctaattgcgaaatttgcttccttgcttgttgtctagcgtccgtgccatctcaagatctcaaatccccgatctatcgtcgagttcaattccgaatccaaatccctccaaatcaaattcctccgcaaaagtctattttacctccccc

SEQ ID NO: 65912 - DNA, 989 bp, Oryza sativa
cattgttgctctatatatatatatatcttttagcagagtgatgaagagaagcccttgttagtacgcttgcgtacttaacaagatgaccggagtgcggttccgttctaggtctcgttccccagtcgactacttgtggcatgtcaaccgggcccttgaattattttgtcttccgctgttgttctctgataattgttggcctacctggccctaatgtaagcacttaactttcttagcctaaattcattcgtgatatgttgtgattcggctatgtatgtgtgtaccaactactgatctagggattggtactgataaacacagaagatttccgattttcaaaattgggggtcgacaatttggttgctttttagcgacaggctaaacacaagagacatgttggacatgaaaaattgtgccccactaaatgctgacttaacctgtgttttgtgttcacttcagtgcagagaaactctatttcatatgttttttcaatgccccttcagtaaaagatgttggaggtggaatttcttggaatacatctttggagttctttcatatgcttgtcttggctagtgatgcggacatcactacctcggatagacacaacaatcctccaacggtcatttaaggacagataacaagagctcgtgcgcgacaattaaatttagaggtgagctcgttcctatgttcttctttgtatgaattcgagaatagattgctacctaatgattatattgtgattaggaacaatggaggggacaaggagacacttggagaaggacttagagccatggaggatcatcggggacgtccaagtcaaggtggaggcccaaaccaagtcgacgtcgggtgtaattcggagtccaggaccagtctgcactaaaacgggcgcccaggtcgcatacgtgctcggattggggcgttctttatatggatggaaagctaagaagataacctttccaatggttttagtcccatgtccaaatttcttt

SEQ ID NO: 65913 - DNA, 13134 bp, Oryza sativa
cccattgacataactatttatatacaatggtttaagatgccgattctctgtcccttccggcttctcgaagactgcttgttctggtgataaaatctacttagccgattcttcttcaacttcagtgacatcggcttgtttgaccccaaattcagcaagcaatgtgaaaaccatgttaaccgatgcagtcacaacacttttccctttagccaatctctttgcttcatcggttgtggcttcatcggctacaggagcttgattcttaacacgccactcctgcttcggcttcgtcttctttagccgatgattgatttcttgctcgaccttctaaaagcactccctgttcctcaacctctgaacccttatcttctgattctttataaaactaccagaaggacaccattgagtcttcctatctttattgtcttcttggtcacaatcttggttcactgggcccattctttgatgaacaggaactcttgcttgccttagccgattgcttctattatacgatcggcttgaacttcctgcaacattagtgcaccaaggacaatcctcaatagacggcagcctcataccttcattccaacaaaatctaaagaattcacatccccaatgaggatcaaaccgccatcatcttcttcataacacccctcctgctgtttgtcatacttcttctgataattattaataatcttggccgaattcacctaaaaacctcttgcacgacctccatcggctgttcggccaactatatgcaccatattgacaggaaaaggattgccatcaaccttcatcggcctcttagaatcatcaaatttgattttgcctccttcaatagttgcctggatctgctgcctgaagatcttgcaatcattggtagaatgagacacaaaattatgccacttgcaataccttctcttgcccaattcttcagccgatgggattgtatgaacagcaagaagttgaatatgtttctctcgaagtagcaaatcaaaaatcttatcagccttggtaatatcaaagtcatatctctcttcttttccagaactcttcacccattggcatggtataacctttttgcttctaacccattcggctgctgctatttcagagtcatcatcatcatccgatccatatatgtaaggacatacataattaacctttttaaagttcttcctggcttctgcaaacctctgttcatgcaaggttaccttctgtgcaagatatgacaaactatcaaagtcttgagacgagaacttctccctgatcagagctatcataccctgaaaagccaaatcggctagctgggcatcagccaaacttaagctgtttattcctcgtctctttgaacctctgaatgtactcatgcataggctcatcatgcctttgcttaatcgctgttaaatcgaacagtttcatctcatgaatcctactgtagaaatagctatgaaaatgcttctccaaatcggcccaactgttgattgatccacatggcaaagaagaaaaccaagtgaaagccgatccagacaaagacaatgcgaacaacctaacccttaaggcatccacagccgatgcttcactacactgagctaagaatcgactaacgtgttcataggttgaaacgctatctttccctgagaattttgaaaactctggaaccttgaatcaactaggcaaaggaactctctcaaaccacttggggtaaggatgccgatacaaatttccatcatcttttggcttaagcccaaactgttctatcatcacgtctgcaatcatatcggcccatggtcgttgctgaggtactccttgcgcttgttgtggcataggctcgaattgattgtattgaggaacaaactgggggtgagccagtccttcttgctgatattgaacttgtggcgatggaggctgatactgataattcaaattgcccgcctggtaattttgaaagtttggctgaatattgcgcaccaaatgtttgggaacaacttgaggtacgaccgtctgatctggttgcacatgatgaaccaaatgttctgggacaacttgattcgcagcgtgctgaccttgctgctgaatcggctgaacaacctgttgcctcaatggcatttgctgaatcgactgcacgacctgctgcctttgtggcgtctgttgaatcggctgcaccacctgctgccttggtggcgtatgctgaatcggttgcaaaacttgctgccttggtggtgtttgttgaatcggctgttgctggattgagtcaacagtaggttgaggtggtaagaacaaagctgcaacctgatcttgcgttagccgattcacattctgtcaactatgctgtggttgctctctcaccaacaaccgaggattaactaattgacctggtgccaatgatggtgcagcaggtgcaggagccgatactggtgccgttggttgagccgattgtgcattgggaggaattggctgaactgctggctgattatcagtgattaacggccgatagttcaggaaaacacctcgtggcaaataaaccggtcctgtagcttgatattcagctatcgagccatcaaccatcgacttcactatgtttgacaaagtgttgactaatatcccagattgattgatcaaagcatgttgcacggcatagtcaacctgatcctagaagttgttaaactttagctgtaccatgttgccatcttgattaagatttccaccttgaaatccctgagaaccatcaccttgaattccatgagaaccaacaccttggaccccttgagagccatcaccttgaaccccttgagaaccatctgcaacacttttatcacttggttgagctgcaccatctggagcttgttgcacttctcgatccttggaagaacctattccgggaacatcagcaattacttttactttatagttctgaacaactgtccccttgcgggtctgcatgaatgaattcaagaattggttccgttcttgctgcatcattgcttcaagatccttctgctgctcaggtatcaacttgtccggagtgatggtcacgatgttcaggtgtcaacctcagataaaccaagcttctggatcttagatttaaaagagccatctttaccagctgaagacggcaatgctggtggattctcatccatgaggaaacgtcgttgtgattctgacttctaatcggtcccgccaggcatgccaaaagcgtgttgatgtgaaaacacgaggcctgggagatcttcttaactctagtgcaagtccaaaactcgccttcgggtatgctagcgtgccagttgatttgatcctgcaatcatcaagaaacaaagacaaagaatccgtggttaaatccataaatgatagccgatcggctaggtgccgatgacgtatcatttatctttgagccggtgtcatatatgcatcgatcggcagtcataaataaataagaaagaaccaaatctacttgatcggctgtagatattaacgatatataatctctatgtcgatatatacttaaatcaagtgattgggatagatcggtcgccatgccgagacattataaatcacttagatcgaaatatatactaagaacaagattatatatgctcatagcatagccgatcacatagatttagcatgtatcggcaaatactgcaataccactctatattaagatattaaagcaaatagaatataccaaacaaagagcctaatatacttaaatacaacaagatcttaatatgaagggcagatttaacatgtcaacaaagcatataagataaatatggttaaatcaggtaagatcagctgaaaccccgatactaccctaatcggcaaccaagaagcaggctagagattgagattctaatcacgactcataagatcaaactcaactgatgtagctataagtatgaaaagaaggacaatatctagacaatcaagccattggaagtttcatagagtggtggatatcatatataatctaaatcaacatcggtatttaacctaatcggctgccttctagtagcagatgttagccgattgtaggttagatagcgatattgccagagattatgtaagatatatgataattcaacgaattacataaacaagattagagtatcataatgatgggatcactaatcccgagaacgcaagccgccataacaagttttacctcttgttgaagatcgaaaccgatgcagctcaacccgaaagcaagaactcgtcgaaacaaaacgaaagtaaaaagggtggcaatgcgccgagattgtattaaacgtgtgttagtttgattacatggggttcgggtctatttatacccgagaaatacaagatatgtccaaatcggacacgactcttatctctaacaaactctaagataccataagtccttgcggcaactttttgcccaaacatatctgtaagaaaatcacataaaatatcctaattaatagatataattgccttctcaggactttatccatgcgtggcaagcatcatgaagcacatcaacctaaaccgacaacgtatgctatgtcatattgtcgggttcggctcaatcggctaaccccgtccgacctgaactctgccaaccttagccgtagccgattcggacttcagctgatcctcactcgatttcttctcgatttcttcttcatctccgatccttggattactaaatttggtcgttaacagtgtcataccaactaggactaaggtttttttctttctttttcattgttcttttgctatttgcatattgcgcaaatcattacagatcgaatgaataaaataaacaacgaaatccatgtccatgaaaactaatttatagctacacttcttcacatctacaataacaaaatcatccatgttcttgaaaactaattcataggctacatttcttcacaactacaacaacaaaatcatccatgttcattacacttcttcacaactaaaacaacaaaatcatcttcttcacaattacatgcattcatcaaagaagaacaatgcattcatcagagaagaacaaacaaaaagagagcgccgaggggagaacgacgccggacgctggccgccgccgccacttcccccgacgaagccgccggcccccaccgccgccacctcccccgatgcaaccgcctgccgccagccgccgcctcccacccggcgccgacggccgctgcccacccgcagccccagtcaaggaagtgtagagggtggagtagaggggtagtggaggaggaggacgaggagaagaagggagaagagataaggagataaggatcgtggggtctgtgtcctgcgcgcgaggagataaggattgtggggtaatagatatttaccccggttggtattaccaaccgggattaaggatcattggtgccctgacaactattgaaccgggactaaaaataatattttgtcccgattggtaacaccaaccgtgactaaagattaataagtacagctaggctttttaaccgggactaagaatgtttttagtgccattttttttcatcaaccgggactattttggtttttgggcaacccatcaaagatggtttctctagtagtgagaggtttcgacttgttcgatatacgctctacaaatcattcccacatgcgcaccactcatccaaactatatgatttgcaaccaatggtgtgaaaacatccgcatatacagataggatacactagtggggtttcgagcagtttgatacacgtagtacaaatcattgtcacatgtgcaaaaccgacacaagagccattttaagcgctttcttatgcacggttagtcatgtaaaatataactattacaacaaatgatatcaaaatattcccatacacataaaattgacattaggaagctttcaagtgattccacacgcggactacaaatcattcccacatcggcatctacttgtgtaaaatataatttatctaacaattggaaccaaaacaaaagtcactagtacaaaaaagtgatttttgatttttgcagatggccaaaagaggttttcgcgtgcggtagaacaacccacatgcactagaggatctatgaaaattgctatcgttgcgtgcgccgggggggggggtcacccgcacgcaaaaatcgctactttcacgtgtgggtgcttatgttgtctacacgcaaaaataaaaatcacgaaaaaaaccctctgccgagcccgtccgctgcccgtcggccgaccgccttccacacacggaggagggactcacccgtcacttgcactccgccgccgcacgaacgctgtctgccgaactccgtcgcgtgcccatccgtgcgccgctgcctgcccaggactgagtttgtggaggaggggaggtgagatagagagagagagagagaggagagaagataagaatgacttgaaaattttaaagtgctaggagggaaaaagagaaggtaactcggtaactcagacttctgggggaatttttaagggggcttcctacgaaaatatattttcccatgcggtcccttaagaggcgtctggaaaaatagtgtaacatcctcaaattttaaactaaaatttgattgcatcatgctggcttttcattaatttagtgtgttctaaaaatttatttgattcttaaatggttcaagtattacttctttagaaccctactaatttccaaaccttagtgaatttgagcaaattctctcaaatttcaaactatagattatttccctagtttatcctaatattgttgagaattttatatacttcaaaccctagtgaacctttccaaattcatagtttaaattcaattttctctagaaaaaatattcaaaagtcctgaaaaacactgttcattgcactcaaggtgctcgatgaaatgcccagcccagctagaacagcccaacacccatccaaccttgcacaaagtttaggtttggaccttggggaccacatcccactcaaaaaccatggtttagttggccttctcctccccttctcgcgcgctgcctagcgtcctatcttgccgcgcgctgcgccgcagcgcgtaggcctcgagatcgcttgtgcgtgcccgactgccttcgcgcgccatcgcccgtccgacgccctcagaccgccgccgccgcaccaatcttgacgacgacaaagccaggacgacctctgccgcaagaaatcacagctcgacgccgtgcgctcccgtccaacgctgccgccgagtccgattttgattctacccgggatgaatcgcgccaattcttgccgcaaggttgaattgaagatagaaggtggtttcccctctcacaattcaaaccaatcacacccgagccggccgttttaaccctcgccgccgccacgcgtcacgcccggattggcgccaacacgtcgccagccatttctacccgcagtcaagccaatccttcacaggtaagtattcaaacatggcctcccgccactcaaattgatcttgcccgccccctcacagcctctgccacctttgccatatccaatccttgagctcatccatggcgatgatggtgtccgagctcatcctttacttttggccctataaataggaccccaatcccttccttgcccatcatcgatcatcaacaaccatagccccgcaactccgaagctctgcttcaccaatccattccatcaaccaccctcgcccgtcagtcgaacaccttgtgcgcgatcacctccacacccctccatccatcctccaccttaaataccccttaaaacacctatatcctaccatgttttagcatactagatcctaatcgaagctctacgtcaagttttacctcgccgcaccaagccgagcactgccgcccccacgctgctctgttcttcgccactgtaaagtttttccggccgcaacccatcgtttcaattgatctcggtgagttctttcgttttaaccatctatgtactccctagattctattttagcaattggtttgctctaccatgccaccctctaggctgccgacgtgagcacggccactgccaatggaggcgctcgtgggcaagtatattccgcaccttgccgaaggtcggcaagctacctaaacccttctaggtaccttgtagatgctctagaacccctccccaagccatgtctaactctctttaccctgatcaccttcatggtttaaccatgccaccgccgccctagccgctagcttagccacataccaaattaacccctccgccgccgctcgctgtcgccggagaaccctagctccctcccctcctcggctgcaacccctttccccctctagcgccgccacaatcccaaaccctagcgccgcctgccgaatttagggatcgactggaggtagaagaagagaagagagagagagactgacaggtgggacccgcacatagtgctatttcacatttaattgattttcaaactttagaagcccatatcttttaaaatatagatccaattccagtgaaacttggaccaatattcttctaaaatcattctctatcttttgagaccccttttgctatttttctattttattgtattttctctatttttcttatttttttagattttatttgaattccttttaaatttgaattttatatgcttaaccctaggtcttgaggattcttctgacacactagataatatcaatcaatctcaagacatcgagcaaggcaagttattatatatccttttgatcatttaagcctatattttacaaattatttatttatagcctttccattcaatattctattttattatgcataatttaatcatagaaacccagataatttagtattgcttatttcgctcacaatctggttaaaatatcttatacttagattgggacagtatgttagaattggatgatttccgtgtggctagaactgtctcgatcgatatagttattaccaggtacttatgtcgaacgaacgggtacgaccgcagcttctagaatggggacagacctagtaattatgttaattagcaatatggcacctctgtacagtggttcttatttttaagtcctcgcgcaggaggcaactatagccgcgaagggcaacttttaaccattaccatgtacaatggtttgtgatactcgagtataaattatatggtatatttgtaaaccctgatcgagatgacgtggtgtcatacgattagttccccttaaatacctcgggaacaccaaaactcctcttgctgctgttaacattacgttcagagcatatgaggatataagttcatggaacaggtgccacaattgttaataacttaatactgggccatgactaaagccgatgattatcagcaagtcgtggactgcgggtaaagcgtacatctgctgcagtagaatatctttgaaactattcgaatagccgtactcatggaattgagtaccgggactcatatggtaccctggttagaaatttaaagtctacatttttataaattcttgctataacacttccagattgtttattactgcttttatacctccctagtcagaatgtatagaaacttccgccgtatattagatctacgtaggattaactatgtaagtaactattattgtaaaacctttagtattgtaaaactttaatgtatgcaatgaagaactagctatattgtatgtatcaatatttactgatctagggattgatacattaatctagtcagatccaagtaattagttctgggacccgacaaatagccttattttcccgtgcggttgcttaagagggctgcctacgaaaattgatttttgcatatgggtctcttaaggagccgtatacgaaaatgatgggtcgatttttgtagacgaggacacttatggtccgtctcaacatattgaagagctcgtctaggaaagtcattttttagtagtgagagatattagaatggtttcgagcgattccattttttaccagtcatgccaacatacgcaaaactgacataagagcagtttcaagtgttttctcatatccacaagaccacaagtcgtgtaaaataggagtataactttaattttgtaaccagtggtttgatattagagggatttcgagcagttcactacgtgcactacataagacagattttattttgggatgaattttgatctttataaatcaacttgtttttactacttactagttgggcatgaggacagttagtaaagggaggctgcttatgagaaaattttccggtcgagatgatgtcgagaagctccaggatctagcttcttctttctcagttcttgcttatgttctttggttgtggttatagttatacagatcctaattaatgtgctaagactgtaatagctttaaacggaagtagagtacattagatttttttttctacacaacaaatggtacaaatgaaccacattagccttttactactacttttaagttaatactccctccatcctaaaataaattcatgtttcacccatcccgcatataccaaaacaaaaccaaggctctatcaaataaaaatgcatttatttcccgactttatttactcccaatgcaattattcaactgctagagaaagcatatttattcccgtttgcaaccccttttgtcccgggtatgcaaccgggatctcgaatccaggattaaagatgagtatctttagttacagttagtaacaccaaccggactaaaaataatttcgccaggtggctggcgctggcactgctatcttaggattctttttttcattgtttttagctgcttgcatattgatttcccgagttcctctctacatccccaaataagttgctccctacatccccaaatcaaagattcacacataacatcacaaagcacagataacataacagattcacgtcaccaattcttaacaaaaaaaacataaaaaaatctttaaaaaaatacatcacaaataataacatcctaaattcacatcacaaattctaaaaaaaaaagaatgaacataaaaaaaatccggctcgatctggcgctgccgcctaccgtgtcccctctagcagaggggagggcactgccatctcccgccacccgcttgagaggggagaggggaagggggaggagtggacgaggagggcgccgccacccggcgccgcccgctcgaaggggaagagtggaggagggcgcccactagagaggggggagggatagggaagggaaggagtggaggagaagataaaaaagatagaaagagaacaagagtagaagacaaagtataggagaagataaggaagagaaagagagagcggcgttcgagagatatatttagccccggttggtgatatcaaccgggattaaatatatgatctttagtcccggttggtgataccaaccgggactaaattttgttggggacctaacatctattgaacctagactcaaaatgatcttcagtcctggttggtaacaccaatcgggactaaagatcaaaatgtacccctgggctttaaaaccaggactatagatattttttactcccggttcttactcgaaccgtgactaatgtgattttagcctgagccagcaaagatcacttctccagtagtatctctactttcacaaacacaaatgcaatgattactaaacatgtacttattttaggataaattggatgagtaaacaatgattattatagaatgaagggagggagtattgtctccatccctaaaatgacctttcttctggtctcatagagacatagtagcattactttcatttttattgtagcaacaaaggttggttcgtaagtagtactagtacatgtcaaatctaatactccctacaccaaaatataagagattttaagtggatgaaaaatttcctagtactaagaatctgaacaacttaaccagattcttaggactaggatatttcttatcaatttaaaatttcttatatcttgggtcggagggagtatagactgttttcggtatggtaagttgggaactaatcattcggaacgaaaaacagagcaagtcattagcataaaattaattaagtattatcttagaaaaataaaaaaatgtattaatatggtttttttaaaatgacttttatgtagaattattttttacaaaaaaaaatacaccatttaacagtttgaaaagtgtgcgcgtgaaaaggagaggtacaagataggaaagggaggaaagaacatagcctagattgctaggccctccgtcccataaaaaattaggcaaattttaccacatgatatcgtgactttgcggttttagttgtaggacacctcgcgaagtgacttatgggggaagacactctcaaaagtgaaatttgctggtgaataccgcacccaccatgcacccatgatgaggaaggcggcgccggagtatgggtcttccatgatgccatcaggaggcgccgtggtgtcaggaagcagggcaaagaagagcagggcatgggggtgcggggttcggaggtcgtaagcggagacggaacctggagacgccacgaggaggcggcggcggcggttgtttatggtggtgtcgtctacagcggcggcgatcgtcttctgttgctgtcgcgtgctgcgccaccaccacgacggcctctactctgttttcacgtggccactgctccgacttcacgtcggccgccgctcctgcatgtgtgtgccaccgtgccgcgcaccgcgttgccggccgctcgcatcacaccacacagccaccgtgagccgcgtcgtcgctgggctcccgagccacattcagcgcgtcaagggagagagatgagggagagagaggaagagataaggaaataagataggaagacaaagagaaaaaaggggcaatttggtcaagccatgtaaaaaagtgggacacttctcgcctggtcagcacgaaaacaataatttaatgggtttggtgtcctctagcaaataaccatattttcagagtgtgtttccccaaaagtgactccgtgcggtgtcttaccgctaaaaccatgaaattcctatatcctgtagcaaaatttgcctaaaaactatggtcaattgctcagttgaccatgtttcgaattctaactaccagtctaatcctactttttctactttgctaatttgaccccgtttttcaaaatcaaacgtaccatttgaccctatttgcactacactcataggg

SEQ ID NO: 65914 - DNA, 1421 bp, Oryza sativa
atcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttttttttccgcttagatttttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcccttgaccctaggttatgccaaatggttacccatagaagccttctaaaaatattggaaaagtagaactgttctcctccctttctcttttaattaaaccaaactaatggcacatgcacttcataatttttttttaatggttctcattcaaaatttattccagtgttattagtactgtacatctattactgtactaatggctcattttatcagcaaaagttttacaatgttgttttatttaatcttgctgcaataaaataaatttagcatgttgattttataattttctttcatttcttttgaaaccagttattcaaaattacaaaatttgtaacttcgtttccaactgtttcaacttatcctgcaagtttggtttactttatttacttaccttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggattcgggactgcccctttttatgcccagattcctcatgatcgtcatgaagaaaagtgccgagtcaaagtcactttgaacagtaatagtgaagatatcccctcagtgatgtttgaagctggaggaagaaattacatccatgcatgtcaggaggtggcaaggatcgccataggagagctccgtgatcgctacagtgatcaattggccgacactgagtatcgttaccatcctcgtcaaccacagggaagtgaccgtggcagttatcttgagactgaaggaattgagaatgatgctaccacaaggcatttggttgagatgctgtgggctatggatgaaagtcgtgcggagactgtactagcagctcaagatcgtgaagaccggaatcgtggtaagatttgcaagttagaagacaaggtggatcgtttggagaaggaattagccgcattgaagggagaagcaccgccgcagaagg

SEQ ID NO: 65915 - DNA, 49626 bp, Oryza sativa
  unsure (1)..(49626): unsure at all n locations
ttacttatttgaatatatgatattcactcgattaaaaaatagactattgtataatatcagaaaatataatcatcaccaccactggtgtcttttataatagtatagataccaactaatcatgcatcaattctcatcataattttaattgtctaagtataattgaaatagcattgcaacaaatccgtgcatgtcctaaaacttacttgaccatctagatttcaggtgattaaaagtttaagaaattttagtcgcttttgattgtttctttttccttatatataacaagttgaacaacatatttaaacatataaaaggtacaaaattatatgaaataaatttacaattaaaaaactcatacctgaataaaaataaagtaaagcaatgctactatatataacaacaaaattacaattaaagagaaataaaactacacatggcatactactgcaattttgtacaatctagtttttgtctattttttataattaaatatacatattaaggtttaaccttgtttttttttaaaaaaaatgagacgcctttctttatgtaaagtacgttggcaacaaaccaacttggttaaaaaaaactttgcttcacatcctcatttgcggtttgctttgtaatcataattttgtcagtccttttacataccgaccttgacaaatgtgtaggtatttgaacacacatcttgggaaaaaggattgcaattgtaggatagaagcacgggcaaaccattacgcaactgaatgcccgatgaaaattatgaatgtgctagaagccacttaaattttactcagttagcgcttttaggcttggatttcccgtttaaattttacacctcttggttagttggcttcaccactcatgcgtgcgtacttcttcacaaatggggctacagtcggtgccaatgatacaacatgctcacagatccttcagtttgtgtaggcgtacacttcacagatttggcaccggggctccacattgcctcttttggcccaacgacaaggcctcccccctctcccccacctccatcttcgccattggctagcgaatagcagtgcaaccctagctcgcgcctcgcggctcgcgcgggtggactcatgaactcggcctacgctttacactgggctagaaaacaaacgatacggcaggggatgcccccgccgcggcctaccagctaagcaggcgagccccctcacacacgtagaatccacatatggtgacatgggatccacgtggcggccccccacgtgccctatcgctgggcccactcctcgcagctataagtaccccgtcctctcccactccgcctccacccacctctcaaactctcggagaagcgagcacacacactcactccctgtctcctcctcctcctcctcccttgaggctgttcgtctcgacgagtgcttggctttgtgtttgtggtgtgtgatcatgacgaaccaggacgtggtggtttctgagatgggcatcgcggcaggcgcggcgctgccgggaggaccggccggcccggcgggcggcctcttcgcgtgccgcagcgcggccgcgtcgatgaggcagacgtacctcgacctcgccgcggcggcggtggcggcgcgctccgcgagctgcaccagctgggccgacgccatgcgcgcctcctcccccacccgctcgtcccgctccgcctccgacgtcgacgagttcaccgcctgggtggtgagtgttgtagctagctagctagctctccccttagcttgcttgtcctctccttctcgcggcgtttctcgcgctcggtgcccagcccccggctattgcctttctggagtggtgtctcaacctttctctgtgtttcttggtggttcgaacagaggaagcacccgtcggcgcttagcaagttcgaggagatcgccgccaagtccagggggaagaagatcgtaatgttcatggactacgacggcacgctctctcccatcgtcgccgaccccgacacggcctacatgagcgacgcggtgagccaccaatccatgcatcgtgccgcgatctgttccggccacctctcccatctcttctcttttgctgatgacgctctctttccatggcggtgcgcgcgcgtgcgcagatgagggcggcggtgcgcgaagtcgccaagaccttcccgacggcgatcgtcagcgggcggtgccgcgacaaggtacattgccggagccactcctctcgccgtcccagacaccgtgacactctcgcgcgtgtattctgattcctctttgcccttcaggttcgcaacttcgtcggcctctccgacctctactacgccggcagccatggcatggacatcaagggaccaagctccaacgtatgctcgctgcacctcttcatccaatcatctcctcattcccagctcactctcgctaattaatcttcttcttctcccatgacaatctgcagccggagtctgccctttgccagccagcaagcgagttcctccccatgatcgacgaggtactaacctgcctcgctaatgaggattaattagtagctggacacttgtcgatttgtgattaacccgcactgattactcgagacccatagatattaatggtgatgaaatattcacattttgtcaggtgtacaagacgctggtggaaaagacgaaatctacacctggagccaaggtggagaacaacaagttctgcctgtccgtccacttcagatgtgtagatgaaaaggtaggcaggactcactctatcttgggataccaacacaacagcttcacttaattacactgctttataataacgggcagctgcatcatgtgcggccataatttatccacacccatcgtctcaagtctgaaccattactgctctcttgcagagatggaatgctttgggggagcaggtcaaggccgtgatcaaggaatacccaaagttgaagcttacccaaggaaggaaggtaggcatgcataatcttgttaatctctaatgaacttaccaagtaattacccagaaaatcaaatcagttagagatacctagtgaggatctattttaacgaagattgcaactttgtttttgtcttttttttaggttttggagatcaggccgagcattgagtgggacaagggcaaggctctggagttcttgcttgaatcgctgggtatgtacgaacatctggacattttgtcttttctccaccttctatgagactatgactcttgctatctttttaattaacctgttcgtgtcagcgtcgtcacagtcgctttcgtttcggttttatttcacttgcgttccacaccactgtcgtaaaaaaaatcggctgatgacactttgcccctattcgctgttcctccccaggattcgccaactgcggcgacgtcatgccggtgtacatcggtgacgaccgcaccgacgaggacgccttcaaggtaaacatcacatcagtttaacaagaacacaacataaatgcatgcatctaatcatcactttaccgattaattcatgcttgcctcggtgattccgactggtgtttgttttacacacatgcaattaacttggtcaaaaccttttgcctcgctatgttgaaaccaggtgttgagaaagagaggtcagggcctgggaatcctagtctccaagtgccccaaggacaccaacgcctcctactctctccaggacccaacagaggtaaacccagctcagacaagaacatgtccaaatattttacctttttgtacgtatacacacgagcacagcacgtacagaatatataaaacgtttttgacccgtttctgcaggtgatggagttcttgctcaggctggtggagtggaagcggaagtcgtcgtcgtcgtcgttgatgattcgtccgagagtgtagcggcgacacggtgtagaggccgtaagaaactgaaactaagatggtcaatcatgcgaacatgcgaacataccccaccaacaccacgtactacccccatttttttccgatgatttctgtggttggcctctgcgacggactcgtggtggttacacgctagctgttcgattccgtcccctgtgccgccgaggaaaaggagaccaccaaaaaagaagaaaaaaaaactctcgcttaattagctctcgatcagattccggcatgtttgggcgcgcagcggccggcgccaaagcaagcatggctccaggcatgttggtcactggtggtgttgcagctgcagtctagaacagtaaccatgtctactacccggcaatgtgctactactattactagtagtctactgctgctactgctactacgactacgactactacccttgttattattatttttttggtcccatggacttggaaggcatatgcaaagaaacctgccatcctagacccttaacaaaaagagaaggttctatctccatcgatctgttcatcaccccatgtaaaatgtactactactagctagctagagcaagacttaattcatccgtttgtcgacagttcgtcctcgatctccctctgtaaaatgtaatggagttaattaattaatagcaatggattatttcgcatgtcgtagtacctctccatcgatctgggatgctaactttctttgctctttcgatgatctcatgacgacgaagatatactgtgatgtgagcatgcatgagcaccgggaaacaaaaggaggccaggtggctagctaacaccgtacacatacaacacctcgcgggaagcatgtgaacggcttgctgcaggatctccctgcatgatcacctgcagggttcttgcgtgcagtgacaaactagctagctagctccaacaagatcgcagggcattgtttacaggattaaccaggtcgctctgattcctgtcgagcagccgtgattaacgggtacatctcgcgtgtacgaacgtgtgatatatattaaacgggggagggttctgaattgcttttcagcctgtgctgtactatggaaacagcttattaagacggagacgtgtgtatcagagatctacacatgtacacctatattactaacccaatagctcgatcatgttgatgattccttgatcagagacacacgataggctggctcttccaaccatgcatgctgtggtcctgcctcgctgctcgtcaatgtgtgcaatatgcaatgtattctatatgtgctgcatctttgaatattggtgtaagttcttgatatgatcagatttgccggtaaaaagtagagcggaattaagcacaacctaattaacaatctctgtgccttgtggccttaattaggccgcaactccctcttaagacgactcattaatataagtatagccaattgttaatcatcggtagatgtatagtaccactactatatatacatgcattaagtgagtgaagcctctcccccctgccagatgattcctcacaatgattcgatgcatattctcatgtgattgcatggccatagtacagttctagagcactagctcatgttcttctgctggaaaagccagtgctacttaaaatgttcatctttatcagaaatcattcatatgtggaagcaagcctctgccaagattgagctagctagctgactgtttgggaccaccaaagttgcaattatctttgatgtgtccttccagtgaccaattgatcatcctaccacttttttcccagacgcaaagcaggtttcctaagacatgaaaatgagtaactgctgctggaaatgaaagcattgccgatccaatcacgcacacaataatgcgcccttgtgtgtgctggatttagtaggtccttgcccctgtttgtcctgcatgcccagtatataccaatgtgcactgtactgcagacaccatagcacaggaactcgcaagctagctaggccattggtggttacatattctgatgcaatttatgattgggattcagtggtacatctgatactagaaaacatccgccaaccgaaacaactttaatttgaatactgctaacctagcttatcaatcgccatcaagctgcgagccccgcatttcactgctccaaccaaccagaagcacccatgcacacacatcctcctcacagctgcagcgatccatcgtcctctgatctgcagtcgtctctcagatggccacgcaaggtagggttttgttggaccccttggtcctatgaaaggtggcatgtatgcgatgcgttttacgggctcagagtggcctcatcattcgtactttatgcctttttggcaccagcaaccaaacccctcttcttggggctcaactcatcatccaagtgttatttgctgcaatcaagagccgataaaatgcatgcgtatctctgcagcaaacgacggcgcgtgagttgatgaagctgttgcgttgcaacatccgtcgatgtggatatatatatacccaggtggtgattttgtgccataccatagggtctttatcattgttactgctgcagtgtcaccatcttaactgctcctatatattatctctctctcggctggtagcgatcgaaactttcagtacgtgttatatgtcttctgtcccttgctgtagaagcaaaagattgcagttttgctagctggcagtctatactaggagtcctaaaaatgtagtaattaacagaagaaaattaacaagcagctggtctcggaatcctttcttgcgtggatagatatatgatatgatccaaacaggcatactacactcgatcactagctaattatccctgcattgtttcctataagttttagctacactaacccaagccaacatggaattattaattaaagccggcgcggctttgagcgcgcgcgcgcgcgcacaagcgtacagtcactgatcgtggtactgattatagaattggcccctaatctggcattgagatccccaaattaaccaagccagcgattaaagaagaggttaaaaaggatcagggcaataaaataggcgatgcaaccattatagggtgcagcgaaataatgcttgtttatacagatccaagctgctttgcgtggatattttacgccaaaggcctcgtagaaagctggctgcccttgaatcaagtgacaatggcgagccagacccccacaagccccacatggctcccaggtggagagatctatccggtatccactattcacctaaacaatctagaactcttcacaagatgcatatataatttttacatgcctcaatgtggcacactcctgttacatgtactagtgctactattattgagtttgttactggtagaagattatattagcatggagtgcttcacatttccagaggtttatcactagttctgttagcgaataaaaaggtcagaaggatcagacacacagcaggtgaagtgagtgagagagaaaggggcattttttgtttgagagatactgctgctgctaatgctttttttaggtagatcaaaaggaaaggggtgactggtgatcgaggcacaaattatgtgtaaaggaatctgatggttgagaagggagttggaatccactaaagccatggtgctttttattctgcagcaccacctgcagtgcagtgcaggggtattgaggtattggtacacaggcaagtgtccagaaaaggctttgacatttgacaagtgcccccctttcctatgtggaaaggtgttgagtccactgtgttttagctcatgattggtgcctaagccaccgtataaaataactaaccctagatgaccctcattattggtgcctggtggtggttgggttgggtaagtaattgggttttgatcagttgagcttgggtctctgtctccgatcgagtcacatcctgagagaggagccactcctgctagtgccgccttcaacacgagcccatgcaaagtgcgaccaaacaatgcagggcagccagccagcacaactcccgagaatctaatgcctgcccaatcatggacctaatctagctagccaggtgttaggagaggaacaactgtcaaaatgcccttcatgcctgcatctgcatgccaattccagatcttttatctgcccatacccatgcgcatgggccttctgcatgcatatgccctctgagtttactactactactagcttgctccaaaagcattgccccaggactaaagatggtcgatcgatcgatcacacaaactcatccctactgtatcttattcctgcctgatccgtaggcagcctgtagcagctagcgtcgcatagatcaaatcttccatgtacaaattatatatgtactctatctagctagctatactaccctgcaggacggtggaaagtggaattatagttaccaattcgtgcagctagcgattgggatttgacgtgttgacgagaactgttcggctttggcgtgccggccagctttagcgaccagtagacccggggggcctcgtcccgccggcgtcagatgtgtcgcgcgctcgtcgctcgatctcctcctgtggctgcgggctcgcccacggggcgccctaggcgggggctttttccgcggaaaagaggcgcgtatgcttccatccgtgatccgtccatcaggtcacactaggctatccccatcgcgaccgcgaccccggccgcgcggcatgggggccatatacgcgtgtcgccgcctcggccgtgccggctgcgggtggacacgcgcgcgcggagacgacggacgacgagctaggcattacggcttgcgcgcgagggccgcggtcttgcagggaggggcgcgcgccgcacgaggccgcggtttcggtgtaggagttggcggtgtttgttttgtttactgacccggggcggtcactacaggtggcggcggcatgcgcgcgcgcgtgcacgcacggccgatcaatctgcctcgcaggcacgcatcgtaccgggccagcgcgcgtgagatcgatgggcgtgtgtgaccgtacccgtgcgggggtttgtttatgcgtgggcggataagtttagcgtagcatctcaggggggatcgatcgatcaacgtgcatgcgcgtgcgtgtacgtgttggttttcaatacgtggagtgctatgtgcttccaaaagtttagccatctgtatattaacttatacagtaccgtacttgattctaagggtgacttaaagaggcatgtactacatactccctcctttcttaaatgttggacgtcgttgacttttttaaacatatttgaccattcgtcttattaaaaaaatttaaaaaaatgtgtaaaactatatgtatacataaaagtatatttaacaataaatcaaatgatagaaaaagaattaataattacttaaatttttcaaataagatgaacggtcaaacatttttaaaaaagtcaacggtgtcaaacattttgggatggagggagtatgtaatagtaatatgcgttttactacctcaaaatgcatgcaaggatatgcttggatgggtaatgttatctattataagatccaagcgcgcgaatgagtcgtgtactacgctatatgtttacacccgagtcctaattaaactagctatcgtatcgtgccatccctagttgttggcgtcctatttgtcaggaaatatgaatcggatctcgtgtacagtcgtgtccaccttttcccattaatgaagatcatgtgtggtggttcaagtagtattgtttttgcacgcacgtagttacacgtagcgattgtctgaccatgccgaatgtatggtaacattgtaacatgttcgttaattatcatattaaggcctggccttcattggttgactagccagcaataggaacaaatggatgtactaaagtgctataatgtaacgcagttgtactagtcctcaagcatacaactgcagatcaaggaaatgacaacactagtaattaactagcttaacactgacgtttcttttatttcttaaaacttgtgataagacatgaagagcatgaagtacttgatgtcaaactcaaatttattctctctatataattaattattaaactgccaaaatgtccaatcgagtagcaaccaattaggatttcatcgatctggagtatccagctgactgcacacgctgcgaaataaatatgcataagtctcatcttcttatgtttcttttttcataaaaaaaatgctacttctagttaagttctgattggcactcacgaccagctagctcaaactaaactaatgaagcttaatttgattgattaaacaaagatcgatcgaacattgcctccttccggagttgttaaaccgtcgcttcagttgagagtcccactttcagtctttcagagtgacggttgttgcatcttcacttcacatacattattccttcgcatgtccttttaatttctggtcctggagcatcgacgatgaatgtgacagaagaaaacagaatatatatcataagatactgtacttatatgtatagtactatactgcacacataaagaaactgagaagtgaaaaaatgcagtgtaatgggccaatgactgcgatatgatcgataatgacgccactaaagaataagatcgccgagaacatcatcgtgttgctgactgtacttgacatcaactcttgtccttctcggcgcctcggcggcgagtcaactgtccgacctggcgccgcctgtgaaatatctccgtcgtccaaccatcagtgacccggtcgtgaaagttttttgcaggcccactgcccaaccgaatcactatagagaaaagtgtgtagtactactaataattaccagttgttttatcaaaaaaaaaaaccagttgctggtatgtggaattttattagtacggcttaactagtgtaatagtcaccgtcaagattgtcaggttggcgtgcagccacacgcacatgcatcaattgtggcacgtgtgggttttacaggcaagcagtaaggtgaagaacgtggttggacatggaatgacttaatcatttttttaggagcgttttttctttaaaaaaaggttagagcatattaatattgtagctgttggataaggcatgtttggttgagtattatggatgtacagtcttttagagaaaaatgactgttttggtttgatgccaaaacttaccctaccaaataattggcaatttaaatagtactttgtagatgtttggattgattccaatatttgcaatagctaatacaactcatatagtccaactctaccaaaatattggtagtgccaaaatatacctaagatttggtactgtcaatggtttggtagtggtagggcatcaaactaaatgagtccaaaaaatattttgggatggattagcagcccagccaattgcaaagaatttggcccatatgtgatattcagctttgggtctaaattgtagtagcagtatttggcccatatgtggttttgcagctttgggagtttgggcccaaattgttgctcaggtccactaggccactagcaaaacccaacgaacgaacggcatgcggctcgagacgaacacggagatgagtttgtcgcttctgcaaggctactcctccgccgaggaagacgacccagccgccgccggcgccggcgctggcgagctgagcgactccggcgactcctccgctgaggacgccggatcagacggcgaggaggcttccgctgctccgaggccagccgcgaagccccgcccccgcccaaaccctagccgcggggatgctggcggcggcggcggggacggctcattgctgccctcagcactggatgccttcgcggagatatcgggcccgccggagttcctgaacaatagagtcgccgagcccgaggaggccgtggaggcgctcggagtgctcgaccgccgcggcaagggcgggaggggaagtgacagcaagcagccgcctcctggtgagccttctcagctaattgaagcgagtattgatgttctctcagaagtttattaatgagtagtgttttttagactcgatttgacatctgcagtactagaatgagccctctatttcgtcccttttggcaaagcaattatcaacgtaggttcaaatctgacattctcggaaatcagaatagtagattacactttgtggattgaatgatactatcacctatacttggtgtggtgatcttcctttgatgtatagatattttgattacagtgtgtctgtgttggataaaagttctactagagtcaatcgcttcaattctagaaagaattgcaatgtgctggttgagattttggtccaaaaatgggtaatatgcagtggtgttggagggccttggcccttgggttgttcatactgctcagtgctttgattgatgtgtgcctagtctttcgtgttagatgtctatacagatactagggaatgcgctcgcatggaatcaagatcttggcacaattgggatgcctgccaagttccaattgagggggtgcagcgcaaaagaagggaacattttttagccaggctttctttgacatggtagctccaattggcacccctgatacatgtaggacagttagaaattggatcttacattcgcatagcaaaataaggggataaattcattcatgttatgcgttcaatggttgattttttttccaaaagtaccgtacttcacgttttgcatgaaagtactgtcaaagtgcagcatgtccaaaaaaaaagttcccatcactgatgactgtttatagaatgggctctgttcttacaactgctttgaatcggattggcagtttatattttgcaaattattgatatgcttgggcacaaggtacatggtaaatcggatctgatcactgtatgcgcttctatgtgcttagtattagcgtgtcaagtttctgcgatagcacttatactgtttccagttcatgttacatctaagagtgatctgactgaaagccttctccaggtgccgttgtggtcgcaaaacctcaattggttgcaattcgtgaacgagttagcagtggaacaaatggtgccaaccctccagtttctactgaaggaaagagaataataggtgcggcaaatcctggtccagaagatgctgctgatcttctaaggttggtcatttttatcaatactacaacaagataacttgaaaacttagctgaattcgttatattcctggttaattatttactgctcttaaaactgtgtttcttttcaatctgtagaatgtgcctccaatgtggtataccaaagacctattcacacgcacgaggtatggtgtgtcctgtttgcaacgatagaccagagcaggcaagagagccagaaaagaagaaaggatcgaccgtcaaagacaaggagaagatcaaaaggatgagggggcaatcatcacacgcttcgtggaagagtgaaactgagatggccctgcggcaacaatttgactgattactaactagtgccacctcctatacttggtgtcatgtgttatgtacactgcgaatacttatgtaatcctatcttcatcaaaatcccgtagaactgcctccaagagtcatagtcggttcccgattgtgtttgctgtattttcagttttccaccatgaatatggatttgctcgataagctgagaaatggttccttgcaaaattccgtcgaagccaaagtttgagccaattgtatgatcatttactccctctatcccaatatgtagcaagttttaagcttgtgcacaagtattaagtaaagtagaaaaaagaccatactaccctcaatgattattcctgtactaaaactcagtggtggcggtttgtttgctgccatcaaactcacacgtgcatttcaaacgcattggcgccagaaagctggtaaaacacagtaaaaatccactcacacgcaaatcaaattttaaactggtagacggcaaaagcacatacggcaatataaactagtactccattattttcttctctttcactgataactatgctgaggggtagaattggtagatttattttcttctctttcactgataactatgctgaggggtagaattggtagatttgtggtaagagttgtactaggttgtaacatttgggacaaattttgaatgccaaaacttattatatattgggacagagggtgtatttttcctcttgcaaattgttcctcagacaagactggaagtggcaatcctaatgttgggtcaggactcatgagtgcctgatgctgtaggactgatgcggcatcagaattcttcgacgcaaggaatgaaatgggttggttgggacttgggacttgtatttcgtctccaaggctcgtccatcgtactgtacggacagttttaaattttactatctataagcagggatagtcatgtggtgtaacatggccaacgtgcaatcggtccaaggagatagacgcgaccgtaccaagcagtaagcagatccctccgtctaccattattattcgtcctctactttctcggatccctccgtttcgtgcctggttgccagtaacgttatccggctcatccaacctgtttttcactgccatcctggagcctctactggttcattttgcagttttgctgtgaaaccaaaaacagcgttaatagtgaaacttctgggagaaagacaaacagttgccgccagatgtatgaagcaggtggagtagccatggcatatggcccatggggcctatccagcatgattttctcgttagaataatgcgcgttcatgtccgatcgagacgaatgcggccgaagaaattttccgcaccatcaacactgtgacagcgaggcccccaccgccacgagcccacgactcatcaactgcttccatttttatactgatccacatccactccccccgatctccgcagctcacacaccgaaacaacacacatcgccactagctccctcgatccgattcggatcggatccatggctaacctcgccgcctccctcctcttcctcctcgccgtcgcgtcgtccgccaccgtgccagcgcatgggcgccgcgacctcctcccgactcgcatcaaggtacgtcggccttggatctctggcacctcgtcatcgatcgtttaatttctccttgcggcttcgcagctggtgaggggagccgacgccggcgccggcgccgtggccggcggggacaagatggagtgcgtgtacacggtgtacatccggacggggtcgatctggaaggccgggacggacgcgaacatcacgctggagcttgccggcgcggacggcaacggggtggggatcacggacctgccgtcgtggggcggcctgatgggggagggccactcctacttcgagcgcggcaacctcgacatcttcagcggccgcggcccgtgcatggccgcgccgccgtgctggatgcgggtggcgtccgacggcaccggcccgcaccacggatggtactgcaactacgtcgaggtcaccgtcacgggcgcgcacaaggggtgcgcgcagcagctgttcaccgtcgagcagtggctggccaccgacgccgcgccctacaagctcgaggccatccgcgacaaatgctccgccgcaggagcgggcgccgccgcggcgtgagcgagtgacgcggccacgccgtgggaaataagctcgtacgttatctgtggtgagtggcatctgtagactgtgggggggtgttcatgttttgatttgtaaagatggtaatccgcgtgcgttatcatgtacggtggatgctacagactatccgactaataactttgcgagtcgccggtgatgaaccggcgttgtgtttcctcggttacgcatcgtcgtgccgcctcgtcatacagaacaaaatggaggaaaaatcgcctaagacagcaacgtaaagtgaaataaatccagctcaatgacaacaatggaaaactaaataattaatcggtattgctaaaaatatgtcgccacaaattatgatggatttcagtcggttgtttcaaccatcagatgcggatgcagaaatcaccgcatgtgtacgcatatccctccgattctgttttaacgttatttgctaatcaggattactaattaatcttaaaaactaaatatctgtgtcattgcaaatttatagttttgtgacttacatcaacttacatatgtaattttaggacttacatatgtaattttaggacttacatatgtaattttggaatttacattgtaaatacactaaaattacatacgcaatttagggacttacaatgtaaatacatgccgaccatttttttgatgaaaaatatggtgccataaatatagctactccctaattaattaatgcgccataatactatgagatagctttcggattttgcgcctaaagtcataagaaatctgggatatcattagcgatggatcgacgacttgctgggtatcatcagcaggctggcccatcagctcatggcatgggccagtaatgagcctcccctgaggccctgtggcaggcaagcgcgcgcccaattagcctcgtttgtgaggtccaatttttcggcccatcgttgcgtttgggccagaattttagttcaacgctcgagtgggccccagcctatcaacaagacacagagaagtattaaacttccagatgctcagataactagtaccctcgaataaaaaaaaaggataactactaccctgggagagtttgtttttgagaattcatttttagttcaaaatcctaggtctaaattctattggttcatttgatccatatcattaccaatataccgaattagaaaaataccattaccataccatcgccatcagattttccttccatcttcattctttcctcttcttctcccatggcgatggttcaagagtgaggcatcaagacgatgaagacaggaccatgggtgaccggtcaacgacggggtcccaaatttgctcctggagcaataaagggaactgaggaggaaggaggccaagctacgcatcggtactagagtgttagccctgccgctctaccaccctgaccgcccttgcaacctctccacgctgaccgtgcgtcgccactagaggctatggtattgagcccatctgctggagccaaactcttatcatctcgcccactagagtttgccactctttgtcacgttgcggacctcctcaagccaccgacacaaagttcttctcgtcgagctcctcgcagccagcaccctcatcgagctcctgcactactaacggcctccttgaggcaccgcgctgaagtcttcttctgcctcttcatcactaccgccataaggtggtgccatctcgttctccctagcatgacgattctgctgctactagttaagcttcaacataggaatcggtgaagccgaggaggttgaagaagcgtaggccatacatggaggaaggagaggaatctaacatggataacaaaaaaactagacgataatggaattgttatcgatttgacaaaatttcagtggcacccaatagatatcgcgaatagtaatgatattttttttcgacaaatttgcaaatgatatttatggatcaaattaacccaaattttatcgtactcagatagaaactgacgggaatatgaattctgccgagagacggcctcccttagcgtgccgagcaaagcaacttcgcaataaatcgatggctttgccactgccgccggccggtggagcatgggcctagcgccctagccacccattgccgtcccccataccttgcatccctctcaagtgcatctcccctttcatgattgcaccaaatgttcttaaatttgagctaactcccttttacaatctttacacatcaccgggttcactcatgcacaccaacctctcccagcttatcattggcacacagataaacaatcacggcgacctcattagtattgatcgaaagtgctaatggtacaagagaaccatcattaggtgaattttattatctcaacagaaataattaactaacctagtaacctatatactaccggtgcccatcggattgaaaaataagtccactaatatatgcagtagcgtttagtttgctttgaagtttcatgggcagttcttgtgatgctgcaatgatcaatctctcttctaaataaattctgcgtcgccgcttgacaattattaggtttggcgccaccgcggcagccacacctcttctcgctcgtagagaccgtgacagtcacgaggcactggacctctcatcaagttatggagctgtacacaattcattgcaccacggcacgagttgtagtagtggaaatgcagatatgttcaccatactgcatatcctgtagcattgccattcgccgcagctgtagatgcgagctgacgaacgaactgtgcatgcacgcgcactgcacttaaaacacacaagtattcgatcggcagaaaataaagttcagagcaagaaggtccaggtgccatacctgtatcttgtagtggtacgacaaaagtagtactccctccgttttcatataaaaacgttattaactttcacaaggttatttttaaagtacctttaatgataaaataagttgtgacagagtaaatattatttgcacatttctttaacaagatgataatgatgaaaacatcatataaaaataaaaaaaatcattatatttaaaaacggaggtagtgtcaattcagaattcagattcggtcatgcttgttccagattatccatcaccacggcagatgcagattatgcacgggcgcgttatattttgttcccaaattaaatctagcgaagatcacttctcagttcagtctacagtattcctccgttgtattcctccgttttttaatagatgacacaattaacttttaattaaatacacgattaaccgtttgttttatttttctcgcaaaggcataagatataaattatgcttaaagtatttttagcacaacaaaataaatgatagttacgtaaatttttgagttattttcataaaactacatgcattttaacacgttgtatcactaaactacaaattgaacgctaaagtcatcataaaactacaaatttaaagctaagtatatcaaaactacctatttaatatttaaataataaagaaattgcataatttagagtttaaattcctatcactactattatattggagttataaacgttatagttttgtggttaaattggtgctaaatttatatcaaagtatctatagttaaaattttcttaaatttttttaataagacaaattcaaacctgtatccgaaaattaacggcgtcatctattaaaaagcggatgtattgttgttgacgaaaaaaattgaacaccggcctgggagatctgcttagctcctatgcaggttcaaagattgatgagatgtgggcgtgccagtcagtttgatcctgcaactgacaagatatgcaaatagtagatctaaacagccgatcggctgacaagccgatggagtagttccagccgatagccgataatagccgataccgataccagccgatagcgatagggtttaagcaatcggctatatgtccaatgtggataatgatataaaggcaatcggctgatgataatataatatagcaatataatccagtagaaaccaatcggctaacaatatgaaatagtagaacaaatattgatccgaaggttaaagcacacatcggctggaggtccgatgtcataagatccacaagattagattaaacagtgaaacctttgttgccatcggctaaatccaacttatatgtatatacaatccctacaagccgatgcaacgtccagataacttatcggctagcaccccgataaaacattagcatgaacctatcggcttaacaagacttatattatcaacaacaatctagtagatcgaacctaaccgatgcagcacgagattgtatatgataatctaatactcgatgagccgatagatctatctaatgtgatggatataacaaatctatttagaacagcattatgattgtagagatatatcggctaagacaggagatcagacctaaccgagacagtcccaactaaaccgatgcgtctctaaacacaatgcaattagagatagaattgagatatcaggtaggcaaatatatcaaccaaaccagagcgatccaagagatcgaatcgatgcagccttgaacaacaccaacgtagccgatagattcaccaggacccgacagaacgtaggacttaccccttcgctggagatcgaaagccgatgcagccttgcgtcaggtgcccaagttccgccgaaagataagtaaaaacctcagggaagagggtggcgatgcgccgagagtattatcgatcgatagattgatagattacaatgaccccgggtgtacatatttatacccatagggagatactagtccttatcggacaagaaagaaactaaaaaggaaaagataaagtccttatcggacactaaacacactttcctaaagataaaaggaaactaacaaactatgcctaattaatagataactgtcatgtcgcatccttcttgaactcgaactcttctagataagcttcctttgattgatccgactccaccaagaacacgacatcgtggcgacttctcccatcggctgattctagaactttgaagccgatactgactctaaaccgatggtaattttgggattaccaaatttcactgttaacaattgtcaaatagtttctttggttttagttcagattatacattttttccctacattaagtgaaattagcggctcgccggttcgtttaaaaaaataccgtataatctgtatcaccgtatatagtccagcatagcattaataagttaatccgcgtacttcgggagtatggcagtacttgcttgcatgctacgacgccgggttcttcagttcagaggaagattagtagcggcagtggtacaaaaactgggctcctcttgcagtagacagtggacggacagaaataaatttggtgccgtgcaacgtacacgacatacacacatacccttgtcctcctgctcctgattggatcggtagaaaggtggcggatgctggattataataaaaaccctgtagattacacccataataaaatggtcaaggaccacgacaccacataaagacacccatccccgtgatcaactacctcaattagcctcccaagatccccctataatttaccataatttattcaaacagctggtacctctcctccgggttaataatacttatcgttttagacaaggacacgatataaaaaaaactttaaccattatttttcattataatatatatagaagtgttaacaaatatatgattttattaaattactttttaaaactaatctatacaggtagtcaccatatttaatagacaaatattttaaaatcaattcataatcaaagattctcaagtttgacatcacctttatctaaaataacaactattaccagcaccgaaggataatactaatttgaacatattcaccctactacaaatcttaataaaatctgaacaatggcctattggagttatagtactataatatatcattttccttagtagggccgagtttggttctaaatttttttttcgaactttcaatttttctatcacattaaaacttttcaacacacacaaacttccaacattttcatcatatcgttttaatttcaaccaaactttcaattttaatgtgaactaaacacaccctaggttactgtattttggcactgaggcggcacacatctacaagggaacgcacgaatctcaaagcagatgctcaggccgaacgcctccatctctaccgttcactgcgccacgttggtgtcctttttgcatgatggatcgctcgctacgagtttttttcttttttaagcggcagcggcaactggaaggtggaaggctctcctctgcttttaagaccagcgctgagacagatcgagcgatcagtcgaacgaacgagatgaagggaggaagggggagcaatggcgccgccaccgacctgctcgtctgcttcccgtcgcgggcgcacctggcgctgatgccgcccaaggcgatctgcagcccgtcgcggccgtcggcgtcggagccggtcaagcgccggcacagcacgagcaggtccgggccgccgccgccgtcggccgcgctcttcaaggcggcggccagtggtaggaacccgagccgccgcgccgcggacgtccccgtcgacaacgagccgtcgtcgccgaaggtgacgtgcgccggccagatcaaggcacggcggccggcggccaagcccaagatcagcggcgccggcggcggtgccgggggagcgaaggcggccaagaaggcgacgtggctgcaggcgctcggcatcaagaaggacgcgctgccgttcttgaacgccgtgcacggcgccttccgcctcaacgtcgccggctgcttcggtagctttcccggcgccgtggtggagtacacctccggggaggatgacgacgacgaggagctcgcggcggggaaggacacagagcacggggctgcattggccaagtggttcatggtgctcgaggaaggcaagaaggtatcaagcaggaagcgggagcaagagccgcagaagcagcaggaggaggaggagcaggacaagaaggaagcggacgtggcgccgccggcgaacgccctgatgctgatgcgtgccggtcggcgccggctaaggggttgccgaggaggttaggaggagatgcagaggaggaggtgatcaagaactccaagaaggaggaggaagaagaggatgagaaggaggagaggcttgtgctcatgagctacgcccctgacttcttcaaggtatccgtcgacatcgccaaggagacgtggatcgtcggcggcgacgacgccgtcttgcgctgccggagctggaagagatgatcaccacaaggatcgttctgtgagcaacgtatgtgtgttttgttctacttttttgctacatgcttgccttttcttttccttttttttcttccctcggagaattatatattcttctttatataaagctcatgtaaagggttcgatgagcacgcagcagattcttcatttgttctgccaaggccaccacaatggtctctctgcagaaggatttctgctctgtaaatagtgctgtaataaccttttactagatgctagtacacggtgaatagtacttttgtttgtgaaatgtaacgagtaatatatatatgatgagctgtatagctcactttaatttcctactttcctagtggagttaagatacaaccattagcgctttagccttgtatgatagattggaatctctatgatgaacttttcagaatatcttgttttctttttgcaaactgataatcatttgctggagtggttggtttacctctgctcagctcatattagctgtgataaaaaggcatgatcttaatgttgtatttggccacattttttaatggatcagtcacagttcgttagagaaggccatgttgttgaaagaattgtccttgtatgcccagaggcaattgttgccactgttgttatccgacagatgtacaggggaagtagtaggtggattaaaagctggttctagtgtcaactcggatttcttttagcccattttttgtcattccttttgaatcactacttattattaccacatccatttcaaaatataaacatttctatattctttaggaaaactacgttaagagaattcagtggtcaaattttgaattttgagttactcctttccaagcatctcattggttgaaaacgtaaagatttctatgtaatggaatcagtgcctaaaaatgtttattgcggtacaaaatttaaatcctagaaatgtttatattttgaaacatatggagtagttattagtctccgacctctgtataatgtgcaaaattttcggaaagtgctaagagaagttgatttttctaagtttcagagcataactgaaccagctcacctgttacgatctacaaactaaatcttatggagtactttacaattattgagaccaaacttagtgacaaattttccgattgtgttttctgaaaaatcaacggaaggttgaatagcgaacagatgcaagcattttttaattttgaggatttacataaaaaagatcatttagagaaacattgaacttgtaatagaattataattcttcagtagccctgtttactaaagagtttctctagtttttatgaactaaatctgctcgcgggaagtgtacatctagagctcacatttctcatccccggaactagcattagcctgccttaactgctggacattaccaattatgtgttcagctttaacagattctggacaagccgaaaaatgcaaaccattctcaatgccacataacaggttcagaatgaagaaactacaagcaaccatatgttcagacatccagaccattgtgccaaccaaactgataaatgaaagccatgcactacggtgtgcagtactgaagttcagttacatatacgcaccatcaatagtacagtcagtcacacggcacagcatttagcaatgcatgtcctgcaaaattttgtacaggcatccggattccagatatagtttcagcaagagggagccatgctcaaatggatactcactcattttctgtttgggatggatattagttttgtagtacaaagtacaacccagtatgttttttgtgtgaggcaaacttaaatcttcagaaactttcatggttgctatcactgccaacccacattcaaattaactagctatacttctcggtgcagcaagtattatgtacagtttcattactctcaattctcttgtaatttggcgtatagtgcacaaaaaaagaatcatactgacttgacactaacaaaccgcgcaatggtgcgtgctgcattgttttgtccaaagtcttgtcctcttcagatcttgcagttgatttcgggtagccgacagattaaagaagcctacaaggaagaataaacttatatagagatcaacatgccaatgctttgttctaaagaagaagcacaggcgagaatctccctaattttcaaacagcctttttatttctttatctgcgcgtggtaatcaactgctgtccttgacctaaccagttaaaattaaggtagataaagagtactgaaattctttttagagccgacacagtagtgcccaagtactatagggactacgnnatgcagttttggatttgtttctttccagtatgcaagcaatctacacaatgtctcccagaaaagtaccgatgagggcttttttgaaataaaattaaggaattcaagggcatgaaaatatgtcttcactgtccattttacttgatttttgtttgatgaaaaggacctggttttctctacgactgatttatcattttctagaacatatattagcaaatagtacatacttatatttctctttggtgtagtactatggtgaaacctagtaggaaaattattttgacggtatattcgatgaatgtaaacatgaattggtaaggctagctgtggttacatggcgtcactgttgtgatctgcttgcaatgcccccattcctctggctccggagcttggcttcgacctcggacagcgccttcttcatgtcctcgttctccgggagttcttggatcagcacctggtaatctcgcaacgacgcttcccatctctccagctgatcacaaaaacacagacaaaaagttcgttgacaaaaatgagatcgcgcattcatgtcaggtatggcgatgaaaatttccggcacggcggaggcagcgaaccttgacgttgcagtcggccctcctgaggcgcgccttgctgtacgccggccgcatggcgagcgcgccgttgcagtcctcgacggccttctcgtaccgcgcgagcctcgcgtggcacgcggcgcggttgcagagcagcacggcgttgccggtctccctgtcgaggccctcgcagtaggcggcgcacgcctcggcgaacctggacgccttgaagaggtcgttcccgcgcagcctcgccgacgccaccaccttggcccgccggtgcacgttcgcgatctcccggttgctcgggtcgagctggcacgccgtctgcgccgtcgccaccgcgtcctcaaaccttcacacatccagcatgaacacgacggcatcagaatacagccatctcatctctgctgatctccatttgatcgaggaagaggaaaaaaaataaaaaacaacgttgagaacgaacctcccagcagccatgtcgacctgagcacggatcatgaggacgtaggcatgggcgacggtgccgaagaacttggtcgattcgtcgacgccgaaccgcggcgcgccgcccagcacagcgtcggcctcgtcgtgccggctcagcttcaccagggcctcggcttgcaacgccatgaccttccagaaaaaaattccatcgtgacagagacgtatgatcagatcgctgcatttgatcggatgctggtcgtgtcgcgtaaacgttttctttccttttctttttctttttctttcacgtggcgcgagggacgctcacctgtggggcgcagtcggcgccgtcggcgacggcggcctgcgattcctgcagcaccgtgatccagttcctcagcttgcgcgcgtcgccgcacttggcgacgcggctcttgaccgactgtgcgcgcgacacgtccgcgcccgtcgagtcgttcgccgattgcttgaagtggtggattgccttgtcaggttctcctaatctgagcaataacagcaatggctgtgtttagttcacaccaaaattagaagtttggttgaaattggaacgatatgacagaaaaattgaaagtttatgtgtgtaggaaagttttgatgtgatgaaaaagttagaagtttgaagaattattttggaactaaaaacggtgtaagtttactatcgataaaaatcatcgtggtgttgtgtaaacaaaacaatgtcagtactcagtacagagtaggcagtagaaaaatgaagtgtgtgtggacttgttctctgacagatcgcaaaattcaacaagctagtactaagctagtgctgcaatcattctcttcaaaaagaagtgtgagaatgcttgtcgaggaagtgattagctattggaattaccaatcatcaatgtgatcgcaaatggctagagtaatttacggcagaaggtcttgcttgacctgctaaaccaatgatcaaatgatcaaatgttccaaaggagcacatgtatcaaattgtactattgcctaatcacaaacaatgggtaattccatttcttaagggaaaagtttgagatttccaagaaagaatagcagtacccctactcaaccatgaattcatttctttcaaaaaaaaatgaataagtcatcattgacaaagagccaatgctgatgcaaattagccattccattaactaattccccaacatctaaatttggtgcacctattttcggccaaaataattgcctacgaaatattagtgggtaaagttgaacaatcagttgtcgtcttgtcaaaagccatgatcaaatcccttttccaatagaattagatcatgctactataactatggtgctagtcaaatctgatttccaaatcaagtcacgatatgaactgacctaattccagtttttttttactaaagacctaattccagttgatcagtgtccttaagaattcctgtgcaaatactagttaatttcatttcttttgccggattcctaaagatttcaattgcactaatgacattggtgatgaacaatctgaacgcccaaatgcggaatgcgcgtacctgagatacagcccgccgaggcggtggtgcgcgcggccgtacgacgggcgatccggacagcctccctgcagtcgccgacggcctcgatgaggcggccgagcgcggcgagcgcggcggccttgttgctccagtacgccggccgcgttggatccaccatgatggcctggtcgtagagcgccaccgcctccgcgtaatgcccctcccggtactcctcgttgcccatctccttgagcttctcggggtccgtccggtgcgacagcgcgcggcacagctcggacgacgccggcggcgccctcggctccttgacgatgttcccgaggccggagaacgcgtacccgttggtggccttccgctcgttcgccggcttgttggcggggttgcgttccagcgagctccgcgccgacgcgccggggacgccggcattgaggttgccgaggttgcggtggagcatcatgttgccggaggttgcgcgcaccagctgcgtggtgcccttgaccctctggtgatcgaggatcatcttgtcgagctccgctgccatcccggtgtactccgcggccggtgccgccgacgccgcattcctcgccccgccgttcgccgccttcgtcgcgtgtacggccctgtcgcttgccggtgcatgggcacgctgcgcgccgttgttcgtccctgggagcggcttggccgggcggtgcgcgagggacgagtcgtcgtggacgccgccgcccttccggtgcgcctggttcgccggcgcggaggccgccttggcctcggcctcgtgctcgtgctcggcggtggcgggtgggaccccgttgatgcgggcgatggaggacatggagtttgaccggcgtcgccggaacatgccgctgtagatgccgaacatcgcgcagccggacggcggggggagngaattcgttatggtgactggngacgtccgcgnccgcgcgcccgctccggccgttgtgtcgtgccgcgtcgtggcgagcgcgcgcaccgggaggcggggaagggggtcacgacgaggacgagggagcgcgggcgttggctcctggctggcaacgaacggcggggttgcgaggttggggtgggaatatttttggaggagggggatttaaattggggaatatttacatgcacccgcttgtacctgttcagttcatcctgtgggccattttgggcaagttctattatccttcctcttttttgttttgttttgttttgtttttcttcttggagagttggagtagatatggatttcttggaccatggtttggttggggaggcattcatggtgggaactgcttggttgggtcgaatgtcttggagtttattaatgttctactgtgttgatgaagtttgaaccataatttgaatttcttttgttgaaatttgaggcacatgggcaccaacgaaattagtttcttcgggagaatatgctaagacaaaatggggccacttactgtttaccatcataagacaacagaggttgatggaatggcagggtcaagacgattagtagtacgcctctgttttcctctttcgagaatagtacgtctctgtttttaaatatttgataatgttgacttacatgtttagaatggatagaataaaacttaagtgacgaaaacaacaatagagaagaagatcggtgtagtgtaaaaagagtagagaagcatgaggaaggtagaaggcagcggacatgtcgggaggaaaactggtgtgtgacctgaggtttgctgaagtgtggctaagaagaatggtttataattctttcttaaaaaaaaggagaatggtttatagctatagtcgttgcactaatctcaaagcaatcccaggctcaaaaaaaatgtttggtagtaccaagcatgaacatatgtgcaacctcgtgaaattattttactccagtgcctctcaagaaacgcttataagggacgtgggtcaaaaggttggtacaacatggctcgcttcctccgtgcatgtgtagcatgagtttacttgattgttttaactttggttaagagatgcttgctgtccgtcgctctgaaaattgggtgttaggcgtgagaagagaagagaggaatagagaaaattgagaaaatatgtaaaacgagataagctactagcgcgtaattaatttaatattaattattttaaacttaaaatatagattaatatttttttaaagcatttttttataaatagtttttttcaaaaaatatcatttagcagcttgggaagcgtgcgtgtgaaatacgatgttctttttttctcccttttcaactctcaaacagcatcagcttgtcaactatcaggcaaattctgatcagaagacagataacacaacagctatgcctgatccttttatttttcactactactactaaaaaacaaaaacttggggcggttgactcctgaccaccactaacctgttggatcgctggaaaatgttggaccagatcaaaccacgcaggcacgacttagctagcaatctggacttgggtttgtgttggccatttttgtgctccactattatgtgcacgtacgcaccgtcaccgacgacgtgaatcgtgatcgatcgatctgctccaaaacgtgttcgacgtgctaaacatggatagcacatcactaataatagcgtattgcgcgttagttggcaaagcagctagcaggtctcccatcgttctgggaatttggggtcactgtattttagaccaaaaagttaagcagcacaggcacgaacaaatctttctgtggtcagcgtcgtttctcgcatcattgcatggtgtgacggcagattgttatgatatcataaaagtataaaaccgttgccgcgtagcatcatcggatttcagtatttcagactgatatatgaatagtggttcgttagagctaacaaccctggtgtttgtggctgatgccgattaccgacaatacaatactggccgttgacaaccggttgatcattattataaacctattcatggtttgctgctactgtcaattgcaatttgcaaccgagcgttgaagagcatgtgaacgttggatcagtatgtgccatgaaattaagtatagttaagcaatcactaaggccacattcctgatctcccctgtcagtttcctgaaactaactctgcagcaggagttaagcgcgatcgaaaagcgtttccatgtaagaaatgccaaaacactcctgtctcggaagaattggtcgtctctctgtcgtacggagtaatgcctaggagacgtccaaatcaaaagccgatggcatgtctaaatcgcactacgagatcgaaaccgccctattctcaactcaagcgcaactaccgtttcaatacagtgatgagcagcatgggacagcgatgcgcatgggcttaccggaccatccaatagttactgtcctttatactcacagaataagtctattttactcccctcaactcatttccttgaatcacatcccttgattgcaaaatcgggtataacccatcctctaactccaaaaaccattgcaatcgactcccagggtggtttcggaggcagtttcatccgatgtggcaattgacttgttgcgtcatcaaatcggacccacttatcagtggcctccaactcatcctcacattccccctgacccctccatctttcatctattcctcttctctcaccttatcagggttattgataccacatatctaatagtaattgattaagctcggtgaggcccatcatataccaagtcttatacgaaatcatagctcgtatatagaatgagttccagataaggaaggacgagtagagttctatatgaaaactataatgactattcgaattgtatccatattggtctctctagttctacttggacaaagggacatctatgggtataaatacaataccccctaggaggaggggagacagaccaacaagacacaacagattgacacactaagccaggacaaaccaatacgccaccagacatcgacatcagagataagcctagacagacctcatccagtgcctgtggaggccgacaaagaggaatctagtgctatctctgatctcgacgagttcatattcgaggaggaagactaccctgtcatcgactacgtgttggtgttcgtgccaccatgtcgacgatagttatataggttatcccaaatattgtacttgtgtaattcagatgaataaagagcaacaccggctttggccaacatgagtatggctattacctgtcagataaggggccctaacatgtataaaaacccttgtctctatctcttttaactcaatctcggtaccaacgatccccataccatgcaaatacagtagtcgtgacctcaaacgtcgacacaccttccatcaatagaggtagcgcagcggtgacggcgcactagggaggagctcgccagctggccaacagcgctgcacgagttggaggagcttgccgatcgtcacgctagttggaccggcaaccttcttcagttggattggtcggcttgctcatcccacttctcggcatccaacttcatccacgcgctgcttgagtactctaggacccatgttgcacgcgctactctccgagacccacgttggcagcaagaccggggaggggggaggggaggctcgtgctctgtcccgtcgccgcctcctccatccacagttgcttgccgccatccatttgagagagagaggggggtaaagaggaaggagaaagggtaactgataggtgggcctgatatttatttttattgttttaccactgacatgtggatcctatttagatttgttttcattttagtgccacataagcgccacgttgatgtcacatggggtgaaggtcaagttaacccgctacgtaagtgtcatgtaggatgaaactgctattaaaaccaccgagggactctacttgtaccggtttttgaaattgagggagacgttatacccggttctgtggttgagggatgcaattcacctaagggcaagatatgagggaggtcaatagacttattccctttacttactcattccctgcctcactgggccttaccttttggaccttccaggccatatatggttgggccgaaaagggattacgtgaggcccgtatttggattcccccacatatggttgggccaaaactggattgtcatgtcatgtgcgtttacgtagtggaagttgggccagaataggactgtgacgtatgtgcggcccatattagtcgagaaacgaggttacggttgcgtacggctcaaaattatgtgatggagcaggatcccgttctactacgtaccaatatacttgtcttcagaaaaaataataaaatcatactagcatatactaatggattgtgccttgtgggtctctctgctttgattgcaaccagctcgccatgccgactcacttcatcatggctaatccttatccattgtttgatataaagcggatttttttttcgagacagagatagagcggtttgatttcataataaatcaatgagttttctttgtttattagcgagcacttagctcagtgataaagccatgcccgctccagcctgcagctggccgacacatcggtgcctcctttttatcagaagatactgtcgcattcgcacgtgcatgacttctctgtgttaactgctaatacgtggagtacgtcagtaaaataccgcctccaaaattgtaccagcaggtagtagctttttaaggcctgttcattttgatgtcattttcaaccttaccaaattttggtaaagttattaaaaaaagtggctacatttagtttgctgtcaaattttgataactatataagaaattctgtaaaaaattttggtaagtatgctaatttttggtaaggttttttttgacattaaagtgaacatgtcctaagtgtgtgcaggtatgcggtaattgattaattatccccatgcttaatcaacaggccgagagttcaactacgttgacgccacgatagcaagtcacgaacgcactgaatgacgcgtgtcgtactagttagcacatatattcctggtctatctcactgtatgacatcgtatacatggttacgttacacattgacggtatgtacacaccatctcccttggcagctaattagaagtcgtcagtcaagctagctaagctaagctagcgcgtgcgtctggatgataatattgcccacacgattcttccatgcgtcgacgttatgggaactgtatgcttgctagatcgatactgctgtactctcgtctgaactgagtttcagctacgtgatacatcgaccatcgtgaccgagaaattattggcgtacgtgagcttgaccacgggatttcagttgggaatccactagcagcgtggtcacacgagagggcagcatccgcaaaccgcaaatcatatgaactacctgtcatcgagttcatatctagaaagaaatggccaatggaactatatcaagtgcaacaaaaaggtttgctttactcgtgaacagaagttaatctaccgcgaaaagcaagatgtgttgcatgcagaggcagagcagagaagagagagtccgtcctacttgacctgccggaaaaagcttagcgatcgcaatgccatttcacaacgctcctcaactgtttgatctgccccccactggcttgtagaacaccctccttgttttaactgacgatcacttcacgagcacgagcacaggaagaactaagataaggatcaactcgccatgtactaatgtacagattaattactaatcgaagtcaaaacaacccaactcgattgttcgatacactaccgtctgattaaacatttaggttccgttctattctacaacgatagttggatgaaaataaaaattttcgtgacatgcttttcaaactgctaaacggtgtgtttcgtgggaaaactttctatatgaaagttgctctaaaatatcatattaatctattttttaagtttataataattaaaactcaattaattatacgttaataccatcttattttgcgtaaaaaattaatctttatctttatctttatatttatctttaggagaaaaaacatcactttatgtgtctgcttggcccaaaagatcgtctgcctggagaatatactaccgggataatcaccgaagaggtaaaagaatttagacccaggcggtaaattccagctaagtatatataagtagccatcaaacgcagctattccactggcaaacctacacacactattgagcctctgtcacgagaagccaatgtactcgtgcgaccacgaatgcacggcgccaacgcacaccgcgttcggcgccaagtaccagccgtgcatcggtgtctcggggcgccctgaccatcacgccgtcgggaggctgcagcagccggctggcaaggccgccgccgccgccgtcgtttccgcggccgcgcagcctcagcgcgccgccaagaagaggcatgcggcggcgccgccgccgcgcccgtcggcgtcgacgtcgcgccgctcgtcgaccaccgtggtggcgaccgacgtgtccagcttccgctccatggtgcaggagctcaccggcttcccggcggccgccatcttccggccgctgcctcgtaggatccccgtccacgcggtcaacccgtcgcccgcggtgcgtgggtacggtggtggcgcgcttcaggggcacggttcggacacggcgactgctgccggcagcagcagcagcagcaacccgggcgtctcgaccgtgcagctgatgcagtgctcgccgcccggcgtgttcgatgggctgccggaccttgggtcgccggagttcgactcgtggctcgatttgtccgacgagtaacctctccttgtcggactggtcaatggaagccaatacaatactgtagtaaaggtttggtaattggcagtacagtactttctttctgcgcatgcatctcttaaggttagtgtgttataacatccttgaaaaaaatgatggcgtttgtactcaagctttcccaaatttgcagaaatatgcgttaatacactcatgtaatctcaattcttggttggcttttttggacttcgttacttacaagattggttgaaattagtctagcaattctgtcggatgttcttctttcagagagaaaaaaaaagctgtcagatgttcaactacttcttggaattgacctgtctgttaatattgtctgtcttaatcggttgttgacatgagccggcctaatggcatacaagcaccagtatacaccgtcacgagtgacaacattgcgcggacatacgaaaaacggaaggtaaaagatcgccgctgacatgctcaaagaaattaattcatgtactgtaaacaggaagagtacaagagcctgataagttcgtggaagaggtttcagcgtacaagtaacaactgtcatgtactcactactgcaggttgccaccttctgataatctcctgaagtcaagtcctgatacacacgaaccatgtaagagccatgcgtagcaagttactacactgtgacaagtcttggtcactcgtgaaaattgacagccgatccaatctacgccgcaaaagtgccatagtattgagttgaatataccatgagattctcatgggagtatccgacaaaacatgtttagccttaagaacaattaagtttccacgattctatggtctcctatgtctgtaaccatcctctgctaactcatggcaccctattcccgaacgatgtaactgggctttttttttaaaaaccctattcccgaacgatgtaactggggttttttttttttgaaaactacctgaattccccacgcaacaataacgcttgataatgaaccaatactccaatagtatctgaagcagctcagatgacaaaccagtatgcaggacagattttattatatgagcactgctatgcagactagctcacttgtatcattcagaaacaacaaaatagaacacagttctatgcagatcttattttccgatcaaacaaggaggatcagacagacgagatggagcagatatacacctcactctgctccaaggagggcaaggagtatatcctcgtagtctctggttgtatctttagcaacagctcgctccaatgggacactgtttctcttctggtaggcctcctttatcagcttcaggtctacctcggcacgagttgttatgatccttgtaagagagttctcgtctgtgcccattcctcctagagccaatcgaatgactttctcaaagtatctgtcagggcaagtgaagcatcttatgatcgcccttagtgtaccaaggaactcgtccttaggatcagctttaagatcctgtcagtgtgccagaatgtgttagaagagtttcagacaaggacaggtcggcaaacgacattatggaccactagcaatgtgtaataatttcagttcctaaaataccatgttcagtgcaaacaatggcatgttactgaatgaaacatttcaatacaatgcatgttatcattcagcttagtgattggacaaggaatggtaagtaaaatgtttttcaacgggaaaaaaaacggttatcaatgctattattaccttagtgattggatggccgaactgatcattgtaactattgaatgttgctagtaactgtgctttgctccttgtggtgagaatcctgatgatttcatcgtcactgtaagccttgtcatggatcttctcatggagtattttggcttcagaatgtgccaacgatgtgttcacctctggcccatcatagcgatatacagtcacaagtggcaccaaaagctgcaagaaagaaataaaaataattcattttggtaacaagggtgttctttttttagcattgacgtatgcaatttagtagtatgtcacaaattttaaagcacaataataaaatggtccagtcaacgtaaactgaggagatggtcacattctagtatacagaccagggtaactgaagtgatatcatctcacacagctagtaactgcattatcttctcagatatgatcatctaagaactacgttaccatttatcaatgcccacacaaaatacaaataaaaaaagtggaattgcagtatactagagttaaattgaagagatgatttagatccttagcaaaacaattcatcttcaatattgagttatccactatacactacatactaatcatgagaacaaggagatcaagaagtaaacatctcgcataagtctattgtcatgataaacatctcgtatatccctgagaagcatagcagcaagtgtaaaattcatggtttctgtgattatgacagagatatcgatctatcaaaatttcaagaactccgtggtagatgatagattcaggatcatcaccttacggtagtcgccggtgatgtgcgccgcgacgtcctcctcgagcgacctcttgaagcgctcgtggtacgcctgcttcgcagcgaagagctgcgatggagtgcgcgtgcacgcgatctcgacgagcgcgcggccccccgggtgccacttcctcgcctcctcgttcgccagcaccgcgtcccgctccgccgggtccagcgtccactggatcaccgccctctgacaaaatcccaacccccacacgaatcaaatcagacagatagcgacggagctaaaggggggagccgattaatccgcacaagctagatcggggacctcgaatttgccgtggatctcgtcgttgagggcgcggagcagctcctcgccgtacgcctcggcgtaggcgcggcggatcgcccggcgctgcgccgcgtcgcggtgggcgaggatggagatgatgagcttctcgttcgtgccccaccctgcgggaccaccagtaaagcagatcgcgtcagcacccggtccggcctcgcgccggccggcggaggattaaggcgaggacggcggagcgcgcgcctgacctttgaacgccttgcgcagctgctcgcagtcctcggcgacgggcggcacggcggcgggcacggtgagcgtcgccattgatcgtcgctccggtgatcgatccaatcacggtctctcactttatgcctcagtgagatcgtgcgacgccgcggggcgcggcggggaggcgaaggggatttatgcggcggggaggagttcgaggaaagtttggacacggagtgtgcgtgcgtgcgcgcgcggtcggtgacggtggcgacagcgtcgcgtcgcgtcgcgcagggtatggaaagacacgatcacgggggagaggttggcaaggtgggacccgagacttcagtacgtgtccgtgcctgagacgccacatgttgggcaactggacgcggtgatggcatcaataggaaggtcttgatgacgaataatttagctaccttaagtggattaggtggtggttaagaccgtccaaggcgttaatgcgtgtgactgtcatcatttgcaagtttgtaaccggtaatacgtgtgacagtgtgactttgtcgggatgtgcaagtttgtggatgtttctcgttatggtattattaattgttgatctttacaaatataacatgctatattagaaaaaaacaagaagttatatttcttcgttgatttgtgaaggtcagtttaaggggcttttatgttccgattaatattcgttaccgtattcgtttcgattcgtattcgctctgtatttgataatattcgattccgttttcgtatccgggtttccgattccgatttcgattccgagaaaaaaaatatgataatgaatatgataaagttagtttccaaccgtatccgatccgttttcatccctattccaagaacaaccatgtgtgcgcttttcatagtgcatttggtggtggcgatagaatacttggattgggggtggcagcacggagattaaattaaatcatgctgtattagggctggttgtaacaatgtgattgggacactagcttgtttaggccgatggttatacttatacgccgttgcttagcgctcctaacttactattgacggatcatacagggttacacgcgtaaccgttcttactaggaattaaagcaatgtgcacgcaaggacgcaacaatcctaacatccttagcagcttcacatcttcaccaaaactattgcctgccctgcccggccgtcaatggatggccaccacagaaagtcggaaaacgttttgctgtttaggctgtctgatgtttgaactttctagcccatcgttcccttcctagggtgtgcttagttcacacaaaaattagaaagtttggttgaaattggaacgatgtgatagaaaaattagaagtttgtgtgtataggaaaattttaatgtgatgaaaaagttagaaatttaaagaaataatttgaaactaaactcggccttaatttagaacaactctaactaatggataccatacacaattctgactagtgcaacagtgactgcacagttaggcacttattgggcacagccacgtagccaattgacctccaaagtttctctcgagatatggctatatttaggtacagtggtgtaaagttttggcgtgtcacatcggatatacggacacacattaaaagtattaaacatagtttaataataatacaattacaaaatccgcatgtaaaccgcgagacgaatttattaagtctaattaattcgtcattagcaaatatttactgtagcaccacattgtcaaatcatgacgtaattatgcttgaaagattcgtctcgcaatttacacgcaatctgtgtaattagttgttttttttatttatatttaatactttatatatgtgaccaaatatttcaaagtaacagggctaaattttagcggggggataaacaggcgcagtagtgccggtagggcgatgaatgcatggccatcgagagaaacattaaatgcgtgcagagaccgttgttttcctgtagttgttttttttggacccctttgaatcacggaaatagaaaaacggaggaataagtgtaaaacagagcattgcaaaacacaggaaaaatataggaatgaccgtttgattggaccacaataaaaacacatgaatttgaggagagataaagactcaaaggatttcttccatgaggttctacctcttgttaaaattcctccaaaacttgtatgggaagaggcattccatagtaatttcatagaattccatagcgttcattcctttgattcaaagggctttgtagaaaaaattcctataaaaataaaatcctctaaaatttctatgaatttcctccgaatcaaagcgggccttatttttttctggacggccagctttcagagttcagaacgaacataaagacgcgatgatgatttggaacgtacgtcaccgttcctgcgtcatcgctttgcctaaggtttcgatgaggattgaactggaatgagatgaacacagaacaattccccaccccaatcttttttcacttatacttatgttatgtttattagttaaaatttaaattttcaatcttagatttaaaattaattttaagttttcttcatcaaaatttatttttagcatttgcttttagatagttataagaatacatatataaaatttttattcataaattattttcgtttgcaaatatgtacccgaagtactccgaacccgaagtcaaataaatttgacagaggagtattgagtctgtataaaacccggacaacaaaagcttgaagaattcctacctgtggtaaaacagcatcgtccacggtacggtgcgcacacagacacacaaatcgaacactcttgcactaataaattcagggggtgtttatttcttttggtgtaaagtttttaaagtatacgaaaacatttaaagtattaaatgtagactaataatgaaacaaattacagactccgtctgtaaactggacaaatttattaagcctaactaatctatcactactaagtgttttactgtagtatcacattgtcaaatcatgacgtaattatgctaaaaaaattcatctcgcaatttacatgcaaactgtacaattgaatttttcttttcatacttaatgtccacgcatgtgttcaaatatttaatgtgatttttttaaaaaaaatttttgggatctggcctcagcagagatcttctccgacgtccctgacgagttacagtaacaagctactccagctttccatgtgtcaaatccaggctagtgtgatagtgtcacgcccgctatcctgtaccgttgcacatcgatcgtgatttgtcacgtgaaatttcattaccacgccagaaaaaaaaaaaaaagcccgcccgggccgagccgaatcgctcgattatccgtccgtccgagcgcgtctatctcccaccgccactttgccattgtcacgaaaggcgcgagagcggagaaccagttccgcttatgggcaggcgcggtcgcggaacctttgaaacgtgacgaccgagacgtgacgtatccgagccgcgcgcggaggcgagcgcgacgtcgctgtcgcgcggcccgtttctggcgccctccgcggcgtcacgtcgcggcgcgggtcggccaccgctgctcttccggcgcgaagagtcttgttggttgggtgactcgatccccatccccaacccaaagcatatccctcctccgggacaagcgttctggcgcgcacttggcccagcgcctaactccctttcacccaacacacggttcggcgccgatgctagctgctgctgcctcgtctcgtcgcgtcgtagcctaagcaccgcaacgctagaagccgagactggtctatggctaggctaaagcttgcccgatctggaggttaggcgcgcgccgcagcggggggcgacgatgatataaatggccactagcgctagctacccctcctgctccttgccgaattgccgtgcacagtgcttttttttcttcttcttcttcgtcttctcccttgccatctctgcgctccgatccttggttgagctgctgtcttgtttgtttggctggatcaataatgcatgcgtccgtggggaggagatgggggtttgatccttgcgacgaggtaagtgttcttcagctttctcgttgcatgatgcatatatactgctttgtttctccagcttgtttgatcagtagaatcgatgtagtatcttgtatttttgttgtgatcttgctcaaaattaatatgggtattggccctccaagaaagaacttatggttattgtttggttgttaacttgttatgcttgaagttctttttttttttttgagaacaattatgcttgaagttcatgtacggaaacggagtcgtatgtactctgtatagttcagtacagtagttggtatggactggagttgatgctgctgactttcattttgatctactacatctgatctgcgaactagatgagagtcatcaggaaaaattgaagaaataataactaaccgtttaacagtacagagaaaaaatatcatactactagtacagaaagattggtactgctataaatttcttactgttgaactgtaatgttctagtagcttttctggactactaaagatgaagcgatttttttctcaggtcacccacgttgttatgaatgactttgctctgatgaatgaccacaccgtgctgcttcaaggccatgacaagtcaaggatcagcccagctggttatttgacaaggtcaggacctacacagggcggtggcatcagaaacaatattggatattgtgacgggagatccatcaatgaatcctgcggtaaaagaagcacttatccaccaacttacaagaaagatgtcactgttccaaaaagtacgcaatcttgcttgtatctttcctttttgataatggagcttttatgatggatagttctagtctaagaccatgtctatgaaatgcattcattcaggtacaaaaccaagcatttttgatgctgatgaatatgtcagtgttagcaatgtttcagacgttccttcgtcagaaggcaatactatgcaggatgagcacaggaacaaagggaaagatttgttatactgtgattggtctgaactgctcaacttggatgacctcgaagcagatctgaggtaatctcttgctgcctccagcatctatctttatccatcagaagctgagtcctttatgtgaatcttgaacatttttctttcatttttttctgaagaagtttcgagtccacgtttgagataggaagtaatcactttgaagatccactgtggtcttcagtttgcttaccagatgcccagctagtaccaagcagctgtctcttggacaataccaatttgtcaactgtttcgaatgagagcacaacaaagtctatattatcatcagtttcagtttccgatactactagtgctgaaccattgttccttgatcaggtacttccaaacttttgatctttctaattgatttccccctaattttataggttagatgatgccgagggtttcttccccagggtagcttctcttgtcattccgagagtcaagatctctggcctcttcaatatgcaacaaatctccagatcatatgtttcctcaaaataatcttggttccatataggaacattttaacatttctcttcaatttatctctgcagaataatatggcaaatcctatcaacatacaacaaccacccagcaaaggaagaagttcggcaactttgaatcatgaagcacttgcctgttcttccggggaaatcgagcgattttcacaacattcagatgttgatgttttctacccatttgacaatgtaacaagctcggaacgcataagtggctgtgagggactagaggctatcttttgcacaaatcaggaaatgctagccccaacaacatcaagcatcatgtgtgatgatgaaattgtatcttcatcgactttctcagcaccggatctcgttgcaacctacgttccgcgttcgatgaagagatctcatgatccactgaatggaactccagacatgatcctcgacgaaatggctggaaatccactagagatgtatttccctccatcattgactgcatatgaacacccagaacatctgaataacgttactttgacacaaacacaccagtttcctgaaggatttgcaggtgacgatgttctgaaaagtgcagacttacagttcctctcgaagggaaagacttcagcagacttatgtgtgaacccttgctcaccactgattctagaagctgtgccagttaaggatcttggcttccataagcttcaggaaggcatgaatcaggtatactaatagtatcagtaacttagaacaccctcttgcaacccttctagctatgttgcattcttcaggaatttgtgaatgcaattagctattattcaggttgataatatttcagattgtccatgataagtattcagctcttgtatccttccaatgtactttgcagttggacgtggcatccaaagctcgcataagagatgccttgtatcgattggccaattgtgttgagcataggcatcgcattgctagtacaacagagaccgttaaccaacttggagttatggaatcatcagcttcaaagaggtacaacggtttaatgtgatcttcaattatgtttaggacacttgaagtgatcgacagctgagtttttgtgaagtgtaattttctgacatgttcaaatcaaacaggtggagagaaattcagatgatgaaccctatggatcgctcagtggcacagctgcttctccagaaaccgctccaccataaatctccacctgattcggcgctcggcattggtccctgaattgtactgcaccgtgaaaaacacgtaggagtggctgctgatgcgatgtggttttttttactgcacatgtctgatcgattgagcattctaggtccggcaattttttttccctctcggttccggtacgcatgtatatacagtaatcactaaagagtacagacttactagatgaaatgtaatgtgatagcaacgctttgctgttcagagatgtgattctaaatagaaactacagtgttttttttttgttgtcttcagcatttacctgtgacttgtcagatgccccattgtaccgtccaaaaatttcctctattgacggttaccccttggtcgcagatttacacggtttctcttattgacggttaccatggtaattaggcttatcacgtgtgcggaaacgataagtgccggataattctaccaagttcaaagaaacttaaatgtaaactctctccagttttttcacggttcatcacgataaccgcaatggttaccgcggtcgttggagataaaccctgtcgccgaaccgaggccgcctgtgcactaaccgccaattagaggaaaggaaacaaatcttgcaagtgtgcaagtgaccgggctagataatccaatcttgacttggcagttgtgttcgccaccgaacggcaggagaagcgaagcgtggggaggaaaaggcccaaatcctcgcctcctcctgcctgcaaccaccgcctccgtcgtctcgtctcccccggcagaggaatccccaacccggaagctttcgggagtcggacgagctcgccttgactcgcgtccccctccctcgcgcgcgcgcgcgctcgtcgcctcctaaacttagcggccgcgcgggacgcggaggggcgctcccctccagaaataggcggggtgggtggcgaggaggatggggtacctgccgtcgtcgctgggcagcaaggcggcgcacttcgtgtccgacctcaccaccgtcatcctcaacccaatctccgagcgcgagccttcctccccactccccgtgagacccgagatctctctctctctctccatctctcctctctaccgttcctcgtagtgcgggcagtttatatctggttttgaattgtgatcggtttgcggctcgcgtcctagatttgcgcgatcgggctgagtcggatgctgccggtagagatatcagcgtggtttggactttttggagtgatttcgccgcagggatcatcccgttgctagggtttttgtgtaggttgctgaattctctgcctgtctttgtttagttttctgtgggggtttgccgcgatctggatgagtggcaacggaattggagaatgctgatagatagtggacttcgtcgggtggggatatttgtgttctttttgacatgattgaggacttgagaagttgaggtagctgcaatagtaaagttagctcacctgtatgtttctacttgctacctgaaagttgttcttcgtattgtcagcttctgctagtctcgagaggggaaatagttctgttccatctcagtgcgcttttgaaagcctaccccagctgtttatctgttgtctttgttgatgtatccctttgcattctgttatagtttaaagatggtttgcattgttgattgtttgaaataaattgttactgcatgtgtttgatctttgatgccagtttgtagctatgaattgccgctaatcactgacccgtgtttcactcaccatcttgttttccagtaagctcacatctcaagttctttgatcgttgtaggaggtggacaaagacgaagaaaaatcagaggatgacaaagattctgagcaaaattctgacacccccgatggccctgacacatcttcctttagagcattcttgatctcattcctgtcatcatctggttctagtaatggttccatggagataattcctgatcagaatggggaattgggatacccaactttcacaccaatggggaagtcaaaaaagggaaagtctgggctcctaagtagaggaaaacattccattggaaaaatcattagcaaagcggctagaattggtggtttcaaacaaaatgtggagcctaagattgatagagaggtggtagatcatgttgaatcagtttcacctgtattggagcttgaagaatcaaaggaagttgcttccttcattaatttgccagctatgtcagaaccatctgttcttttgtcagaagtgatgaggttcaatatttatgcatcttttcctgttcttgccaaaggaatgaactgggtcttgctatacaggtttaaaacatgtctgttatttaatatggtatgactatatgcattagctaaagtctaatgtttgcgttcacaattgtgcagcacatggaggcatggaatatctttgtctactctatacagaaggagcatgctttgccctggttactctctcttggtattcttcttctgtagcttgaagctgtttgatttttatagtttaactggtactccaaggccagcagccagtgtgccaatatacatattgaagttccaaatattcttacgtgggtgatactgtgatagcactttattccaataaaattctatggtttaaatatcggtctccataattttagctcatgttagttcagtttttacaaaacttctttttttttttgtttagtaataataataatattttccctaacaggtagttggggataaagaaggtgcagtttttggcggtttagttgaggctccattgcagccaaccagtgcaaagaaatatcaggttccacctacacattctgaatttctgataccctttttttctggtttaattaccttatgcagattatgatggaatcttaatattgcaggggagcaatagctgctttgttttcactaatttacacagcaatcctagtatatatcgaccgactggtaatatttcacctcctgttttcatgttctttgcataagaacatcaaaagctgcgaaataattttgttccatttgaccctaccttccagactactagatgtatttctctgtgtagcagtgacttatgattgtttttgtcccctgattcctgttcaatatatataacactagcatactcctacaaaaattctgggggatcaagttgctgaatatattactgttaacactagcaaagacttaactcaggagagcccctgagcattcatttctggtattgcaggtgctaataactatttcacagtgtgctccaccgactatttggcattaggaggtggaggtcatttcgcactttatctagatgccgacctgtaatctcccacctcttaagcatgtctttcacgccgtcaaatctgctggttttattgccttttgtcattgatagctctcatcttttcttctgggttaccctttttcaggttgagtggttcaagttccaattcagagacttttaacaacatgtgtttatctcattccccagacttcgcggtaaaagatgtcgaggtatctaattgtgggcttctggctgaatgctatcatgttcatctgggatgcagatatgtaactgctgttttctttgcaatgcagctgtggggtttcgtctatccttccaagtacgatgagacgctcgccctctgccgtactgagaaaccaggaatttgccggtggtgatttggtggtccttgaaggcttgaattgtgctgaatctgcgaatgatgcatctgtacagtttttcgtagacttgagagaattttagtgcacaggatcgtgtaggattgtaggagtgatggaaacttgcgtttctcatgcgagcttgctcagagctgtacatatttgtaattttcttgctactgttagcgaaacatggacgcgctggttatttgtttcagtgttgtcagcttgtcattatatgagaacaatattactggcgaatcaggagataaatgacctgcaatctccccatgcctctacaagaaattgcatgcaaaacatcactagaactcgcaaatcgtgtgaccgttctaggcttctagcgaatcattttaaagcagctgaggcgcagcgataactgttagtgctagctaccattaaccactgtttatagataaaccaactgaagacgattacattacatacggaaaacgtaaatgacatatttatccccttttatcagagttattcgaatcacatgacgcgtgcaaaaggataactgacgcgtgcaaaagtataactgtggctgcgttttataatacgatcactcgatcagacatacgagagggcaccatcgtatttcgcttctcaagtcaagctcaggttttgaaggaacagatggaatttaaagagcttgaatatgttattgaaatattcaat

SEQ ID NO: 65916 - DNA, 3720 bp, Oryza sativa
gaagagaggcaaggttgtttttgcaaatcttttgttttgaaatcattttgaaatcacaaagtgatttatttctttctaagtttgggtcgaaaagagacttgcgtctcgattcgaccttaagagatgtttttcaacagctcatttggtaatgtaccgacctcccgggtcagatcattacttctcggctcctagagccattccacttgattaatcggctcccagagccttttacattttctcggactcacagagtctagctgcccagcagcacaacaatccgcttccactcgggaagcctagtctatgatgccggtagacatcccgaatcacacagattcatttcttgaccactcaggtcatccatctgccacataggctgattctggtaacaattcccacaccacaacaacttttcacaaagcacaggcaaacaaatctacgctacaggaaacacctcacatccgcccatgaccgcgggcacggctgttcgaacagttagttaacctctgcagagggggtacactttacccacacgacattactaacccggatcacccagcccgtgagattagccacgtcgggagaccctaaggctttcataacaaggcatttcgaaagccgacacaggtttaccatatgccaacgagaggggtcccagaccaacaccaggttaggtcccagaccataccgtgccaggaagcccgagggttctccctgacaccaccccgttgaatccacatgtctcttggcatcatggctcccccgattagctaattactcagccaggggcgtcccattgcacccgtgtggtcgcacttattatatgctcagatgaatttcccacaggaatcggtccttatatgcgaatacaggacagtaccacataggcacaacccccgcatcgcgagttttttcaaacacaccgacgccacatgtcgggttttcaaggcttctcaaacccatttcccaaattatcgacaaacaacggtgtatgtggaatagttggtataagtgctcagagagcacggataccgaagtaccacaagggtggagcgacaaggaatcagggtaatacgacctacaggaattagtgcgactactgggtaggtccgtcggtttggcacgcaaaccgaggccaagcatgttaagtgtgtgattctaataatgtgagctgcaatcaaaataataatgattttccaattataggagcaattggtcaaagggtgacttgcctcgctcaaggtcttcacagagcttcacgaatcttcgagaaaacccgcgatcgacgaaaatccgataaccgcaactttacgcaaacaaacaaaaacctaaagaaaagaccaagaaaaagaccctatttagactaaataatagtgccattaaatagatctcaattttacggaattactggaagttgaacgaagtcaatcgggtgagcggttgagaagatatggattttctaaggattatttgattttctgtctaaaggaaaaggaattattaattcccttggaaaagaaaaggaaggagggatcggatttagacttcctcgggcgacttaggcgcagcccgagggattcacaaggcttggccggccattgggccgagcgcggccacggggaggcggcccattagggggcgcggggagagagggaggcccaacggggtgggcgcggtccgccgcgcggggtcccgagatgggcccgcatggcagcggtcgggtgtatggtggggagggcgcacgcggggacgggcgagacggatcggtggattgggtgcggatgcggtgcgccggtcgacaaggaggcggtgggcccacgtgcagcctcatggctcaccggggtccgcacgcacggggatgaaggggcgagggcgagcggctgaccggcttgactgggtcaagccgacgtggcacctatgccaggccacgtgggcggcgagaggaggaagaaggggggatgccgagatggacggcggacggtggccgagttcaccgcagtttgatgcagaggtctagggccaacgggagcacaccggaacgatggctaggataagagggagtgagcctccggctcggattcgccgggggggattcgatggcgacggatttcgacggtggcggccggcggcgatcaaaaggggaaatcgcggcggggcgacgagaggtcgattcaaggaggagggagcatctccggggcgcggggaactcatttccggcaccggatggggcggaggactgccgaggagggctgacgacggcggcggcctccgggagcgggcggcaacggcggcaagcctatggcgggcggcggcgagacctggggcggcgtccatgcgtgttcggggggctagccgagctaccacgcgagctagggagggagagggcgagcgagaagggagaacggagggtggcactaccaagccgggacgggcgcagtgacgagcggccgacggctcgggagcgagctctccggcctcgggccggggaaggggaagaagagggatggccggagtcctcgtctcgcgtccacgcatgcaccggcctctgatgcgtgcgacggcgaagagacgaaggcaagaggtgggagtggcggcaaggcgtcaacaatggcgcggtgagtgtgaggcgagcgaaaacgagagaggaaggggtttgggggcggcttgggttttatagtggaggcgatgtcggtttggggagggagggaaaccgaccttggtggcggtcaaggagagcgagctggcggtgagctggtgcagtcgcacgaccagcgtccgcgctttggccgcgagcggctgggaccatggatgatgtcacaccccgaagttttcctcccaggccaaaattgtaatttacaaatgaccccaagaaaatgcaggtgaaatcaggagaaaaccctaagaaagtaatgcaaataataatcggacttgacatgtggaatttttcttgagttctacatgtcaaaattcattaacaggatttttagtggaattttcagagctctagaaataattttaaccaattaaaattgagcaagcaatattttattccagggaaaatcctttttcctttttctttttctttttcctctctttttcctcctttttgtcaaatgggccgtcggcccatttctcctttcctccccccccctctccgctgggccggccgcaggccgaggcccagcccggcagccaggccgccccgctgcctcctctctcggggtcgccgacaggtggggctgtcacaccctgaaaattcaaaatatataaattgttgtttaaatggaatttttagaaataattttaaaagtcttgaaaagaaaatctaagtttaattaataaattccaatataaaatggggccagataaaatttcattaaatactttgcttaattctataattcctagatttttctgggatttatttgagctaagaaagtatttgtaataaatggaattgcatttaagaaataattttaattgaaaaaggttttaaaaagtcttcttttggctttgggcccgaaagtcggcccaaaacctctcttctctctcctcggcccagccggcccagtcagccgcgcgcgcgcgccctcgctgtcgctgacaggtgggtcccgcctgtcggagccgtcgtcttcctcgggccgaaaccctagcgcggcgccgccgagcccccgacgctgtttccttccaatccgggccgttcctttccttttccgg

SEQ ID NO: 65917 - DNA, 12112 bp, Oryza sativa
ctatctctcccacggcatgagcagtggcagcagcgctggcacgcggagagagggtgcagcttcacgtgtggagggagggggtggtggtggcaccggcgcccagtgggaggcggcagcaatggcacgcagaggaaggcagcactggtgctgcgtgcagacggagggaacggcgactccggcgtgcggaggaagggggcggtggcagcacaagcaccgcgtgtggagggtgttgacattataggcatataatgatttaatatatttcataaataaatcatgacattgcagatgtatactagtattaacgcatcattagatctacacatgtaagcttagtaaaacatgaacagataaaatatgcgcaacatactgagcatgtatcgaggttacgtaaaaatcggttgctcagcagggaatactcgcggttgcaggcgtcggcgaaggcgcgcagcacgcgagtgaacaggaagacgagccgtcacgaacgaacagggagcagtcgcgcgaagcgcttcccaaaaaccttattgccgccttctcccggtgcaggacgtcgaaggcataggttccggagacctgctctccctatcgctagtggatgccggcgagcgggatggagtagtctacgagtgatggcgcagtacatagtaggaggcaaaacctagattgatttcaagtgtgttgtgtgaagatggcggctcggtttatatagagaagggtcgcttgatcagggcgctcgcacgatctccactccgcgtaaccgaaccgtataagtcacatgtaacttatccggagtccacgccgttttcacgcacaggatttttcggaacgtttccaaaacaaaacaaatccgaatttccctcagcaaaacaaagctgtaaaaggaggttgcatctgcgcaaggtgaggaacgaattttggcggaccattcgacgcgtacatcatgcacgcgcgccgcctgtcctgccctgccaggcgaggcgaggcgagcgagcacgtgtgttccccctcttctctccaccacacatgcttcaagtggctaggtgggcatcctcccttttaaggaggtccccctctcctagaataaccaagatggtagtaaactccgcatgcatgccatcccatgaggtgggcttttatgattttccaaaaaaataatcttcgagtgggctaaggcccatccattaattccaacaatcacccaccaaatctcgaaatcccactgagatttgccttttccaatttactgtttatataccagcggttcgatggagaccgattaagattgaacagccatctagaactccaagtcttgtgtaagcaagtttcactcagagtcttatctggtactagaccgtctatagactacccctcggatggagcgtataagtcatactccttagtctttagtaagcttcctagaagattcacccaacatcttcatagactgcgaccaacagtcaagctcacaaaggtaagttctttcaagaatgctctgcaggacagcattttcgctaattaaagccaacaaaactcattaaggcatagccaacctgccttacagctcatgagagtacatgcatcttcacttagagagggcatagaattgtactctcctcaagttaactaatggcttgttcttcccaggttctaattcaaaggatctccgatcacatagactgggttaccaccatagtataactcacatgggtctcaaacccatctccttcgatgcattgtctatcacatttcgtgatagtcccttcgtgaagggatttgccagctttctagatgtttggaagtaatccaatgttataactccggagtttctcaatttcctgacagacttcaatcgtcttttcacatgtctagacgatttcatattatccttagaactgttcactttgacaattaccgtttgattgtcacagttcataagaatagccggcaccgatttttcaacaataggtaggtgcattaatagatcacgcacccattctgcctcaacagtagcagtatccagtgccgtcagctctgcttatatggttgacctcatcaaaatggtctgtttgcaagacctccatgaaacagcaccaccacctagtgtgaagacatatccactagtggctttgatctcatccatatcagagatccagttagaatcactatatccctccagtaccgcaggatacccagtatagtgaagccccaattccatagtacctttcagatagcgcattactcactcaagcgcatgccattgatcatctccccggttagaggtaaaccggctcaatttgctcacagcaaaggagatgtcaggcctagttgcactagccaggtacataagcgagccaatgatttgggagtattcaagttgattcgtagcaattctcttattcttgcaaagtatcaagctaggatcataaggtattggagaaggcttactgtcaatgtaaccaatgcgattcaagatcttctgcacataataggactacagaagtgtaattccattctcacctctaattagcttaatgtttaggataacatcagctactcccaaatccttcatatcgaaattttaagacaagaatgatttaaccttatttatcacctcaatgtttgtcccaaatatcagtatgttatcaacatacaagcaaattaaagaataactccctcacccccaccatagcgatagtacacacatttatctacctcattgattgcaaagcctgcagatgtcaatgttttatcaaatttctcatgccattgcttaggagcttgtttctgaccagacaaagacttcaacaatttacacaccttgccttcttgaccatcaactacaaactcatcgggctgatccatatatatctcctcatccagctctccattaagaaaagatctcttaacgtccatttaatgaacgagaagaccatgtgagattgctagggaaagtagcacacgaattgtagtctatctagcaataggtgagtaagtgtcaaagaaatcttcaccttctttctgagtatagcacttagcaacaagccgagccttgtacttttcaatagtaccgtcaggcctaagcttcttcttgaacacccacttgcacccaacaggtttacacccatagggtcgctctatcacctcccaagtcccgttagtgataatggaatccatttcgctacggacagcctccttccagtagtctgcatctggagatgcatatgcttttgaaattgacttagaagtgtcatccacgaggtacacaatgaaatcatcaccaaaagacttagccgtcctttgtctattactccttcgaggaccttcactgtcattctcctcagtgacatgttcatgtgtatgttcagtttgttctggtgatgtgattgaactgggaattatttcagagggttggctagaactactatgtgtatccttcattaggaaaaagttcacaaagaaggtagcatcacgagactccataattgtaccaacatgcatgtcaggtacctcagatttaactattaaaaatctataggcaatgctgtgatgagcatatcccaaaaagacacagtccacagtcttaggtccaagtttgcgcttcttcgttattggtacattgactttcgccaagcacccccatgtgcgcaaataagaaagtgatggttttctcccaatccatatctcatatggtgttttgtccttatttctattaggaactctatttaacacatgattcgaggtcaacaatgcctccccctaccatgccttaggtagtcccgcggtgtccaacatggtattcaacaagtcagtcagtgtgcggttcttcctttcggcaatcccattagattcgggagaataaggaggcgtcctctcatgtatgatgccatgttcctcacagaataagtcaaactcgtttgagaaaaactctccaccacgatcagacctaagtctttttatctttctgtcaagttgattttcaacttgtcttataaactttaaaatagtctagagcctcgtctttcattatcaacaaatacacatagcaaaatctagtagcatcatcaatcaacgtcattaaatatcgttttccacccttcatcaacaccccattcatttcacaaagatatgaatgtaggagttctagaggtaccaagtttctctcctcagcagccttgtgagacttgcgaggttgctttgattgcacacaactatggcacttagaacctttaaaaatggaaaacttacgaattaaacacatgctggaaaactgagacttcaagccaaaattaatatgacataaacgtgagtgccaaacattagcctcatcatctacactgccacaaatatggttcatgacttactgcagaaaatcagaaagggaaaagcggaacaggcctccgcactcataacatttaccaataaaatatccatgtttagacaggactattttattagactcaaaaaccaacttaaatccatctctagttagacgggagccactaacaagattcctgtcgatagtagggatatgctgcacgttctttagctgcacgatctttcctgaagtaaatttcagatctaccgtgccaacaccatgaacagaagcatgtgacccattccctattaggacggtggaaccccgtgcgacctgataagaagaaaacaatgagatgtcagcacaaacatgtacattggcccctatatcaatccaccaattagtagactgattaactgaaaaaccagaaggtaaattatcatacccgcttccgtctctagtgttgccaatggtcacattagcagacttagaagtctgccctgcaagtgccttcatccccttgcgttgtggacacttcctggccagatgaccaggtaggccacacacaaagcaagtcctctcatcctgattaggattgttgttcttcttcttcttcaagttggtggtctgctgagctttgtatttccccttgctcttgttctgggccttgtgcacaacattggcgctggattgcccaccatcgcccttagacgcagagtctttttcccgagttttctcctcaacatcaagagacgctatcaacccctcaacggagtattcctgtgtcttgtggttgagtgcagtaccaaaacctctccaagatggaggaagtttcgcaataatgcacccggccacaaattacatgggcctgctcgagtttcttagccatggtctgtattacatgggcctgctcaactacagaacggttatcagccatcttgtagtcatgaaacagctccatgatgtacagattattgctagcatcagtagcaccgaatttagcaatcagtgcatcccacaactccttagcgtcggtcatatgtatatacacctcgaccagacgatcgccaagaacgctaagaatgcatcccacgaagagagtagtggcctcgtcgaattctttctgctggtcagcattaagaacttccataggcttgccagtactcacccagaagcatttcatagctgtcagccacagagtgatcctgatctgccatctcttaaaatgcacaccggtgaatttatccggcctcagtgcattggcaaaccagccattgtaaaatcacagtgcctataataaggtttttggattgttgagattatagacatataatgatttaatatattccataaataaatcatgacattgcagatgtatactagcattaacgcatcattaaatctatacatgtaaactaagcagtaaaacatgaacaaatgaaatatgcgcaacatactgagcatgtaccgaggttgcgtaaagatcggttgctcagcagagattactcgcagttgctggcgtcggcgaaggcgcgcagcacgtgagcgaataggaagacgagccgttacggacgaacagagagcagtcgcgtgaagcgcttccaaaaaccttatcgccgccttctcccggtgcaggacgtcgaaggcagaggttccagagacctgctctcctgatcgccggtgcacgccggcgagcgggatggagtagtctacgagcgacgacgcagtacagagtacgaggcaaaccctagattgatttcgtgtgtgttgcgtgaagacggcggctcggtttatagagagaatggtcgcttgatcggggcgcccgcatgatctccactccacgtaacctaaatggataagtcgcgtgtaacttatccggactccatgtcgttttcacgcaccggatttttcggaacgtttccaaaacaaaacaaatccgaatttcccgcagcaaaacaaaactaaaaaaggaggctgcatctgcgcaaggtgaggaatcaatttcagcggaccattcgacgcgtacatcgtgcacaccggatttttggaacatttccaaaacaaaacaaatccgaatttcccacagcaaaacaaaactaaaaaatgaggctgcatctgcgaaggtgaggaactaattttagcggaccattcgacgcgtacatcatgcacgcgcggcacctgtcttgtcctgctaggcaaggcgaggcgagcgcgtgtgttccccctcttctctccaccacacatgcttcgagtggctaggaggccatccccttttaaggaggtacccctctctagaataagtaagatggtactaaactctccatgcataccatcccataaggtggtcttttgtgattttttaaagaattaatctgagtgggctaaggacccttcattaattccaacagaggaagggaacgacggcgccgacgagcggaggaagggcacagcagcggcactggtgcacagagagaggggtggcggtggcggcagtctgcggagggagcggtggcagaaccggtgcacgacggcagcggcgactgtcgcgcggcgtcagtggccgctgctgcggtaggaggccgtgaatttgtcgttggatattaatctctgttggatttgactaagatttgtgtttctgcttcatcgtgtgccatttgggatccataaaataggacaatatgccgtaaaaaaactgtaaaaatttatgtcaaattttttttacttcattttgttaaaaatctatcaaattagagtcaaatttgttaaattgattcaaatgtttagattgatttgaattttaaaaattcaagccaattttgtcaaaacatccaaatatatacacattttgatataacatgatcaagaagtaagggcaaaagagtattcgttcattagttaaccctgttaactcactttaacggaatagggtcaagcttcatcttcgattggtaattagacttccaaacagggttaaatatgcaattaccactaaaactaagctaatatcggatgtggcacattctattaccattaatttagatggatatatttttttctaggatatatcacatccgatactttgaatttttttagagcgggtatacgtcccactaacacgctttttaaactgctaaacattatgtttcgtgctaaaacattcaatataaaagttgctctaaaatattaaaattaatctatttttaagtttgtagtaattaaaactctattaatgatatattaatagtatcttgatttacgtaaaagactttatcttcgtattcatttaacagagaaaataacaccacctatatctcgcgatcgagtattgataagagaaattcatgcgtcactaggcctgccctacagtagagagccagtactgtccactgacgacaggactgatccacgcactcaccaaaccgaaaatcgcagcaagcatgatgaaatagtctaagtccattattatgcccatgagagttacatgatgaaaaaaacatactccctccataaaaaaagccaaaccccaaaccctaaattttcgtgtccaacatttgactgttcgtcctatatgaaatattttttataattggtattttcactgttgttagatgataaaacataattaatactttatgcgtgacttgtctttttaatttttttcataactttttttagattttttttagagggagggagtacatggatttgggagccagtaataggcactggtggagtgtcattgattcatcaaaaaacctgtggctggctgactggctggtagtactgaggatatgtcagtgatgatctttaaagtttaaactgacactgagaaaaaggcaggatgcatgcatgacctttttgagggataggtgaaagtgatcagacagaagaaacgcattaagtatttgaaaagcctgagcaaaccacagtacggcgccattgaggccatcattattgtcattgtgggaactactcctaggtaaagaaatggctgtctagtctaatggtaaaatcattccataatactccatgctcctcatatctcatgggtgtaatgtatgtatgtgttgcgaacagatattatataaagtgtcgtatagtatgtttgggcactaataaaaaactaatttacagaatccgtcagtaaaccgcgagacgaatttgttaagcctaattaatctgtcattagcaaatatttaccgcagcaccacattatcaaattatggagtaattaggtttaaaagattcgtctcgtaaattagtcgcaatctgtgtaattagttattttttttagctcatatttaatattttatgcaggtgttcaaacattcgatgttataggatgtaaaatttttaggtgggatgagaacatgccctcacttgaaacttttgcttgaaccttatgcatattcatggtgaatactccctgctcctcttttgtgccatcatttggccatcctacacagtcaaatcacaatcaacaaagatgtgtgcatgatgcatttctacacagtcaaaagtgcaggtttgggagtttggaatttggattttggcaaattcagtgggcccacaaggacataattttgacgattccaaaatttagggctaatttacaaaacactcccacacaaacgttgccaaaccaaaattttggtattgctaacaagctgtttttataggtcaattttgacataatccaaactaatatttttgatagtgttaaaatttgtccatccctttgcgctaccgaaaattctagtagcgtattaaaccaaaccagccttatacccagagagattcaaatatgcaattcaattttacgaataattaaattaatctctaatttttatattagtaagacattattggctagaattaggaattaatccctccattattaaatgtgcgatgcgagtgtactaatttatattatgcataaatattaacatatttggtactgtgaaaaccacatcaatagagtatttatggctagtaatctggttttcctttatggtgcggtagtgggctccataaaaatatctccgagaagacaacacctagtggaaaaagtaagtgtcagtgttaattaagggcaataattaaattgaggctacgcgtcaagcctaggtctatacgagatatgagaatctatagctgtgtttagttggtgtgccaaaatggacgtatatttgaaatattaaacgtagactaataataaaataaattagattctgccttgtaaactgtgagacaaatttattaaacataattaatccatcattaacaaatgtttattgtagtatcacattgtcaaatcatggtgtaattaggcttaaaagattcgtcttgtaatttacatacaaactgtacaattgatttttttcgtgtacatttaatgctgtatgtatgtgtataaacatttgatatgacggagtttttagaagtttaaagttaactaaacactgcctatgtatatctaccgttcctgtataattgtccccattagttgtgattttaggcagccaaatcaccttatttatttgaggcattagattgatgtcaaacttcaatagaaaccgttagatttatattatgtctacctgctgctgacttaattggcttcctcctgccactgctcgagaaacccacggtagttcggtttgtaaactctttagtcctgggttataaaccgagacctgaatccgagattaaataacaccaaccgggacaaaaatgatgatagtgccaagtggatgtagtcttgtgtcaccatgaaagcacttttttttactagaaactgccaataacaattcgcgtggctaatctcaattattctatcataaaactctcctgcaattcttatcctatcttactataaatataaagttatcccctactaactccttaagcttaatatgcaaagataccacatcatcatccactaacaagatgccacatcatcatccactaattaacaagatgacacatcatcatccactaacaattatcacatttaaacatcatgcaaacatactatatttttatagtttttataatttaagagcttttcaaatataaacttgttaaattatcatccaacataattcacacaatattttaatgtatatcctatatacttatatagttcatcctcacttactgcttaaatgattaatctatggtccaaattatctttctcctttttttctataattaagtcatatcacattaattgtttttagtctttagatgattaatctacagtccaaactatctccctaattttcttcttccataaagtcataccaccttactttttacgtttgaatcaccatttacatactatttaaatttaaattatcatagaccatattaatttacttaatctgatgttatctagctatcttacacgttattttttttgttatcatactaaattctcgcagcaatgcgcggggtttcacctagttatataattagaacggtcctcacacaccattgaaatcctctatcttatataagagctggcatatcgcctttgtcccttcccgatcgatgctaatcacaagtcggccttcggttcatttcatggaacacattaatttttttcaattatccgtagtctataggatactgtttctttttttttagggcagtactacatagtttcttagtcagaaaaagtatgaattacccctcgaactatcgtggtcgtccgaattaccccccaaaccacaaaaccgggcattcttcatcctcaactacacaaactggacaaattacccccctcgacccaatccgcggtggttttagtccacgtgacgtacgcgtggcagcccagtcagtcctctatttataaaaaaaaaagagtaaattgcatcttagggctactatttcttacgtgtgttgtaacttggactagtgtaaaataaaacttttcactttggaacaagtatgtttacagaaggttttaatttggactatcttcttgttcctccagctccctttcttcctctcttttctctgtacagctcacggtctctttctcgatcaggcgtagtgcatgagaagtcaagaaggaaaacccttcacagggcagccacccaccgaaattgagctcgagctcaaatgtaggcggcactgggaaggcggagcttgagcactgcaaaacttgctgaagtgcgagcggcacatgtggaaatttagcgcaggcgcgcaacacgtatagcactagcggaggtcgagcatgagctttagcgtggctgtctgctactccctccgtttcataatataatactttctaccactgcccacattcatatggatgttaatgaatttagacacgcatatatatctagattcattaacatccatttgaatgtgcgtaatgctacgaagtcttatattatgaaatggaggaagtacttggcttagttcttatagtcagttcagaaagtagcagcaactgtatgtcattgccggccagcttcttcatatgctacttgctaccagtaggaatacttgttgtgcaccctctgctttccttgaaattaagcaacaagcactagctagttgatgattgaaaatgcaaactaccctttgaattctttggaagactttacagattgaaggagagagaggaggaagagagttggaggaggaagaagggagtccaaattgaaacatcatgtaaagatatctggcccaaagtaaaaagtttggctttagtctagtccacattgtaacaatggtaatcaaaggtggctcaaggtgcaattcacataaaaaaaattt

SEQ ID NO: 65918 - DNA, 801 bp, Oryza sativa
gcaagacgattgaactcgtgcagttactcggtaactgagcgagatccctgagtaagcgacctgaactccttcttctcgagagacactactcctgatggtatatgcgtcttccgaaaagcagcggtgaattcaagccaagtgataggttcagcagtaatcctattcaggcggaagtgatcccaccattcagaggcagggccatgcaactgatgtgatgcaaatgagaccttctcctgatcagtacactgaagcaaatccaacttcttctctatggcatgcagccaatcactagcttcaacaggattagtggtactagagaaaacaggcggcctcacacgaagaaattctgctaacttgttctggggaggtgcatgattatttccttggttttgctgattctgaaattgctgcatcatcatgttcataagctgtgtctgttgagcaagaacttgggccagagtgggattctctccattgttgttgttattggggttgttgggaccattcccattgctgcgagtgttcaccatctgacatggacagggcacaagaagagaaaccggggaaactacttaagatagagaattactttaacttttattgctcttaactgagtttcattattacaaactgaagactctcacaccactaaactctccaacttcctaacactcaaaaacaaacaaacgcatgcaattacatcccaccactgatgtaaatcacatgcgagccacacacaagcaaactttaagcaagcaaactaacacaacgatataagacaacgacttaacaagtcactct

SEQ ID NO: 65919 - DNA, 8978 bp, Oryza sativa
cggcgagagcgagcggcgagcggcggaaacggaagagcggagctcgagggacgattttatagcgtcggaagggagagaaggcggccggggaggaaggaaaccgaccgcggagttttcgcccgccatagatgcgccggcgacgattacgggattaaatccgagcgaatccgagggagagagagaggggaaaacgggggaaacgggagagggaatcacggggagtgattcccctctctttaatgcgtgcggggacggcgggatgcggcgcaatccgcggcggcggcggcgctagggcacgggcgcggcggcgggcgcggcgcgaggagggagatgacaggtgggccccacccgtcagcgagagtggcgggcgggcccgcctgtcagcggcgcgcgcgcgcggggaggccgatgggccgcgggagaggagagagagagggagagggaagtgggccgagccggcccaagagggaaggagggggaaaaaaagaacttcttttagggttttctttttataaaacctttttaactttgtttatttcttttcaattattatttgtgctctgaaaattccactaaaatttgtttaagcattttaggcttttaggaaatatacaaaaatcctccaagcctcatttgacttttatctttgcacattttaattgttggaggctttcacatgaattttaattattctttgcacaatttcgaggatagattttagagtcgatttgggacgcgacaaacctaccccccttaaacggaatctcgaccccgagattcggaagaactggcgaagagaccgggatgggctgccttcagctcgtcttcgcgctcccaagtagcttcttcttcggcgtggttgctccactggaccttgcaaaaacggattactcggttcctggtcctgcgctccatggtgtccaggattttcactggcctctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaagcaacttctccacgtcgagcgatgatacggaagggacccacataccgaggtgcgagcttcccttttgtctgaatcctgtgcacacctcgcaatggcgtgacccgaagatacacaaaatcatccactgcgaattccagatcacggcgtcggttatctgcataacttttctgccgagactgtgccacctttagattatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggattgatagctgttattgtaggagaactcggcataggggagactcttatcccaagtcttcccgaaatctaggacacatgcgcggagcatatcttctaggatctgatttagacgctcggtctgtccatctgtctgcgggtgataggcggtgctgaaattcaatcgagtacccagctcttcttggagcttcttccaaaagtgagaggtgaattggcttcccctatcagatacgattttcttgggaataccatggagactcacgatcctagcgaagtagagctccgctagtttgttccctccataggtggtcttcacaggaatgaatcgagctaccttggttaatcgatccactattacccatatagagtcatatccaccttgggtttttggaaggccggtgatgaaatccatcccaatttcatcccatttccattccggcacttggagaggttggagaagtccagccggtcgctggtgctctaccttgacacgctggcacacatcacatagagccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctggtacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttccaacgcggccaaaaatccacgaccaactatgcttaggttcagggcttccatctgttgactaagctcgggcggaatgctacggacgttgagagtattgcaatggctcttccgacttagagcgtcggcaaccacgttagccttaccagggtgatagtgtattcccacatcataatccttgatgagttctaaccatctcctttgccgaagattcagatccgactgggtgaagatgtatttcaaactcttatgatcagtatatatttcacagcggttcccaatgagatagtgccgccagatttttagagcatgaaccaccgctgctaactccaagtcatgcgtagggtagttgccttcatgaggtcgtagttggcgtgaggcataggctaccacatgaccgtcctgcatgagcacgcaccccaatccttggcgcgaagcatcacagtacaccatgaaatccttacgagtatccggcaagattaacactggcgaggaaaccagcttttctttgagagtttggaacgccttctcgcattgcgggctccacacaaacttctcttcttttttcaacaactgtgtcatgggtcgagcgattttggagaagttctcgatgaatctccggtagtatcctgccaaacccaagaaactgcgaatctgagtgactgtcttgggttgcttccaatcggtgacggcggtcactgtttcggggtccacagcaactcctttagcagatatcacgtgtcccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacgaacttatccaagtattccatgaacactttgttcatcaagttcatgaagaaggcaggagcattggtcaagccgaacgacatcaccgtgaattcatacagcccgtatcgcgtggtgaatgcggtcttcggaatatcttcttcccgaatacgtaattggtgatatccggaacgaagatcaatcttggagaatacagtggcacctttaagctgatcgaacagatcatcgatccggggaagagggtacttgtttttgatggtgacttcattgagagctctgtagtcgacgcacatcctcttcgtcttgtctttcttctctacaaaaatcacaggagcaccccatggggaagtactcggacgtatgtaccccttttctttcaactcttccaactgtttctttacttcggccagttcatttgctgccatacggtagggtcgcttgtgcagaggagtggttcctggagcaagatctatccggaactcaatctctcgcttgggcggcataccaggtagttcttccggaaacacgtctccgaactctctgacgatggggatttctgacagacctatctgatgcagttctgaacttctgacagaggttggaggtgcaaagaaaacaaccggttgttctggtcctcggtacatagtaacagtgcgtctcgcgcaatccactactccttggaattgtgccagccaattcatcccaaggatcacatccaagttctttgtgtctagaagaatcaggtccgagggaaaaggaatcccctgaatttctatagggacggcagggctatagtactttgctgtcataacccctccaggggtggtgataagcagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacatccttcccgccgttgttggagcggggaggcgcttggccttgctgacgccttggcttcgggcatttatccgcaaagtgcccgggctcgaagcagttgaagcacagccgctgcggacctgaagcgtccctgcggccttgaacgggctgcccagctggcgtaggaggacggggcgcacgagtcccttgctgattctgctgctgttgctgctgtgggacgcgcaccacggattgaggtcgaggcgcggagcgaggttgctgctgctgctgttgctgctgcgaggaggatccccctgggtagggattggtgtagcggaccctctggttagcaccctgctgattgcggaagttcgccaagcggcgcttgtgcgattccagctccttgtgcttggcttccaagcggatgctcttgtccaccagacgttggaagtccgggtagtctccagagactagacgaacagacagctcagggtccattcctgccaagaacttctcttgcttctcctcatcttcccgcacatcctccggggcataacgtgctagattgttgaactcatgcaaatactccatcacggagcggttgccttgcttcaactcccggaattccctcttcttgagagccacgactccggcgggcacatgggttctccggaaagcggcggtgaagcgagcccaagtaatcggctgcccctcgggctgcgtagcctggaagtggtcccaccatagagatgcgggcccctgcagctggtgggcggcgaagatgactttctcttcgtcactgcactgcaccgtgtctagcttcttccccacggcatgcaaccaatccaaagcatccacggggttgttggagctggagaaggtaggtgggcggatgcggaggaactcggcgagtttagagtgttggggaggtggtggtggagcattctgttgtggcaggttttggaggtggtggaggaaagcggtcatcatgttggcttgctgggcgaggatttgggtgagaatggcgttggtgtctggtggtggtggtggaggtggattgccttggtggttggggttgctgccctcgggttggttgccttcaccggtgttaacatttctcctggtcgtcaccatctgaaaaccccacacagaaccagcaagcagagaaagagagctgacgattaaaactaaccacccacgactactattattcttaaatttatcactgctattaaattggttcattaaagttcaagttgcttaggcaaattaaaaataagacaggctccgacatagttacaccacacaccggcgtaaccatgccccacacgactcaacaagaagataaacgagaaagaacacacgcgcaggcctactaactgctcgtctaacgctgcgacgggccaggacggaaggtgagcaacagcgcaccctccgagctaccaacgccggaggcttccccctcctggggaaccacgggcgcaggctcggcacgaggggtctcgacgaagcaggtccacgccagggactgacggacaagctcgggcctggaggtgctcttgcgggcggtgatcttctggctgcggcagacgcggcgacgcttgggacggctgtcctctccctgggcgatcttgagctggtgcagctgcgcctccactgcgtcgaggtccttcttgagctgcaggttctcctgacgcagctccaggatcttcaggttgttctccaccatgccacgacgcaccatctgatggaagtcgatacgagccgcgtcgtacgcctccaccatgcgtgccaggtgcacgacggtagcgtcatcctccgagctggcgtctcggaaggtggcgtagtcgcgggctcctccgcgacgagggtggtagcggtagggcgagtgctgcaactcgtccgggtagcgctggtgaagggtgccgatggcgaggagagcggcgttctggcaagcggcggggaaggagtccccacccgctgtgactgccagcgaaatccgctcgggagagccggagaggatcactgcagtgacctcccaaccagcgtgaggctctgcatcctcaccctcctgctccgggagcggcctggcctggtaatccactccatgtggataccccaagaccacgcacatgccccgcagctccaagacgaagccagtcatgtccaaaccacgacgggtaacgctgccggccatctacaaacaaaaacaaaagaaaagcaacatttaaaagatcagattttgacgataaatgaagcagcaagacaaagagagaatagcgggttttcacaaataataaaggatttttatttttttggaaaatatagccaaggcttgggatctacggctcgtcctagggtcaagggaggctctgataccaacttgtcacgaccggaaatcacccaacaggcgttcctgacgtgcgtgcattattccttgtcccaggaggcaaggtacaccaaaagttgatacaattcagagtttaacaagcggaagcgtatataaaattattacacgggcagcgaaggcccaacacacaaagacaaacgagaaacagcggaagactagggcgacgaccacaggcgcttgacggcaggcacgagctagacaccaaagccttcatcttcaaggaactcctcatctgggcttgggaaaattaagcaagactgagtacaaccaccgtactcaacaagacacacccacaaatgcaaaataaatgcaagggagtacaagggaattataacataaagggttagggttgcagtaaacagcatttaaagacatttagttgctcaaggccattttgtaaacacgatcctagaactatccaatattattaatcaaggccgtgaacccacacgaacctgccttaacccaaggcctatgatgattcagaccgaactggcaacccgaccctgggtcccagctcgtcctaagccaacccaggccaaccattccatattttagttgttaagcaggttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccacgcaccccgagcccagcctaaaaccattttaggggattttgaatagagggggcggtgtgaagccaattccacaataaaccaacaattccagagtatccaagtgatatgaatatttcccaaagtctaaagttgtaaaaccacctaaggttacctaattagattgcgaagcatctacctaaaatttatactagggataccatgagtagagtgtccactagttgaggttttgtttgtctagggtgaacaaggtaataataataacaataacaataataatatggtcataacaaaggtaaataggcatggctaagtaaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttatatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggtggagcggcgcccgagagagaggagggaagggggaaggcgaacggcggtcttcggctcaccccggaacaacgacgatgacgagaacggcggccggagcggaggaagacggcggcgcgggtcgggatgacgatgacgacggtgctccggcggtcggcgggcgaagcggagcggcggacggggtcggcaaccactcggcgaagcggacggaggtgtcgccgagtaaggaggaagttcggagcggcggcggcggcggaacggagctcggcggcgatggcggagagagcggagcacggcgcgagcacgaatccgacggcgagagcgagcggcgagcggaggaaacggaagagcggagctcgagggggatttta

SEQ ID NO: 65920 - DNA, 13296 bp, Oryza sativa
tttcgaggatagattttagagtcgatttgggacgcgacacagtgccatctgcagattggcctggtagctgttgttgtaagagaattccgcatatggcaagcgtttgtcccaagctccatcataatcaagagcgcaagctctcaacatatcctccaagaattgatggactcgctcggtctgaccatcagtttgcgggtgataggccgtgctgaagtttaaacgggtccccaattcttcctgcagtttctgccaaaactttgaggtgaactgactacctcggtcggatagtatcttcatgggtaccccatgcaaacacatgatccttgcgaggtacaattctgccaatctctttcccgtataggtggtatgtactagtataaagtgagcaaccttagtgagtcgatccacgactacccagattgaatcgtgacccgatgatgtccggggcagtcctgttataaagtccattccaatctccttccatttccattccgggatttgaagaggttggagtaaacctgctggtctttggtgctctgctttcactcgttggcaaacatcgcagagtgcgacgaattcagctatttctctcctcatgctgacccaccaaaacctttctttgaggtcttgatacattttagtgctgcctggatgaatggagtactgggtctgatgagcctcggtgagtatcagatccttcagttccttgtcgtcaggtacacacaatctttctcccatccagattgtgccatgctcatcctcaaagaaatcccgagcctttccgactctcatgttctttttcagctctgctatttccggatcatttacttgagcggctctaacttgatccacgagcgtaggccgtgcctccagagcggctacgaacccgtgttcaacaattcccatgttgagatgttcaaactcctgccgcaattcctcacacatgccctcgatgcatagggcagtgcagtaacttttccggcttaaagcgtctgccaccacattggctttacccgggtggtagtgaatactcatgtcatagtctttgattagttccaaccatcttcgttgtcgaaggtttagatccggttgggtgaagatgtatttcagactcttatggtccgtatatacttcgcagcggttgccaatcagatagtgcctccagatcttcaaagcatgaaccactgctgccaattccaagtcatgagttggataatttccttcgtgtggacgcaactgccgcgaggcatatgcaaccactctgccctcttgcattaggacacatccaagtccgtgacgggatgcatcgcaatagacctggaagtctttcatctggtcgggcaggatcaaaaccggtgcggatactaatttcttcttgagctcctcaaagctcttatcgcactcagctgtccatttaaacttctcatccttcttaagcaactgagtcatgggtcgggcgatcctggagaaattttcgatgaatcggcggtaataacccgcaagtccaaggaaacttcgaatctgcgacacggtcttaggtggggtccatttggtaactgactccacgttcgatggatcaactgccacaccctgagctgtaatgacatggcccagaaatttgacttccgtcaaccagaagtcacacttgctgaacttggcgtatagctggtgctccttcaacttttcgagtaccagacggagatgttgctcatgttcttcctcggattttgagtagataagtatgtcgtcgatgaacaccacaacaaacttgtccagaaattccatgaacactttgttcatcagattcatgaagaatgcgggtgcgttggtaagtccgaaagacataaccgtgcactcatatagcccgtaccgagtggtgaaggccgtcttcggaatatcctctttccggattcttcaactggtggtagcctgatcgcaggtctatcttagaaaacactttagttcctttcagttgatcaaataaatcgtcgattcgcgggaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgctcatcaacttgcttcttgacctctgctaattcgttggccgccattctgtacggtctcttatagattggagcagttcccggtgccaagtcaatccggaattcaatctctctcttgggtggcatggtagtgaggtcttcggggaacacttctggatactcgcagactatgggtatatcttccaattttctcaagttcttctctacggtgtccactgggatttccgtctcaatctgattcaacgagacccctttctttggcgagactagagatttgtacaccacggtttctcccttctcgttggtcaaggtgactgtgcgactcgcacaatcgatgactcccttaaacttggtcagccaatccatcccaagaatgacatctaggtctttggattcgagaagaatgaggttggctagaaatggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgtgttgcaccagaatcaaaaagtactgttgcagggattgagttaacagggaacgtacccagtacgacctccggtgctgtttgtgcctcctgcgcagatgcgtggttgacacgagcctggataaaccttggcccggcacgcctgggcttcgggcatttgtcagcgaagtggccaagctcgccacagttgaagcaggaccctggttttgctccagtctccttcttggcttgcgcgggctggcctgactgtgccggtgccactgatgggcgtggagctgcaccgcggttgggctgacctccatggtggttctgactgccactggtgccctggtggaagttgctagggttgaacgggcggtgctggcggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtcctattgccctgatggagtgcacgaaattccctcttcttttgtgccacgaccccatctggcacctgtgccttcctgaagctacggcagaactctgcccatgtgacttcagtacccggtgggcgggtggccatgtggttgtcccaccaagctgacgcgggaccctgaagctggtgtgtggcaaaagcgaccttctcctgatcattacactgcaggagattcagcttcttctctattgcatggagccagtcgttcgcctccatagggttggtggtgctggagaaggtgggtggcctgacgcgtagaaactctggcaacttggactgagggggagggggaccaaactgttgatgctgctgttcggcgtgctgcatcatcctctggtgcatctgctggtgctgctgctgcatctgctgcatcatggctgccatcatctgagtctgatgtgccataacttgggcaagcgtcggattctcgggaagtggtggcggaccattgccagaatcgctgttggggtgcacaccatcagtgcgctcttcgccgttgctgccctcgcctgtcgcgcgactgccagtcctggtgtagaccatctggagggaaaagcagacgggggaaaagaagaaaaacagatgctcaagaactaagctttattacaaaggaattaaaactgcaattgttctgatctgaattaaaacacttaaaaagcaagcaaaaatccttattaagacagccatatcataggcacatgatatcgaccgtcaactgaccccaaacaagcaacctaaacacgcaaactaacaaccagaagctagaccatcgataaactaatgggaaaacgagcctaatgctcggaacggctcctgcggtcggtggagtcgaaggcgtcctcctgctcgtcacccggtccctctgagcgactcctggagcctgacagatcagtctcgccgctgccactgggagtagcagacaaccaacctccggtgccactggctggacccctggcggctgatgctggagcgaaggagagagtgaacgcgggagctggaactggagctgcaggaactgcgggcggaactggaggtgctgcgggagctgctgctggaggtgggttcctgggcgcaagctggatgcgcacaggtgcagtcgtcgtcttgcggggcgtggtgcggatccggactccttctggcgctggaagaccctttagctgagcgttctccttcttcaggcgcgctatctcgtccttcagagcgacgatcctcatgagcttcccatcgttcaaagccttggtcgccttgtgcaagtccgagtgcatcctgtccaatcccctcatcacagcacacatgtgaccaaaggtggtgtcgttctcgccagctgtcggacggaaggagctgacgccatcaccgttggctcgacgggggtggtagcggtacgccgtgtcgtggaagatgtagttgtggcgctcccgtagtctggccatcatcaagtaggctgcctcctgacaggcgtgatctgctgtgcctccagatgcctcgaccgccatgttagcgaggcaagtccccacgtagccatggacctccaagcggacacggtgaggaagctcgccactaagcagcggaatcgtcgtgtactccggcgcattggggtagcccaccaccagtgtcatacgtgccaactctgccacgaaatcgatcatgccttctccgcggtggttgggtgggtgaccggccatctagagaagacaaaggagtaggatcaatgcatgctcaaatccaaatttaaataaagcaataaaagacccaaataagggaaacgaacaagagcgaaatttttatgcatagatcattttgcatgagagcgaataaacaagacagacccacataacgataaaataatgagaaattagatacatactaataataacgataagagcataaacaccttgcaactcatattcctgagctaggacctaatgcatttcacccatcaaaccccaactgactgacgaataaatcccaataattttactaaaaccctagactgacttgttttgaaaaaaccccgcttaaacgagcgaccaagattttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacatacagatccacgtcttacaaacatcgtaaagtcttacataaatgcagcggaaaacagaagaaactggagctaatccttgactaaactgcagcgggaacaccactccacaggcatcctcgacggcacggacgaagcctactcctcagagaaaccttcatctgacccgaactcgaactctggggttgggaaaagtagagcaagactgagtactacccactgtactcagcaagtcataccggaatagaggtatgatgcagggaatcatcaaagaagagctaaagtggttcatttgcataaagcgagcatttataaatagagattgaaggatttaaacagttgtaaaaattaagcagtattaatcatccactgtccaacgctacaccacgttgcaacaggcccaaccaaccacctataccatccaaattcattagactaaactaatgtgattctaatcacggtgaatctggttgaccgcccataaccgcgggcgcggctattcgaatagttttactctgatcagaggtgtacaactgtacccacaagacacagccccacgacacgtttccgtgcgccggcatgccaccacgacataccggaaagaggccgtgacaggacccttcgcataaccccctttagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactaaaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtggttcattttatttaaccaacaccagagcggtggtattaaaccaacattaccattagaactaacagtctaaacattaatatgattttccccattgtgatctagttgaactaagcaaggctaagcaattcctagtccaaactctaatcatgttataacccaagctaacaaaggagcatggtatccaaaaagcatggctgtaacaataggtaaccatcccatagtaatattataaaacaatacaatatttgaaaggaaacaatagagcattggcaatataggatcaacatgttcaagtgacaagcatgacttgccttgctctgctgctgggggaacctcggcgactatctcgaagtacaccggagcgtcggagggatcggaatctagcggcatacaaagcaaacattgcaaacaggctataagactactgaaacagagaacaaaaccatttttaatggattctacacatttttcttgatttactgagacttgagtgggattaaacggagctcggatgaattagttatgaattttagaagattcactgtgtttattactataacaaaaatccttaaataatttatggcgcaatattaaccagggctgacgtcagcacagggggggagtgcggcgccgacatgcggggcccactggtcagcgactcaagggtgagcggttcaccgtggaccgggaccacgcgggtggtccatcgccggtccacgggaccgacggcccagatcgccctcgggccgatcggacggcggcggtggaggcagccgccgggctcggctcggcatcaaagccgaccggccgacccggggctgacggcggcggcacgcgcacgtcgcgttgccggcgacggcatccggcggcggaggcgacggcgcaaaagcgacgcgaaagcggcggcagtggacggcggcaacgaccaaaggcgacggcaagcgcggcggcggcgacgcacggagaatcgaggaagtaaaggaaaggggaaggagtcccccccgaaggggacgacggcgtccggcgacgaggagcgacggagggaagtcgacacgcggcggacggcgaccgggacgacctaaagaacgaaacgaaagggattagagaggaagagaggggccataggaggcggggatgccggccgaaggcggcggacatggcgaccctcaccgtcgcacgacgggaacggctctccggcgacggacctcgacgaaagaggggtggacgggatggatctcggccacgcgaacccgacggcggcgacggcgcggtgcggcggcgagcctagcggcggctagcggcgaccggagtagcggaagcggcggcggcgggtggttgcacggcgcgggagcaatggggagctcgggaggggtcggcgaaatggggaaaaagtgagagaggacgacggcgatgcttaaatagggggagagggaaccggacgtggccgggagaggcgggaatcgccggccgacgcgggggagtggggaggagagagaggcgggattcgattttcgaatcccggccatctcgggcgcgggcgcgagcgggagagagaggggaatgggcgcgggagattcggcgcacgcgcgggcgtggtcgacgtggcccgggggaggcggagacgtgggcgcggcgatggttgcgggcgcggcggcgcgccgggatcggcgggaggagggagacgggcccgacaggtgggcccctgtcacgcccggaatttctatccaaaattccaaacgcttacatgtgtgtgaacccttgtccaggaatcagccgaggcacacaataacaaattgataatagagtacaaatattactctaattaataagcgaataaaatgtcattacagaggtagatagttcctctcaatcaataaaaatctaagcagcggaaaaaaaaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttgataaaacagttaagtaattaaacaatattaatccaacgctatacaacataccctgttgtataggcccaaccattctgaacaaccatcccggctgcacagttctatctccaaaccaggaatgtaccattccaaaccaggagctaaacaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctctgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataagccatcatgaaataatagtgagtcattagttatcccataaatgtactaatgtttctaagcatggctaagcaattatatctagtatctagttggaccaatataaataaagctcaactagtcaaattataataacctaaggtatcaaggaataaggtaatcaagtacgaaagggccataacaaaggataggtcaattccacccaatgacattcgaaaatagatgcaatagttgaatagaaacaatagctttaaataggatcaacatgctcaaagggttgtttgggatctgtgtgacttgccttgctggccttggaattcttcaaactcttcttctgcgaaaacggactctccggaaacgactaaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgactcaataatgaattatttttgaaaaggaaaaggggatttattgcgtcagcgggctagggtttggtggaccgggcgcacgggcggcggttcacgcgaacggacggccgagatctaaccgatccaagatggacggccgagatcgatcgggtccacagcggctcacggcggacgaccccgatgacgtcagcaatgacgtcaccgacagcggcggcggctcggcggagcggacggcgcacgctcgccggcgaacggcggcgcgagaacgcaaacggaaggcaccgggacgaagcgggcggcacggcgaactcaccgacgaccaaaacgacggcggagaagcaacggacggcgccggcgacgaggaggaaacggcggagttcttcggcttgacgacggcgatgatgctccggcggtctccgacgatggcgaagcggcggacgaggacggcgacgacttggcgaccacgatgacgtccttcccgagcgacggcgacggctgaaacgacggcggcacacggctggagcggcggcggcgacggcaaagctagggcacacggcgctagagctcttccggcgacgagaagcgaaggcgagggtggcggcgagaagagaagactccgggggtccttttaaaggggctcggaggcggcggcgaaggcccacggcgacggcaacggcgaaggaaactcgcggcttggagagaggaaagccgatccgattcgaactcgaatcaaactcattccaaaccgattgagccaaagattccaaaggagaaaaggtagaggagatcccggagattgtttcccctctaacaaatcggccggagaaggaaaggaacggccggattggaaggaaacagcggcggcggctcggcggcgccgcgctagggtttcggcccgaggaagacgacggctccgacaggcgggacccacctgtcagcgacagcgagggcgcgcgcgcgcggctgactgggccggctgggccgaggagagagaagagaggttttgggccgactttcggcccaaagccaaaagaagactttttaaaacctttttcaattaaaattatttcttaaatgcaattccatttattacaaatactttcttagctcaaataaatcccagaaaaatctaggaattatagaattaagcaaagtatttaatgaaattttatctggccccattttatattggaatttattaattaaacttagattttcttttcaagacttttaaaattatttctaaaaattccatttaaacaacaatttatatattttgaattttcagggtgtgacaaacctaccccccttaaacagaatctcgtcctcgagattcggaagaactggcgaacaggtgcggatgagctgacttcaattcatcttctcgttcccaagttgattcttcttccgagtgattactccactggactttgcaaaaacggataactcgattcctggttcttctctcacttgtttccaggatacggattggtttttcaacataggtcagatcctcttggacttctatctggtcaagattagcttcttcggtaggtacccttaaacactttttcaattgcgaaacatggaacacattatggactcctgccaaagattgaggtaactccaactgataagcgacctctcctcttctactgacaatcttataaggtcccacaaaacgcggtgccaattttcccttggtatgaaaacgatgaactcctcgaaaaggcgtgacacgaagatacacataatctccttcttcaaaactcaaatccctacggcgattgtcggcataactcttatgacgagactgagccacacgcaatctttcttgaatgatctttaccttttcttctgcttcccttaggatatccatcccgaaaacctgacgttctcccgtttgatcccacaaaagtggagtgcgacacttccgaccatacagtgcttcgtaaggagccatctgaagactagcttgataactgttgttgtatgaaaattctgcataaggtagattcttatcccaacttccaccgaaatctagagcacaagctctcaacatgtcttccaaaatctgattcaccctttcggtttgtccgtctgtctgcggatgataagcagtgctaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtctttaccggaataaaatgagccactttggtaagtctgtcgactatcacccaaatagaatcatggcctgatgacgttctgggtaaaccagtgataaaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtacatcttagtactaccagggtgaatggagtataaagtatcatgagcttctttcagaattgcatctttcaaatctttgttgtcagggacacaaattctttcacccaaccatacagttccttgctcatcctccaagaaaccaatagcttttcctcttctcatattcttcttgatctcttaaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttttgtagcattgcaatagccttttctgctaagagcgtctgctacaacattagcctttcccggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccgggcgcacgggcggcggttcacgcgaacggacggccgagatctaaccgatccaagatggacggccgagatcgatcgggtccacagcggctcacggcggacgaccccgatgacgtcagcaatgacgtcaccgacagcggcggcggctccgcggagcggacggcgcacgctcgccggcgaacggcggcgcgagaacgca

SEQ ID NO: 65921 - DNA, 638 bp, Oryza sativa
tcgcttcaatagtgccgcgtagtaatatgcgaccaccaccaaaaaatagcaagaaatttatttgagattaaaaatcaatatgataaataatgataaaatccagattgagtttccccccgactgatttggatcaagtcagagaaaaggagcttgaagaagtggtcgacggaaagaaagtgaaaactccaaaagcgaaagcgaagtcggcgactcatgaaattgattccatcgtgctcgttgataggaaactcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggaattgaatccgcccttttagaccaaggagaatttaacaaaaattctccggaccacattcgaatttttctggcatgtattttagtgtttgtcaatttcttttcgaattttaattaattctattattccttttagaaaatgatttttattttgggatgaatttatcaggacgtgacaaatccaccccccttacaggaatctagtccctgagattcgaggagcctagcaa

SEQ ID NO: 65922 - DNA, 2639 bp, Oryza sativa
ctgtcacctttagtttgtcaaagtttattagggtctatgactggagatatatccttaaatcaatgtcatggttgtaaacttggtaaacagatacaacttccctatcatcctagtgagtttgtgtacaagcatccttttgttcttggttattctgatgtttggggccctgctccctttacttcaatacggggtcatcactactatatctgtcggagatatgggcctgggggtatgcaaagtgaggggatgttaccttcccatccagccacgtgactctatagcctggccctccccccgcgcctcgcgagtcgcagaagcagccggggggcctcggggtgccacgtcacgcccttcgggccctcgcgctgcctcgccccaaggccctcgcccaactgtcatgtggcggggggagcgtgcgggaaggagacctaggctgaaccgccatcaatgcgcgcggcgccccaactgtccctcaccgcgtttaatgctgtaagggcagacgtgtggtgccgtccgactaacccacgtcaatcgagtgtgaccagactgtgacaggcctgtcaccggtcacgtccgattggatgggtggtcgtgcccccacgttcgcctctgtcttcagcggagtggaggcaggtatgtcccgtcccatcggagcattatccggagttccctccacgtgaggaggaccgccacaagtcttcactcatttaagaaggaatgacagggttgtcccctgtgtcaggcggggggcggcgctaggtcccactcaaggacggactgctcttagcttccgggcgaaggcacggatcatggtccagtcaaggtaaagtgggtccccctcccgtcaaagagtaagtggaagcggcgcatgtggtatccccttgaattacaaaaggaggaccttgcccaccgagaaaagggacgacactcagtaggcctgagctctagaaggagaagatcaagagcgctctccggagttcaggaacctttgtaacactcaaccataaatcccacacacaggagtagggtattacgctccatagcgtcctgaacctatataatcttgtcgcccatacgcgatctagaaaccctcagggaggatacacgatctcgagaggcaaaccctttcccccggccgaactcacaaaaggctagagaggatcacttctcgacagctggcgcaccaggtggcgcttcaaagagaagtcgttttcttccgccccaagtattcctccggcctcgacgatcatggtcgaggtcttgaaggaagaagtggtggtgcacacccccactcccttcgggagtgaggatgctagcgggagccgcggcccccatcaccgtcgccgcaactctcggactccgccccgccgcgacccctcgcggagggaggatcccacccggtcgggtggctcagccctctccccgcctccgggcagggggaagccatggcgcatcggagcgcgacaccgcctgacatacggcgacagcggctcgccccgaggcgcgcttcggacagcgggagcccttctacggcatcctcccgtgaactcggagccggagacccccgtcaggcgatggttggacgacgtcgccaacctggtcaccactacccagcggtagctggctgtgggtggccgttccaccgccactggtatgtcacgcacccccccaccatttcctcatcggtgaaaaggagcgcccgtcggtcagccatgacctcgaggcggtccacggccccaacatcgtcgggggcctcgggaaatcagaggcatcacgatggcctctacggggagcaggacgctcggatcaacatcgagcgacgccaggacgagcgccgtgctgcccgcatgggagaaggcgcatcctcctccagagtgtagtgttcctccttgcgaggcggcccgccccccacgttcacccctggatggactggttgtaggggcttcgttgtgagtctccagaacgtccggtggcccccgaagtttcgtcccaacctcacggagaagtatgatggcagcattaatccctccgagttcctccagatctacaccacgatcatcacggcagtgggggggcgatgaacgggtcatggcgaattacttccccatggccttcaacggtcaggcgcgcggctggctgatgccccagccccccgactccatccactcctgggtggacctgtgccagcagttttcatcacgaacttccagggcacgtacccccgcctaggagaggaggcagagctgcatactgtgcaatggaaggacgatgagtccctccgctcgtacatacaacgcttctgccaggtccgcaacactattccatgcattccggcccacgcggtcgtttatgcatttcggaatggcgtgcggcacaaccgcatgctagagaagattgcctccaaggagcccatgaccactgccgagctcttcgagctggcagacaaggtggcgcggaaggaggaggcatgggcctgaaactcgcccagcaccgatgacgagggccacgtcctaagcgacgagataggaggggaaaaaggaagccggcccgctccgatgacgagggccacgtccttgcggccgatgggccctcacggctcccgcgcaaggaaaaagccaccggcgacaagccgagctcca

SEQ ID NO: 65923 - DNA, 4874 bp, Oryza sativa
gccataatactactgcggtagatccaagcctacttgtgaattatcatatagtaataaggctgttcttgctaatgtttacaaggaaccatgtacaggactatgcacacaaatacattaagctgattgagttacattggcaatttatattcaggtaccaacatagatgtcatggtggatgcactagttactctagggtgttacaaatgaatggcagcatctttatatccatttataggtgtatcattttgacatattaatttggtactatatgatcagattcaacacagaaattctcaacgcgactgaatttggtgatcagagtgtaactcaatgtccagaagtttttgaggaaaaacgaagtgaacaagcatcaagtatgtcaattcgcaaaacaattttgttttatttttgtctattagtattgacaagatatagttttttaatcaatcagtcagaagcctgaacctggatcaactagttgttaatgatattggaaaaggagcagtgttgactttttcacagatattggctgctacaaacaatttttcagggagatccttaattggacaaggtggatttgggcctgtttacaaggtactccgtagttctcttcaaaagtaaaccttaggagttaggatgaagaaaatcctgaacttttgaagaaatagtaatattagaattctaaatttgcagttcttacactcgctggatcaaatgaaaaatttttcagccaataattttaatctcacccacataactaatctttctataatatttttttccataacagcagtacataaataatgcggataggatattttgaaaaatttcagctcctcccatgatcttgctttagaacatgttgtcatgtcagcttcttgtaacatgtataacatccaggaatgctttttatggcattatctagaaaatctatgaatgctttgaatatgcgcatatctgaatattttgatttacaatgcttagatgtgctttattaatctgaatttaaactttctcagggaaaacttcccaatggacttgagattgctgtcaaaaggcatgatacttcttcacatcaaggtgaagaagagttcatggctgagattgacgtcataccaaaacttcgacgaaaaaatataattgagctgattgggttttgtgttcaaggcaaagaatgtattcttgtctatgaatacattccaaatggaagtttggcttctaccattagcggcaagttttctattttgactaagaccaatgcctccatttttttttctctaaatgatatctggtatttttgtagatgaaacaaaaaggatattgctaaattggtctaagcgccttaaaataattgaaggaatctcagatggtcttctttacctacacaaccattctcccaagtgcattgtccatagggacataaaagcaagtaatatcctcttagattatgaaatgaatgctaagatttctgattttggtctggccataaaattagctccgaaagcaactacagaggtgcttgttcgtggcacatggtagatactctcccagtctccctatactgtaaactagttagagatgcaactctcatctttcccttgataagtgtagctacaggtgcactgctgtgacgatctactgtcatctttcaggggttatgccgatcctgaatatgttgctactggagtaatctcggagaaaaccgacgtttatagctttggcattgtactgcttgagataataagtggaaagttgtgtgtatctggatataatgtgaagagcagatctcgacgaacaatatttcctgaatttgtaagtattccataactgcacctctatttttatcaatgttctaagggtgaatggtggtatcttcttattagaaaatgtgaaaatggtactactctctggtagtgtggttgataaattccaacctgagagcgccaactgtgaatagggaaacgtggcgcggtgggatgagagggcgaggcgagaggggcgacctggctggcgacgggccgaccaccgcggctgtcacctccggcggccgctccagtgccctcaccattgacttgccgcctctcctcccttctccggcaggtatctccaagctgcgcctcccttctccagcccgggctcttaacctctctcaagttcgaccaggtgaagctttccaaaacctcatccttcatctcttccactgccctgttacccctatcgccactacccttggcccgtcaaaaatcatcccaactcctatttggctttgcgctgctccctctaagccgctcaactcgctctatgtcaaaaatgctcttaatttctggttcagttcttcgttttcgtctttctctgtttcttctttgggttttggtttgtttctttctcatgttgcgaacaaagatgtggctacctcgttgtttcttgcgggttcgtctgttcttaagtctgctggtttgtccatccatttgaccaaagattcagctgcaaaggatattcaagaaaatgttacccggttcttggttcagtttgaaggcagttcgtccgttccctctctggtgggtgaaaaagttgttcccgcgcttcaaacagttaagccagcctttactgcaacgtcacgtcatattggatgctcccaacaatccagcaagacctctaccccctctgtgccgacaggccctgcattgaagtctgtttactgccctgtaacaaactccttcagagacgctctcctctcacagccaaaacctaaaccccccgctcgctcagccacttctcgccttcctagcaggggcagaaaaaacctcaccatgctcaaccgatgctttcgctgccttggttctgatcatcaggtcaaagattgccgggatcccttgatttgcgcatcctgccgtcgagcaggtcacaggcaagattcttggcggtcatctatggcttccaacatctcccctcgccgctcatcttcctccttccacccatccacagcaaactccacctcccgcttcactacccgctgggtcaggcgtgctctaaacactccagccccacctccgcctcgcttacctactgccccataccctcgatccaaccacagctccccccctccagataacctagccattgttccttatgttcctcctctgactcatgtggatgcgcagctggaagatgtgattgccatgttggagagcagtctttgttcctctccggtcagatctgttactgctggacctctggtccccatggaggttagtgagaatgcggtcacttcttctgttgcttctcctttaccggacgtaagaaatgccctagtctgtgtgcaagatagttcaatctcagtggctgccttagttccagttcttgcatgtgctgttaatgatctagagactgtctcaactgaagtggtacctgcgactgtttccttggtgtctgttatgcctacaagagctgctgcggttgctgaagttgctcatgctactgttgagtccgttgttgttccgtcctctgtcagcgaagatctctcgccagcggtcaaccttagcagtatgccacctcgtctcagatgcaagaataaaggtttcctcgcttggtacggcgcctgtccatcttcgaggcagccaagctcggtccccccacaggaacctagggatatcttcgtctgttcggaacagttgtctgccaacccaattctgtctccacctcaggatcctgatagcacgagatcgccacctccgacattgagtggcccctcagctgctgagcaaatcagaagagctctagcaggtctaagtccagaaggatctattcactctgcttcactctctccaggtcgggtgccagtcattacttccaatgacactactgctgcgcaggactttgcttttggggaaccagatccagttaacatatcaggagacagtgacgatgatattcttgatatctttatcccctttgttgacatgagagtaactgctcattacgccactgcttatgttacccctccatgtgaatgccctggcagagtaattcgaaaagcaatgcaggatgctcaccctcgttttcagttcactctcatctcagcttgtagaggtgcaatgactctaagatttattcacagtcaggacagagactttgcagttgatcaccaggagaatcttacagctgaaggccacttggttaggcttgaacggcctgaggacagtgcggctcgcttcattcaacacaacactatgctgtccgaactagactgtattgacttcccgccagagatgttgttccctaacaagataagaaatgcttttgaaaattacggcgagctgatggaagtagatgatcaatgcctctatggggacgaacaatcctctctgcgtcttgttgttctgcactatcctggcaagaggatgagccctagatttcggctgcgctacaatttggggattgtctgcactgtctatgtcagggttctaagaacatgggagctggccatgaacgtggatgaagatggaaattacattaagcattatgaacagtttctattccctcatcagttggatcctccccgttcaggaccaactgttggaccagaggcagagttggacaacttgaatcaggctccttcaaatcaaatctctaacaaccaaggacttcagaacaggggaagattgcttgcgattctgcctgcagctagcactgtcttcattgaggaaatctctgatacacctgaaatttttgtccctccgtcaatccattctgctccctccagtatccatgactgcctccaggacctcgtgccctcagatactgaaaatgaacatgagctttcagcccggaaacgcagaaggcagaagaaacggacaattgattcagatgtcaag

SEQ ID NO: 65924 - DNA, 1147 bp, Oryza sativa
tattaagcctaattaatccgtcattagtaaatggttactgtagcatcatattgtcaaatcatattgtcaaattatgacgtctcttctaggcttttacaattatttctgataattccaattaaataacaatttatatttttgggatttttagggtgtaacaatattttcagccaaatagtgtccaaaagacagcacgcgctttcaacggtcgtcggaaatgtgcatccaccaactcctccaccagcaccatagccattctccacgacatcatctttctcacgccaagcatgcgggattgagcactgatggaaccacaaggatatgggtaaggaaaaccgcgtcactgcggtggaatggttggagaacacaatagtgtaaacattaatttctaccgtgagaaattaaaagatacagggaaagagttgaaataattctgcaactaataaacgacttgtagattggaaaagcatcacaaagctacaagagattaagaggcacgagttgttttcatgggagcacagaaaaagtcaaaaaccgatggtcgtctggttaaccatctccgtcaaagtatttatatcacattatgactggagaattttaagagaagtttcactaccatagaattgttaatcacatacgcgtgttaatgtcgaacatatatagtcacaaaaaatgggacggaaacgtcgtccccgtcttcagaacgtggggacagttttgtccgtgccatgtaaaaacatctcacaagtgccataccacgttcattgaccacatcgaatcaggattttatgactataatgtgtgtaccttatttattgaacgaggaactttatgactattgtcgatccggtcgccccgcttggccagggtgaccggcgacgggctcggtcaatgccggcgccactccacggacctggcaggggggtggctggcggcggcgatggtgacggatgtggcggcgaaaaagttggcgacgacggcagcggactgcggcgcgtgccgtgacgccttcctctatgacgccggcgacccgcactgcgcgctgcacctccaggtccgcgccaccctggccggatctggacggctggcggctggcgacggtggcggctgacggtggcgactggacgtggtgactgacggtggcggc

SEQ ID NO: 65925 - DNA, 1473 bp, Oryza sativa
atgagaaagatgctacaatagaaagaagaaaaagggaaaattacgaaggagaaaaaccaatctaccgcaaggagaagagatttttgccaagggaaagagaggggattggaggaagaataaataccaaacccagacattatactcttattagaatctcaggtacaccgttttgcaagttgagggactcatcatatttggtattgcagttcgaggatgagattcgaactcggcgatgatctaaactgaacttgttccaatttaaaaagttgtatacactttctgggccttacaaagtagacgggccagagtcacaccagcgtcagcgggcgaggcccaataagccccgtggcaaacaacgccacgtcactgcctgacactgtccaccacactaatgtgaacttattccatttaaatttcgttgtggatcagacatttggtgggccttattcggattccagcccagcaaatgatgggccccgcagtggattgactggggcccaaacatcatcgcctcttgccgtcgtctcgtcttttcctctgcggctgaactagtcgctgatccaaggccgtcgtccactcgccatcccaccggccaccgcctccgccgcctctcaccggcgccaccgcctcttaccagcgtcaccgctgctctgcctccaccgccttcttcctctccacaagccccggtcgcccagtacgcatcccacccgtcgcagtcgacctagctgcctggtggaggtggaggcgagggggattgactcggctccggtgctccgattgagcccgcaggcgaccgatctggagacggtccgctccgcttctcgccggaggctgtcacgaacccaggtaacatccccgccctaacctctgctgcttgcgctatgttcgatcgattagaagtttagaacacacgcagaactcaggccacatcgaatcgatcgctgttcacgagatgtgctaattaattccatcggatttttatgggactgcagccaatttagactaggaagcatgaggaggcgaccgggaatcgcgggtttacagaacgcggcggctactcgcgtatgtggacatcatcttgcttggatagcttataatgttttttcttttcctgtggatcctgagatgagtgtgctcttggaaaatttaaggaccaattccggctggttggggaaaatgtggccaaggtcaggaccgatgtaatgaaggagcagcttgccacatttcggacacaactcgaagaatttgcactcaagcataaggtgattcttactcctgtattctagttgagtttgacagaaaatcttatcgtcgctattcgtatgtcccaaattgaattacacatagtgttgtgaccttaggtcacgaacaagatcagggataggccggaaagaagtgttttcccgcctatccttagaaacgagctcgaacagtgaacacaacttttcaggattacttttgtattcaagatgt

SEQ ID NO: 65926 - DNA, 2431 bp, Oryza sativa
taggggacggcctggaactaataactagtagctagtactactttcgattttgtttcgtcacagtctgacgcctcacgagttgtatttactatacctttggttatgtcgtgcactcgtgtggtagtactgtatatatagccgtttatcctggagctaggagatcgactgactaggagacccgcgcggtcaactacacccgatcgatcgactggtcaactactaggagaccttcggctgtgttgggttgggaacctctcctccgcacgcaaaacagagcgataaattaatgcatgattaattaagttttagagataaaaaaaacttaaaaaatggattaatatgattttttaaaagcaactttcctatagaaattttttgcaaaacacagcgcgtggaaaacgagagatgagttgggaacttagtgaaaagaacacagccgaagtgttgtttgtggtccctcaattgagttcaattttttattttattttttgatcaagggaaaccagcacgagagtgtcattttcattaaatatagcgggaagctatacaatatacaagaggcggtataagctcactcatgcgctttgcagccgccagaacccacacacatgcttcttcttttattttggcgatcaggaaggacgtagcggccttcttatgctcaaagatccaccgattgtgctcctgccaaacttcccagacgatgaagaggataagggtatgcaaccccttcataggaatgcccacaattgttgctatcattttgcaccactcttggaccgtatgagtgtccccccagtgttgaggctcgagttattggtactccgcccaagaagctactaggctccagatccttttggtatatctgcattcagcgatgaggtgcatggctatttcatcctctcttcggtagagggggcactatccgttattttgccatcccctgatcgcaaggcggtcagaggtccataccctattcttaataataagccaagcatatagtttgcatttccccggtgcccatgctctccatatcaacgtgtcaaaaggtatgtcaggtgtagcgtggcagtgagctttgtaggccgaagatgctgaatattgtctgtgagttgtgaacttccaagaaatttgatcacactggaacgggatcgcttatctgtgacgggctgaaagcatcatcactatcgggtaaggcccccgtcactgggcaaaggtcactgatgtgaggaaaaatctcaatcgggctaaagcccgtcacggatggatgttatctcactcgggccgaaaacaaagcgcgtggaaaacaaagcccgaaaataaatatctatttttgcaggcgggaaaaaaaatagatccttctgtacataacttcgcatgcatattcacagctaaaaataacagcgcccgtaaaatttgtaattggctttgtgaaaaatcatttttctagtagcatcttacatttcacatttacgataaatccacatcatagacgtagacctattgacgtcttacgtctattgacgtctgcgacttgattgagaatagtcataaagttcctctttcaataaataagtacacacattatagtcagaaaatcctgattcgatgtggtcaatgaacgtggtatggcacttgtgagatgtttttacatggcacggacaaaaatgtccctacgttctgaagacggggacgacgtttccgtccattttttgtgactatatgttcgacatcaacacacacgtaagtgattaattaacaattctatggtagtgaaacttctcttagaaatctccagtcataatgtgatataaatactttgagatggttgaccagacgaccatcgttttatgacttttctgtgctcccatgaaaacaactcgtgcctcttaattaatctcttgtagctttgtgatgcttttccctgtatcttttgatttctcacggtagaaatcaatgtttacattgttgtgttctccaaacattccaccgcagtgacgcggttttccctatccatccttgtggttgttccatcaatcctcgatcatcccacatgcttggcgtgagagaaagagagagagatgatgtcaaggagaatgactatggtgctggtggtggagggatgtggtggatgcacatgcccgacgaccattgaaagcacgtgctgtcttttggaggtcccgttcttaataagtgttggatgaagattaatattttcatggcacgtttttcaaactaataaacggtgtacaaatatgtttcgtgcgaaaactttctatatgaatattgctctagaatatcgtattaacctatttttcaaatttgtactaattaaaactcaatcaatcatacattaataccagctcgttttgcgtaaaaaacttaatcttcatcttaatctttatctttaggataaaagaacactgcctat

SEQ ID NO: 65927 - DNA, 5955 bp, Oryza sativa
gaccttcgaggaaagactcgcacagccatcggcgcgggttggaccacccaagggacccccgcaccacggtttccgccccgacccctgacgacccacgggtctcggggcttgagggggtcgaccctgacccccctcgtcaggtcgtttggatgactgacattcgggcgtatcctcttcttgaggatggcacagaagatgagaagctcgcgcatatctctaagcggtatgtgctcgtagaagagaccctctaccggtgtgccgccaatgggatactcttgaagtgtatttctcgagagcaaggcatagagctcattgccgatgctcatcagggtgagtgcagggcccattcggcctcacgcacattggtttgtaaagccttccgacaaggtttttactggccgactgcattgcaagatgcccaagaatgggaccggcgatgcaaggcatgccaattccatgccaagcaaacccaccagccggcccaagccttgcaggtcatcccgctctcttggcctttcgcggtctgggggctggacatcctaggacccttcaaagcggcccgaggcgggtatcagcacctgtacgtcgctattgacaagtttaccaagtggcccgaggcttacccggtcgtcaagatagatgagcattccgccctcaagttcatcaggggcatcatgtcccggttcgaagtgcccaaccgcttcattatagataacaacacccagttcaccagtgagctgtttggcgactattcctgtcccggcgcatggagatgcctacccagcgcaccgcgcgctccagccgtttgatggcatcggagagttggccaggcccaaactcgtcgcgaggtggcggagggtcacaatctccccagcttggtcctacaccaggcgcccaggtcggcgagagtgtcttgagccgcggcaagctggctgaccaattccgccccgccgggctgcccgcctgccgccaactccttctcccgggcctccagctcggaagtcctcaccgccatcgccgcgcgctcaacacgggcgctctccagatgctgggcctcgtgcccagcaatggcctcctcacgcttggttagttgctcgcccagtcggcacgccgccacctcctcatgcctcggcctcgcgttcggcaagcgcggcctcccgttcctggcatgcgtcctctcgaagccgcagctcctccgcacggcgagccaccaaagcctctgcggtgagggtggtcaggttgcgcttggctgcggcctcctcacggaggcgaagggaggattccgcctcggccaccactctctcgtgggcggccaaggtggtctcgccatggtctagcatgcgcgctcgctcctccagcgcccgggcatgctcctctagcgcccgagcatgctcctccagctcccgggctcgctgcgcctgttcccggccgcgctcatcctgttcgcgctggttacggtcgaggagctcgatcagtcgacggatcgtggcctcgaactcctgcatggagcgggcatgctcgtctaaggccttgcactcggcctcgagcgccgccatccgagcccgcagcgaggcgtcgacctccgatgcccgctgctcttgggcggcagccgcgtcgaggtctccacatgcgtcttcgaccctcttcgccagatcctcggcgtgggcctcgtactgcaaggggatctcgcccagcgcctcttgcaggacgcttgaagcgatgatcgccgcctgccgctcctcctccgtctcccgtatgaccgagtgcagcatctgctcgcgcgactggatctctgccagttgggcttggcgcattttgcgccccacctccaccatgtcgtccatggcgtggcgcccctcgtcaacccgcgcgcagtccgccgcgagctgcgcccactccgcctccagggccgcccgctcgtccgtcagggcttgaacttgggcgttgacccctcccggacggtggaataggcggcggcgagcacctgcaggagtggctccatacccacgggagttggagaagaaaaagtcgcggtccgcccccgggacggcggagtgctgctggacccccgcgagactgggagctgttgtcacgtcctgataaaatcatcccaaaataaaaatcattttctaaaaggaataatagaattaattaaaattcgaaaagaaattgacaaacactaaaatacatgccagaaaaattcgaatgtggtccggagaatttttgttaaattctccttggtctaaaaggagccctcaaattttacttgaattttcagagcaccaaaaatatttattaaacaacaacaacaattatcaaagtttattaaaaagaaaaacctaaaaataaccctctccttccctttgggccaagtctggcccaaggtttctcccctctccctctcggcccgcggccgaagtccctctctcctccctctctttctctccctctccttatcttgggcctcctcttccccttccggcccactgcctcctctccacctcctcctgggctgcctctcccctccctccttcccgcccggcccaagccacgccacccagccacctggcccacgccgagccgctccccgcacgcgctgcgcgcgtgccgtcgtcttcctcctcccgcacggcctgctctctctctccccggaaacctagcgccaaacctccccaaaatccacgtgattcaaaccgggaattccaaaattgattagggggaattaatcccctttccctcctctctctttcccccttaattcccccttgaatggcgcccccaatcgccgggaacggacgtgccaactctggccaccttccatggccgccggccggcttttccgccaccgttccccgctcctcccgtggccggctccctccccacgcctataaaatggaatccccatccttcgttttatcgttttagccccttcccgagcttccccgtggtcgtatcacctctccccgccttctccttctctctctccggcgccggccagcctccagccgcctctccctcctcgcccgagcgccatccggtcgcgccgtcgctgccctcggcctcacagccgcctcctctcccccggtcagccctccgtttcgcggggaaatcaccggagacgtgtcctcgccggcaaaacagtggcgttgccgccactgtactgcctccagctgcccctgccgcgccactcaggtgcgggccggctgcgccgtctcctccctcggcgtcgccgcgtcgacctccaccccggcctgccctcggtttcaccggaacgccatcgcccgcgtcggtctcgccctccgcctcgccggagttcctccggcagccccgtccgccgtgccagtgcgccggccgatgtcgccgtctccacctccggcatcgcagcggcaaggtcgccctcggcctcgcctcccctccatccgaaccccgccggtgttcgttatcgtcgtctccgttcgtcctcgttgacgactcctccggtcggtcgttcctcctcgccggctcgtcgtctcgctgcgccgcctccgttgtcggattcgcagcggcgtgttccacgccgtcctcgtctccgtgcagctgctgctagctgtccctcgttgcctcctcgccggccccggtcgtcgtcgtcgtcctcctcccgtcgttcccggtcatcgtggcgttcgtccttccgtcaagccgttctcgtccgtcgtccgcatccgtcaagtgtgccgctgcagccccgtcgttgtcttcgtcctcgcctccgcgtcgtcaagccttgtgctggccgcgtctcgccttcatccaaggatcaccgccgaagtcgtcccctcgcctttcgtctccgtcgttcccggccgtctccgccgcgcccgttcgtcgttgtcgttccctcgcctcgtcgcgtagtggtaaggatccgtcctctcgctgccccgtccttgtcctttcgttgtcgccccgtacccgttgtgcggttgtcgaccccggtacccgtgtaccggtgtcggtagtcgttcacgtgtgcgggtggtgaccgtgtagtgtccgtgttagtgtgcccgcttggtagccgcgttgtttccacgtgtgcagcccgcgtggtgtttagtggagtccgtttgtcggccactcgcctcggttgacacatggggtccgcttccgtcgacccgtggaccgtctctgtgtactcggtctaccgtggtcctttaggttgacatgtggggtccgcatgtcaacagcgcagccttcctgtcttttccaggctagcgcttccacatgttttatagttgaaaaacctaattataataatccgcaaatctccatataacagcactaaacttcggatgatcatatcttggtcatacgaactctgaatcaacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgcggtcgtcgccaaaggttcggaaggccgttctctttgagcaaggcaagtcacatcatccttgagcatattgaatcccagtttataaaattattttgatttaaattaatgcattaccgctttatttaaattcccgcgttatcgctgttttatttagccatgcctatttacctttgttaagacattattattgctattgttattattatcttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctatttttcggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggctcggtagtcgagatgtcatggcacagggctggtgtcgtgatgctaggggctcaatcctgcctgcctgtcccaggggttccggccgttggtggggttgggtcggtactcttgtttatagctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgcttaacaactaaaatgtggaatggttggcctgggttggcttgggacgagctgggacccaaggtcgggttgccagttcggtctgagtcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattattaccccttgtatccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatggagccgtaggcccgctagtccgctgctgtttatctttgattgtcaggc

SEQ ID NO: 65928 - DNA, 1061 bp, Oryza sativa
ccttctcctctcaacattgtttatcccaactcttttctttcttctttgtagagtttgtgtgtaacttgttataccttcttaacatcaaataaacccttcctttcttcttttctttataaacgctctttatttcaattgttcaagcacccttaggtaaactacgtcctccttatctttggaagaagttacgaaatcgaaacgtactttatctcgtcacgtgcattttccgccttttgagctcgagcgaagggaaaatagagttcgagcattctttagttggtttttttggactaaggcaaaatagttcgaaaaccaccgtcctcctcacctttcgaaggagtgacgaggtcgaaacgtattttacctcgtcacgcggattctccgctttttgagctcgaacgagaatagagttcgagcattctttagttggttttttggactaaggcaaaatagttcgaaaaccgccgtcctcctcacctttcgaaggagtgacgaggtcgaaacgtattttacctcgtcacgcggattctccgctttttgagctcgaacgagaatagagttcgagcattctttagttggttttttggactaaggcaaaatagttcaaaaaccgccgtcctcctcacctttcgaaggagtgacgaggtcgaaacgtattttacctcgtcacgcggattctccgctttttgagctcgaacaagaatagagttcgagcattcctgagctcgttttagggctaaggcaaagtagttcgaaaaccgccgtcctcctcacctttcgaagaagtgacgaggtcgaaatttgctagtcgaaagtatctgactcctagcgtgaggagttatattttgtggactttgatagtcgaatgtatttgactccgagcgtgcggagttctattttgtggactttgtcagtagaatgtatttgactcagagcgtgcggagttctattttgtggactttgctagtggagagtatttaactccgagcgtgggcagttctattttgtcgaactttgctagtggagactatttgactccgagcgtgcggagttctattttg

SEQ ID NO: 65929 - DNA, 1209 bp, Oryza sativa
cttgctgttgttcccccttttcagaagtgtagtgcttctgagctgaagacaaagttagaagaccaaggctcagaccccagttgagttttgcctgtggagtggagctgaagccccgctaggatcgcctttttccgctgctgtcgttctctttcggtgtgaggactaagtgcctcttctgtaagtatttacgctttatttacgtttggaactgtttattacttatcgtttatgtaccatggctggtcctggacagggatttaatacacaaaatagtctggaaatttgggctaaatttctaggcgttacaaagtggtattagagccaactcgactgtaggttgagccaaatggtcaaatcctaaggacaagttttctgaaaaccctagttgtgaaatgtctcctctcttcctccggcatttctttgtgaaacggtttctcaaaattctcctccctgcctctccaattcttttagttgaaaaaccaagaggacaaaccgccagcttcatgtatgttcagaagtcaagtcaagtcaagcctcaagcttcgtgctggagcaagaagatcggtcagcccagagtcttcgttctgcgaaggtcaagtgaagtttctcccggagctgacctaaaatccaatctttcccggaatagtagtttcgttagcttttagatcgtgtgttgtttgcttgtgtgtaggggtatggtttgcatcattggtggggatgcaaccatactaggttgtttgcttaagcaacttgaacaatataagtctactcacaacagatcagtaggcaagtggtttagtaccttatctttagcaacccccctcttctatctctcttccatcctggcagctgatggtctctttagcaacccccctcttctatctctcttccatcctggtagctgatggtcagtgtcagagagaagatcaacatcaacaacggtgcattaaattcatagatcaatgggtcagttgaaagcaacaaggtaccccaaagccagaagaacccctgctcgtgatcaacatttggtatccaagatcagatgatgggtgtattgatgtaggagatgcaaagctcgacgcaaggtaaaatataagcggaagtaaccccagcattgtgttgaggtcagagctactggatcagttcaagacaacaagcaactagctgagtcagagcacctcgctctggtcagattctggttagccaagg

SEQ ID NO: 65930 - DNA, 4166 bp, Oryza sativa
tttggacacctttcgcttccctggcgggtcgccggccgagtctccccccggcccacggctcggaccgggtgccctagagccgccgcccccaacggagccgccggtccgactgccgcctgcggtcgcgccgctgctacctgggccgtcccgccaccactggcgccgccccggcgggacagacccctgctagcaccgactgccgacatcacagccaggatactctaccggtcgcgggcgctgcagatgaggaggatcctgtcacgaatcagcgtttcctcttcaccccagtcccagcgctcacccacgtgggtgcgcatgggatcgttgtgcccgacatactcccacgcgccgcgggaccgctcctggagaggcgcgatgcgacgtcggaagtagtcgccgaacaccatcgcccccgttaagccctggcttcgcaggcccctgaggtggtcccgcactgcgtcgtactcctcgcccatcttttctagaataagtgaccactttaaagtattacttatcttattaatttaccactcatttaatttttttggtcttgcctcaattatacttctatgcaaacacctattatttaatagggtaaattcgatccatgctattgtaattttgccatattaaaaaaataattattacctccctcataatttagacaaaaatttctccttgatcggagctatcagaccctaaaaagctaaatcggctagctgagaatcggtcagagccaaactgtagcacctattcctcatctctctgaatctctgaatgtaatccagcacagattcatcatgcctttgtctgattgctgtcaggtcagataatttcatctcacggatcccactgtaaaaataactgtgaagctgtttctccaaatcggcccaactattgacagagttgtatggcaaagaagaaaaccaagtgaatgccgatccggataaggacaaaggaaacaatctaacccttaaagcatcaacagccgatgcctcaccacattgtcttgtcctgagaattttgaaaaacctggaacttcgtatcggttaggtaatggaaccctctcaaaccactcagggtacggatgccgatacaagtttccagtatccttcggcttaagcccaaactgctccctcatcacatctgcaatcataacggcccattgtctctgctgaggcaccccttgcgcttgttgttgtatcggctcaaactggttgaacctaggagcatactgaggctgaggcgatcccccctgttgatagtgaacatgaggtgaagggggctggtattgataattcaagttactcccttggtagttctggacattcggctgaatattacgcactaactgctcagggataacttgggcagcaaccgattgtccggttgtacaacgtgtaccagatgctcagggatgacttgagtcacattctgacgcgactgccgattatcaggcgtcctcaacccagtcggcatctactggaccgtcttttgctggatcggctgagttgtctgctgttgaatcggctgacctatctgctgccttggtggcgtgtgctgaatggatccaccagtcggctgagttggcaaaaacattgaagcaatttgctcttgagaccgccgattgatattctgaccagcatgttgcggttgttctctagacaagaggcaaggattactaattatttgccttggtgccaatgacggtgcagctggtgctggagtcgaagctgatgccatcggctggattgatggtgcattggtagcagactgttggttaccagttaccaattttctgtaatttgggaaaacgtctcctggaagataaactggccctataacttggtgctcagctattgtaccatcaaccacatactttaccatttttgtgaaggtattgaccaggactcctgattggttgatcaaagcatgttgcactgcgtagtcaatccgatcttggaagttgttaaattgcggttgcacttcgttgttatcttcaccaagatcctcaaccactccatcttgaaggccgtcacctttcttgcctgagccatcggcaatgcctttatcgccttgggatgagcttgatccaacttcgtcggcagtaactacttttactttgtacttttggtaaactttcccacgggtttctacgaacgacttcatgaattgctcctgagcgctcttcatcattaattcaaaatccttcctttgttctggtgacagcttatctatagtgactggaacaatgttcccttcattaacgtcggacccaatcggttttggaatcttgatttgagggtctgatgacatgcccgtcgatgatagaggtggcttttctgctgacatgtttgtcgtgtcccaccaggcttgccaaaagcgtgttgatgcgaaaaacacacactggcctggaagatcagcttaacttcagtgcaggtacaaaaatcttgcctttaggttcatgagcgtgccaattgatttgatcctgcaatcaacaagaaataaagacaggaaaatagtggttaaatctataaacgatagccgatcggccagtcgccgatgacgtatcatttatcttttagccaatgtcatatttgagtcgatcgacagttgtaaataggcaagaaagaactaaatatattcgatcggctaaagatattaatagtatataatacttccgtcgatatatacttaactcaagtgattgggatagatcggtcgccatgccgagacagtataaatcacttagattgaaatatatattaacaagaagattataaccattcatagcatagccgatcagatagatccagcatgtatcgactaatactccgatactactccatattgatatatctaaatgcgacaagatcttaacataaagggcggatttaacatgtcaatgaagcatataagatatagagtagttaaatcggctgaaaccccgatgaaaccttattcggcaaccaaaagcaggctagagattgagattctaatcacgacttataaggtcaaactcaactaatgcagctataagtatgaaaagaaggacaatatctagacaatcaagcagttggatgtttcataggatggtggataccctatataatctaagtcaatattggtatttaacctaatcggctgcctttcaatgatagatgttagccgattgaaggttaaataacgatattgtcagatattagataggatatatgataactcgacgaattacataaacaagattagagtatcataaagatggaaacagtaatcccgagaacgcatgccgccataacaagttttacctctagttgaagatcgaaaccgatgcagctcaacccgaaagcaagaactcgtcaaaagtaaacgaaagtaaaagggtggcgatgcgccaagattgttattgaacgtgtgttgtttgattacatgggttcgggtcatatttatacccgagatacaaaatacgtccttgtcggacacgactattatctctaacaaactccaagataccataagtctttgcggcagacttttgcccaaacttatctctaaggaaattacataaatatcctaatttgtagatacaattgccttttcaggactcaatccgtgcgtggcaatccctatgaagcatattaactcaacccgacaacgtgtaccgagtcacattgtcggaatcggctcaatcagctacctagttcgactcgaactctgctgatcctgatcgtagccgatttagactttagccgattcttgctctatttccggaacaatctctatcttggattctacttcgattttatctccatctccgatacctaaattaccatatttggtcgttaacacccctcttcggctaccatctccccttcgcttccaccttccttccgcttgaaaactctctccttgacgatcttcttcggtggcatctgtggtttcgctcggagctccccacggtcagcgctagctgttgtcgaatggacaactgtgtcacatcgaaaggcgtggttatctcaacagtggttggaaaagaaagacaattgtattacttagtaaaattttttggatccccctattacatggccttagggggctatttataatcctattacaggctcccccctttagggttttggttttacgggggaatttacatggttacc

SEQ ID NO: 65931 - DNA, 1151 bp, Oryza sativa
aaaattaagttaaaacatgtacatatacatatacaatggtcccaagtctaaattcaaaacataaacatatatacatcgttatgtgagaggtagtgactcaagtcgtgaaactcgctaatttgttaagctcatgaagttgctaagtcgttaagcacgtgaaacacgctaagtcgttaagctcgtgaagtcgctaagtcgttaagcaactcatgtaaatcgttcattcgcgtccgtgaaactcgctaagtcattaaactcatgaaactccttcgttcgttaattcattcgttaaactcgctaagccgttaaactcgttgaagttgctaactcgtgaaacttgtttgttcatttgcctgcgttcgaccgttcgttcgcgtgcgttcgttcattcgcttacgttcatttgttcatttgttgttctaacactcatgtacgttcgtggttcgttcgttcatgttcatgcgttcatttgcattcggtcgttcattgttcgtagtcccggcagttgcagccctcggcgtcggccgtggtggcgacagtggcggcaacatcaatagcagcggcgtcagcggcgtcagcatcagtagtgcagaggcagtggttgcccgcgtgcccgcacaagtgacgtcggcgtcggcagcaactgcggtggaaggccgcgggggcaacgggagattgcgacaacgatgatgatgaccgcggcgcttgtggttattgtggccgtcgtccgggcgagaaaaagagagaggaaggaaagagagagtgggacaccgggatccggtggcgcccacaccttgagggaggcgacaatggtgagagcggcgtaggtcagctgctgcaacaatgacgatggcagcggtggcagcggctcgggcggcagtgtactcggcggagatggcgcgcaaccgagattgagatcgagaaactgctaagtgttgtgcacggggaagccgatggacccatatttatagtccgggatctttagtcccggttcgtggttctaactgggactaaagatataaaccgggacaaaacatattttctcgctattccgaaattttatctttagtcccagctaaggttaataaccgggactaatatttgaacatttgtacattttagtgcttacaaacttaaacgggccaaattaa

SEQ ID NO: 65932 - DNA, 4930 bp, Oryza sativa
caccgccgcctgtcccacgccctcatctgcccggccgcctcactgaagaagagagctgacttgtgggtcccacgtactttttaaattttttttgttgactaggatgccacgtcagcaaaactgggcaaaaatactgccgagggacctccggtaaacggtttgagagagtttaggggtacacatttctggttttgtggttaagggacctcaaaaaatctcgttgttaagttggggatctctggtgaacttattccgagaataaatggtgaaacaaggcccaagatgagtagtttaaagcttctttaattttttgaatacatatatgaagtatagagtacatatacgtattttttgtccaaaaatcttgggtatacatctgaatatccttgaatcactagtgggcccacccctgctaatatgtagaatgagatctgttttattcaaatagcaatgtttcatagaaaattggtttaacgatttcgtaagcttttgaaataatttatttttggatggtacgctttaagcacagtttctgcaatccagtcctcaagaaaaactttagactgtaactaaaattgaatctcatcacagcttactttggaagggatttgtttttgaagaactttgaaaacaaaacttgaaagaaatcttttagtttgtaatctgtataacgaaattccagtaaaactatttgaggtgggttttgttatagtctctaaagctcacttttgaaaatagttctctttttacaagcagcaaaaagatataaacccttttttggagggatattccgaagaaacacctgaatcatttttcacactttggttttggtaggttaatttggaatagcatttgaaatcattttctcatgagaaagcacacgtttcgccgaactcacagagttaagttggagatagcgaccgcccgtccggaactcagcaaggtaacgggacgtcttctccatcaactcgttcatctggcaagctgtgtcggatggattgcctgaagtttctacaatgggtatagtacacttttctcagaaaaagcaaagaaagaagaaaatacatcaagagaaagcaaaggagaatatgacctctattaggagtctaatcatccttaccttcttgatgcttttgagtcgaggatcccggagctgaagcggcatcagccgccggcatcaccggagaagagcggacaggagcattagcagccggcacaactgaaggtacatcgtcaataggtaccggagcaacatcggaagaggcagtagctttaagtccacccaatgcagttgcctgctctatagtatcctgagttgcaagtatgttctaagagacaggttatcaaaccactatgacaaagaattttaagagaaaaaaaaagaattggggaaacacggataccttgctagtgccatcagaagaagaagaagaggaggaggagtcactcaactggacagcatcaagctccgtgtcgggaaccacagagcggcggcggcggcgacgatcatcgcttgaagactccgtggatgataccctctcataaactacggggttttttcctcgcttctcacgcatggtgcggtccagctcggggtgtggagaatcttcaatacgcagaccctttttagaagatttcggcaatggaagtctgttaggacgagcagttctctccttcttatgacgccagtcacgcaggaattcgattgactcgccgtggcgtttgtatcctcctcgatcatctctatggaccgggatcttcgtgatatgctgggaagggtcgtcacccttggtctccttctgttgcttgccgccggatcctcccgggcgcttatcttcgacagtgtgtctatctcctgccgagcgcctgtctcatgttactcgcctgtcccccgttctccgcccgtctcgtgggacacgctctccgccgccccggtcgctggcgccacgctcgcctgcaaccctggatactccgtcttccctggccctctcaagatggttgcctgatgaaaaagtacaggatgatcaagaagcatcctaattccggtggctaaagaatcgacaatggatatatacctgcgatggagttaaacacctgaggcgccatattgcataatcgatgcacaggcatgaccagcaatatataggcttcatccaaattactcgtaactgccaaggatttggagtcctggccgatgacggtctagctttgtttttctttcaacgcacggccggagataagcttcaacatgggagtcctttcgtcgcatgactaaactctaccggacatgtatcgcatgagccgacacgacaccaagttaatttcgctcgctccacgatcaaaatttacttggtggggggcatgtgtttgatggtattttggcgattatatgtgtacacaagacttactcatgatggacaaagcaaacaagcagtttgtaagttggctagcttatcatttctacacaatgctcggccatgtatatacacgcaaataaatgcatgcacaggcagctgggaatatatatacttggattagtatatgtgcatgtataattaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcatgggctcggcccatggccgaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagtagagaaacaaagcgaattacaaatcagatatttgacgctaggagaagctaagagataaaatcaaagaaggatatgaacaaatacaaattgatcgatcaagccttatctacaacgaacttgacgcggagcaaacggcgtgcggacgtggcgagcacagacctcagacccctatataaggcgtcgacccctcggcagctaggggcattcacgaactcatccacacattcattcaccaacgcatctagcatccacaagccacccatcatcaacgcatctacccatccagcatcaacacatccatccatcaactctcatcggcgatccatccatcgacgacacgcaccggcggcggcgagcgacttcggccggagtcccggcgtccggcaggagagggcacgcgcggtgatccgatcatcagcaagcgcaggagaggagcttgatggctagtccaggtaaaagctagcaagattgtttcgttttctttcatctacagcacgcacaaatccatgcatagggatccatctgcgcgtatcgtcgtcgccggggaacttgcggtggccgattcatctacgcgtcacagaagcctcatcgatgccggcgtctgttcaagccgacgtagtgctacttgtccctagactcgacgctgctaattcaagccgctggtgatgcatctacccgaagctgcgacctcgccgagataccagacatccttgatttgcaagcttcaccgcactggagcgggctaaccatggaggaggtcgtcgggaagccgccctgccggagcgcgccgaggatcgccggagctgccgccgactgccaagacttctatcagttctcatgccggaggtcaagcatcacgcatagcgtcgaaaccagcggatgacgatggaggcaagtatggctgcagtacagaggaaggacgacgggaggacggtgagccagtgctgttggatggcaacaagctagctaatgcatgttgattaagtaaattattgtggcaacgtggccaaccaattggaggatgacatgtcatcgctgctacagtgccatgcacaaaccaatgcgtgggctgaagaagtcctgttggtttttcttatttgtcccaaatgagatgccgagctttgattaaatccggccgccgtctatatcaaccatcttcaataattcctccctgattcttctctaatctaatctcgacgcaactgctgtgacgtcaagtcgttcaagctatgcaactccatgcatgtcttcaccaacaatctacgtcgacacgttgttcaagaccgacgaggctagacgacggagggtgggcgaccaacaccagcgcacggaccgacgaggccatggatcgctgccggcgcttacacacacacacacacatctacatcatcatcacaaccatgcatggagaacgtgaagcggagacgacgagacgaccacaagcagcttaatcggaggttctcttgcaggcctagacctacggaggtaattaactgggagcttctcgaggccccaggaatcaggagaccatatcgcacaagtcagatctgtccaatgacagattatggagcgcgcatacatatatattacattgggaatttgtatttatgatcatttaagattaataaagagcatgttccctatgttttgtttacattgtgtatttaggtacactggcacgcccgcacatatatgtatctctaaacaaacgagatctcagatgttattttccaccctaaacagcatggtgatggggactttgggagttgcggcagatagtggcaccggtggtggggacttgggagctatatgccacctgttaatatttgttaatattgtggggatgggattccgtcaaataacattcgcttataatttattggaaacaagaagtgatatatctccaaccctctaccttctaagcaagtaaaatgacaaacaatttgttgagttatataatcacacaaaggcaggggccaatacaccataagctatgctgatttcgttaagaaccaatatgtagccactatacaatgtaat

SEQ ID NO: 65933 - DNA, 682 bp, Oryza sativa
attatgggaggatggaggaagtgtacgtacatgcctatgtgcgtgcacggggtgttcggaggatcagtctgcttttcatctaatctaaataggaaagagaaaaagaaaaaaaaatagatgtgcaaccggagtacgtacgtacgtttggttttttttaatacctatccacgtacttaatgggaaatttttacataaatctaatggttgaaaataatgggttcaccagattaaatgaaatcgatggttagatgctttacttttttttcttagaatttctataatttattagagtgcaacatggcggtgtaagagcgtttctagatatgccacgtggcagcttaggagtgtttataaaaagtttaatggacttttagtataaaatagattcagatgcaaagtagatcaagaaaagcccatatgtgaatccacgggttcgcacaatcgcacgggttatgaactagtagatcaagaaaagcccatatgtgaatccacgggttcgcacaatcgcacgggttaaggactgtactattattcataagagcacacgctttccttgaactgtctgattttccgaaccatttgtttgactcacagacaatcaaaagctactggataccaacaacgtgcaactgatatattgaaatagtagtactcctgtatttatccacacaattcaaggcag

SEQ ID NO: 65934 - DNA, 1162 bp, Oryza sativa
ggcgaattcgagctcggtaccctactagccaaatcactcggattaatccctaccgtccatccgcgtgcacgggttcgccaccgcatatactaatataaaaaggaggggttgtacccctccaatcctactagccaaatcactcggattaatccctaccgtccatccgcgcgcacgaatttaccaccgcacgattccacacgcaaacttcgctcctcctccacacgcgaagacttcgctcctcctcctccacgcgtggacttcgcttctcctcctgcatgtagcgccgccgcatcctcgccgtcgccggagctcctccccgcgcgtactgccaccgcatcctcgccggagccgctgcccacgccgacatcttctgctgccgccgccagatccggcttcttccctaccgttgcggccggatccgacctcggccccatccgccgccgccgccgaggtcggcccctcccgtccctgccgccggagtacatccatgtttccctcctcgctgtcgtccacaggctccgccaatgcaatggcctctaccttccctcgaccaccgtcttctggacaaaaaacattctttaagacctgtcaatatgaaaagtacttgccattgatgttctcattttttacaaccaccaaactataacagacaatgagaacccagaaacgacttaacataattttctgttctctgcactacgtcactaatgtgcacacataattaaataaacaacttgaagcaacttgttggagtcccaattaataagtgcggaactcactaccgatttcatatatatgcagcatttccgatcccttccttgctcatggcaaatctcatatactactcattgctcatcattcttcctttcctactcctgattaatttctacaaagctatgttcagctcccgcaagcaagccggacggcttccaccgtgcccatggcagctccctatcatgggtagtatacaccatttgatcggtgatctcccacaccgctccttacatgatctatcacgacggtatgggcctgtcatgttactcaagtttggacaggtaccattcattattgtttcttccccggaggctgccaaggatatcatgaagactcatgacagcatatttgcgatgagaccgcaaagcgagataatgaagatcattac

SEQ ID NO: 65935 - DNA, 588 bp, Oryza sativa
tgttattgttattatttccttgttcaccctagaataaacaaaaccccaactagtggacactctactcatggtaccactagtatgattttaggtagatgcttcgctgattaattaggcaacattaggtggttttacaactctagactttggaattttctcatcacctggacactatggaatggtttaattattgtggaattggattcacaccgctccctctattcaaaatccccaaaatggttttaggctgggctcggggtgcatggttttgatagtagcatctcggccgtgtaaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaagctacacgagctgcggccccgtagtcgagatgtcatgggacagggccggtgttctgctgctaggggcttaagtctgcctacctgtccggggggttccggccgtaggtgggattgggtcggtactcttggctatggcta

SEQ ID NO: 65936 - DNA, 1735 bp, Oryza sativa
caatgtcaagtgatgggctatgacgtgccaaagggaacaaaatttttactaaatctgtggtcgaactcaagagatccgacttattgggatgatccagaaacattcaaacctgagagattcaagaatgatgcaagatatttcaaaggaaatgactaggaattcattccatttggtgctgggagaaagtatgtcatttggtatgaattatatgatcgccaatatatgagctggctatgcaaaccttttattttattttgactgaagtcttcccgacggagttctacccaccgaattgaacattacaaaaaactttggatttactgtccagaagaaagaagatctcttgttgcatgcttctctatatgcacaactttcttgctgattatttccatggtgaataattcaatggttgtaattttaatgatttattattttgtcagtatcctcattgtttgaggctttgatgttgtggttttcttaagcagaatatacatctgctgcatatagtatgtttaaaaactaatatctgcaacagttcccatccgtccaaaatataagcatctttagtttagtttttttatggagattaaagtgaagtgaaaaaattacaatacatttaattaaaatacacacatatcattattataaagcccatctataacaggtcaaaagataaggacaagatttccttatagcctccacaaggagtatattcgactcggagaaacattcttaattaaaatggtcagtgtgttaggataaggacaagatctctttgtttgaagattgcactttgcaacagccgacacaccttgtggagtatttttcagatctttctcccagtcatttgtgatgttcatatgatgactttagactgaaattagagtgcccagatggtattattgaagcccctcaatgagaagtgataaaggaatggaaatgcgtttttgtttataatacttgacttgcagcaaccatggacgactgcagctcccataatgtgtttttattaaaatatttgatttgacttgcagcaaacattcacaaaactgcagtttaattgactgcaaaagaggcaaacctaaaccaagtgggagtccatctagttaatttggactacttaggtgaagtccttcatgtttgccgcaaattttatgggtagcctgttaatgtgtacatggacaggataaacttcctgtttttctaccatgtgacccatttgtacaaaacaagcattatgatggttttcataggactcattcattactaaagtacatgcatgcgccatgtcctcagggtatcgcaagtagagtggaaaattcaccacaaaaaatgattttcgatcacagttgattgggagtagatttatctcgtttttagcgcgcaagcttcccgaactactaaacggtacgttgtttgtaaaaattttctatatggaagttgttttaaaaatcatatatattatccaccttttacatttgaaataattaatactcaactaatcatgagctaatgtctcagctcattttgcgtagcttctgatcaatcttcttgttttcccttctctcaaacaatctattaaaactatacaggtggtttatgaggaacccatgcagtacgccaggtgccgtgtcaccgtttgcatgtgaaaatagccctactttcatcatctcgggtgactgcatccaaaaatattttggaagctgagaagcataagtcaactgcctagaaaata

SEQ ID NO: 65937 - DNA, 3514 bp, Oryza sativa
ggatttttgagagggaatagttctgcaccacaatagagtgcattaaatcaccctccaaatccctctctattctctcgtgggagggattaaacgaagaagattagctttaatcttttcttgcctaacaagctccaccgaataaaaaacatgatgagccctgacctgaaaggcacataactgaggatgggtagcatggctaaggctttgttttaagattaattaagtattagcctaaaaaacttgaaaaatagtttgatatgtttttttaaagcaacttttatatagaaagtttttataaaaaaatatatcatttagcagtttgaaaagcgtgaacgcagaaaacaagtaaaatgagttaggaaagaggggaaaagaacatagtctatgactagcagaggcatgagatggtaagcaactctcattatggaggacaatatgttggaagatgactgggtttattttgttctcaactctatggtacacatgaataaatacatctacttatctactcgatctatctagttattcccaacatccgttttagtcaaacctttgaaacctcatgatttttttaaagacttgaaacgcgtttgaaaatgatgtgtatatatttgtgttgaaaaatatatattttctacgatatcataattctattggatttataaatataatctatctatctatttatctatctttatacctctatactattgagcacattttttttactctcacgttaaccagaaaaatctgatgactactgattagattactcttattatgatgaccctagattaaatatctcacctaacgggtcaactttgaaggcccaatcaattcatataccaactcaacctctatgaataagggtcagtcctgagatttcggtggtctagggtcggtcctgagaagtgatatccatataaaaaaaatcaaacatattggccatttgtaggtgtgaaatcattgatgataagtatcactatcatctgtatttcttgaagtatctattttactccttaaattttaatttatccattgctcaattagcccaattactcgttctttttttaatgtatactttctcgaccacattatatccatacgggcaaattagtgaaagggaacattttaaagttgaactcatagcttaaggctatagaagtactgtattaattcagaaaaatataaccaacaattatattaaactcacaaatcgacatagtctgtactatttaattaatttgtatccctaatttatcaattgaccccttgtaattatgtaaaaaaaagataatctcgagctagatgacagattgagattgacagaaagctttgcgtacttaccaccgccaccgtcgaccttgtccctgccgccggctgttccctcggtcgcaagggatggggttctaattaatcgacgttccgatggtcaccctcgatcttgatggccagccaatggcgcagcttccgctttaggtcgccgagaacaccgcgctacgtatatacacgccttcctcgccagctactccaggactctgcctccagtactgctcctgctaccctcgcctcctacgcctgccgttgccaccatagactagcgtcgaagcgtagcaagaggattgcggccaagcttgcgctcgccggcccgagtgacatgaccttatgtgcgcagcacaatttgatgcgcaagcttgggttggtgcctgagaagggtcatgtgttggccgaggctgttacggcttacaacgccctcttctcccagcccctccctctggatcacgccatagccctatcttcactcttccccagctccctgcctccgacgcaggctggagtgtagtgggatccccaaccccaccatgcattgggataggagatttttcttttttagtagcttatcttctttgtatttgttttttttttcttttttcactactagaggacccctcttctatcccagttcgcaacctcctttacttccgggtaacgaaccaggagaaagaatccaggactaaagaagccagtctttagtccttgttcaaatacctgggagtaaagattcatctttagtcccggttggtgtggcaaagccacatcctggttggtcccttttttccattgtttctttactatttgctagggttaatccctgtatttcctccaaaatcaagtgggttgcatatcccaaatcaaaccctaaatccccaaatcaaattaacatcccaaatcattcacatcacaaatcccaaatcccaaatccaaattattcacaccacaaagcctaagttacttatacaaacaaattaaatacatcataaatccttaaaaaaattacacacaaatcaaatacaccacagattatacatctcagatccatgcaattaatcacaaattatatataaaaaaagaaactatacatcacaaattatcaaaaaaggaaaaaaaagggacgccgcttggccgcctagcatgcgtgctggccaccgctcgccatggccccgccggccgccgccgcctgccactggccgcctgccagcgcacggccgcgccggccgctggccgccggatgggaggagaggagggggaggagaggggagaggaggaggaggaagggtaaggaggagaggggagtggaggaagaggggatcggatctgagaggaggagaggagatgatccgatcttatctaaatactttgtctgggacttaaccgatcagatatgggagtaaatacggttgaagttaccaactgagactaaacataaatctaaatacctacattagtcccggttggtactaccaaccgggagtaaagatcctcagtcccttgacatgcctctgacatgggatgaaccgggactaaaaatgatctttagtcccggttggaaacatcgactgagactaaagatcagaatttttttaatcgggactaaatttagccccgattctttttggaaccgggattattgtagaaatcgcccgaccctcaaaagataacttctccagtagtgtttccttgacccctggcaacagccttattaccatgtgcgttgtgtaatcaaattttactctcatcttctaatatattgacgtacaatcctttttgccgggatcccagcaggcagcagtgccatgattggtgtttatatcagtggcgagatcgattcaagcattcagcccagcacagcggccagcaattgatgcggcaccggcgacaccaaacgtgctcatccagcacgtcgatcgtcgatataagtaagcatgcgggcatgcggctgatgtgctgcgcgcatggcgtcaccaaccagcacggcagtcgtcagatgagatcgatactcgcacgattgcaaaatcatggagcttaattaggaatgccccctcacgtgtctagcggcagaagatcgctaagtagtcacacacctaggaatcgggggccagagcggtcgccccgctcaggccaggcctatgataaggtcccatctcgattttccaggattgttgctacgagggga

SEQ ID NO: 65938 - DNA, 3568 bp, Oryza sativa
aattaaatagattaaactgactataagataaaattttcattggtaataacgaaggttttttgattttggaaagtatgggcttgtttggtacggctccaactcctaaatttagcttcatgagttgggtttggagtgaagttgtggagatgcctaaatccagctctataactctagtccattttatgatagagctccacccagctccacttctattttcggtggagctgaaactgtttgtctgagcttcagtagaggtggaggtggatttgtgccaaacaggtcatatatatatactagaaaatcggtgcgccggttggcgcacttgttttatagcccgtgtatattgtttatatattattaagatgcattactttcattctattaaacaggataacatcatgcaatgtgtacagttaaatatcaatatcttaaattattaaaatttgaaaatcatattagtagattttttatgaaaactctttttatatagttgtatttttattatctttgatatatgtatagtttgtgaaagttatgataaactttatgtattggagagtgtgtctaaattgacattattttgtttcccaaaaaaaagggcattcattttaagaatgtaggatacattttactgaattttataagaattagttcgattttcttgaaattcatgcaaaagctgaacaattaaataaacatttcattattttttttcaagtgcagtttaacttagcatatcacagtactatatggcaattttttaatttttctcttttcccatccatactatttagggttatttatttatgaaatgttataattgagttatctattagattataaaattggtgatgaattttttaagatgtttcatattttttttagagctgcgatgctcatcatttcttcctaacacgtactaacaattttccaaattttttttcccaaaaacatcacatcaaatctttgtacacatgcgtggagcattaaatattgatttaaaaaaaaaactaattgcacagttaggggataaatcgcgagattaatcttttgagcataattagtccatgattagctataagtgctacagtaaaccacatgtactaatgatggattaattaggatcaaaagattcgtctcgcggtttctaggcgagttatgaaattagtttttttattcttgtccgaaaaccccttccgacattcggtcaaacatccgatatgacacccaaatatttttttttcgcgaaagccctagtactccactgaagcctatacatctagcttaactatcctactgagtaactacggtaggtcagttgctatttttatagggaactatgtttattttattaagtgtcgaaacatgaattcggcaataataaaagggggtagcgcacgagacctaaaagtggatggatgtggagacaaaggattagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacagtagcccctgagaccttcacagtcgaaaagataatcttctctcgaaccagattactccaaagccgagtacttcaatcatctttgccatggtctcccgagtacttttaccaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaatcaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagctagtatgttgtgaataaagaaatttccaaagtattgggcatacgccatgcgcacactgctttaacagatgtgcttaagtccctagaagacacatggttccaccacacctggaaatatatgacatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttataggatgacgcatgtaacatgctcccgagtaataaatcttccgggtaatatagaccaagtgtagctcatatgaatagcttctgatctgagtgattatcccttatgggataccccaaaatagatataaaaattgaatcccgactggcgcaagtattcggttgataacccttacggagaataataaatagtccagtctttgagcatagaaaatagacccatgatcatgaattcatgttgcatgtaaccggaacaagtccaaattgaaggtatgatacttgtgtttgaactagtaagcctctgagcatatagcttgtccttctttgtagtcacaattgtccatcgatggtagctgacgcagttggcatagagacaagacgaccaatatagagataatattgcccaccagaggtggcaaaaatattggtggtagtgaagatagtgataccaatcaaaagtactgaagtcgcatagccatggaggcgaagaaaccagtcggcggcaaacagatcaactaacaatgaagatgaaggcgcccagcgataaagttgtgtagccatggcagcgaaataatcagtcggtgacagacgaggcagatcaaatgcgatgacgaaatccaccaatcatgaagatgaagaaaatagttgacgatgacaaacgcaaccgacatgatgaagatgacgatgtcgatgatccagtcaatagcagtgtagcaaccaatgctaatgacaaagacgctcatcagcatttgcatagtaggtcaaccgtgaaggtgaaataataagtcggtgaa

SEQ ID NO: 65939 - DNA, 869 bp, Oryza sativa
aaaatattgctgagagacgtctggtgaacggtttgagtgagtttaggggtaaacatttctggttttgtggttaagtaaccttaaaaaatctcgctgttaagttgagggacctctggtgaacttattcatttattctctattaggcccaaatttcccactcccctccccctttcatctcagcccgtactcagtttgggccgcaactcagcccatttttcctccccggctaacccaaatccccaaaccggccaaccctagacctagaggaatgagggggagaggggttggagcggggaggcgggcggcggtggccggcgattcgcggctttcacacggcgtgtggcggtggcgactgcggcgcggctcgtcggcgcgggcgtggcttggcgccagtgcggcaggaggcggcacgtcggcggcagctgcggcgtgcgcgtcggcggctggaggcggcgcgtcggcggctgcggcgtgcagttgccgacctgccgccgagatcagacaccgaccccgatcacgaccagaggtaggagcaggaccggtgggcgcgctagtccaccgaccactccttcagcatcaatgaccgcgaggagctccgtttcgtcctccttccccagctttcccacctcctctcttcctttctctcttgccaattgccaattggacataaggatctctcggtagagctaaacagaggaaacctgttgtgtggtgaaatggatctatgactgggaaggaaaacaaattgtcagggggaaattagtggccgattgacactggctaaaataataaatcttcggtttagacctcttggcatcactgtcacggacacctgtgaattgcattcttatcttcatacttgcaatgaa

SEQ ID NO: 65940 - DNA, 6144 bp, Oryza sativa
ccacattagtatatatggctaagacaatttcctggggagggtactcctccgtatttagcctcagttggacggccacgacaagttgtcgtaaggaacttggcaacccaaggtggtatctcgaagtaccagaagggcactgttagggggtattggccacacgattgtatactagcagatgtaaactaggatttgagtgtatgttagaagtataggaattgagtgctttctaaatattcttccacttagttagaattactttattatgaggatttgattagctttgcttcgtgtcactctacacttatattaaacttaacccctgcttagactttgacaattacaagtaatatatgcataaagtgcattagtaaagttcactcttattatcttcccttgggattaaaaatacgataccttgaaatacttccgggtgaaatgctacaatggtatatccgtgcacttgcgaattacttctgtaaccataaatataccaggactatttctagcgccattgctaggaaagaatatttctagtaatgtcgttaagaaataccaacaagcatttttggcgccgttgccggggaagattaataatgagatgactaagttaataactttatatatatagtacctctatatgagtccctgtcctttgcaggctaaccttgattgttttcacttgtgtcgtgaaaacaaggtagtgtattactggtttcaatttaccaaaatacattaacgagaatccagaggccttattctgcagcgtcaaacctcgtgtcatccctccatagaagagactctccgaaaagaaaccatccatccaagcgtcaccaagttttaggaacatggccgagaagacccttcgcgaattcgctgccccgtctgctgacaatgtgactgttggcccggctgtcaacatcggagacactattttggaccttaaatgcagcctggtaactatggcgcaggcaagcccattttgcggcaagccgaatgaggacgcaagcactcatctgcagcaattcttggagatctgtagcacttacacggtagaaggtgtcattccggacgccgtgaggctatgtctgttccctttctcactcttgggaaaggcaaagcagtggttctacgcgaactaggcgacagttaacacttgggatagatgctccaccgcgttcctctccaaattcttcccgatggacaagaccaatgcccttcgcgggagaatatcaagttttcagcagaccagggatgagatgattcccgaagcatgggaacatctcaggagtatgtagccgcctgtccttatcatgggatggatgactggctcatcctgcagagtttctacaatgaactcactccctcgtccagggatcacctggatgctactactaggggtgccttcttcttaaagacggtccgtgcggccattgatcttattgagaagatggtatccaacatgggctggagcgaagaacgactccagacccatcatcgtggcatgcacaccattaaggagatgcttgccgctaaactggatctcctgatgaagaaactagacgatcaagagagggccaagccgtaggccaccgtcaaagcattggattcgcacatcacatgcaaggtatgcggaagaacaagtcactcggggaacgattgcccggagtcccgtgaggaagccatgttcatggggaacaatggctaccggcaacaaggaggccacgggtggaaccagccctggccattataccaaggaggcaacaacggcaataacaataacggtaatttgaactagccctccttaatggacttagtttttgcacaagctaaaacaactgatgctacaaacaaaaaacatgccattaatgataaagtccttgagaacataaatgttaagtgagaaggcttcgcttccactttccaaaaccagctgagctgcaacaaaaggatagagactcagctggcgcagctagccgctttagtacctgctaaggagacgggaaggattccgatgcaacccgaaccttccctagaaaatgttaaggcgatcaccacgaggggaggaaaatccactcgggatccgccatattctaacattgcagggaccaggcaagctggcaaggaggcacggtctgctagcacaactgaactcgaggaaaatgaggaggtgcagccggacaagatcccgccgcaggaatactgcgacacgacgctactgccattccctcaacgccagaggaagccttctgtggatgagcaatccgctcggttcatggatgtcacccaaaagatccacatcaacatcccatttgtggatgcaatgcgggtaccaacatacgcccgctacctcaaggacatcctgaacaacaagagggcgttgcctaccacggagatggtcaaccttacggaggagtgtagcaatgctatactccatcggctccgggaaaagaagaaagatccggggtgtcccacaatatcatgcttaattgggatccaacacttcgaccatgccttatgcgatcttggggccagtgtcagcgagatgcgaaaggatgtcttcgacaagctgaactatacggtgttaatcccaacaccaatgaggctccaactggctgattcctctgtttactacccagcgggcatcgccgaggacgtgccagtaaaagtccgggacttcttcttcccggtggatttcgtggtacttgagatgaagtcagataaggagacgcctttgattctggggcatccattcctgagtactgccaaagccagtattgatgtgggggcttgaaacatccggttccacatcaatggaagggaggagaagttcgacttcaaaccaagagcagaacaatgcttaggtcaagatcaggtacgggccaaacccaccgcaaatccaagaagtcgaagtgcagctaccagagatggacagcctcatagtcttcatgaagaaattcctgcagattgaaacaaccaggaagaggccctatccaaggaagacactggcaaaaactggtgcacgagccaagaagcctttggctccggctcccaggaaaccaccgcccacaccaaggaacaaaaaggtgtgcgggtaaaacagacgacgtccgctccttcacctccagagacggacaaaaaatcttcgcactaaaattgctggaggtacggtcttgctcgttggacctaaaatcgacgtcaccctcgccaataggtaaagttggtatgtatctcatgtttattttcatcaatttgattcttgcattcatagcatatttgaatttcctgaaaacattgcattaggaatttaaaatttgagacaaatttggacaatgaattttctgagcacaaagaaataaattttgcagcatttatcaacgtggctcctacacgtgtagccgttggagtccaacggccgaatgtggggccagttgggcccaccaatggttcggccgaatcggccgaagcaacggtcaggttatccctttttgtgccagtggctagtgggtcccacctcacagttatagccattggtagatcattataaaaagggtatggccggtagaaggagttcatcccattctcaaaccatcttcactccttctcaaagtttctttttgctctcaagctcattccaagctagttcaagctttgcctcacattttagagttctacatttgcatttgcatatacaacttactttggtgcaaggctaaccggcacgtagattgtcttgtgttagcttagcccccgctcgagttttgccttgtgctcttgctcttattgcattcatgaagaaacgacactctcgcttgttcaaggggtacggctctcaatccagccgtcaacaacacgagtcaagtgatcggtcatccgccgatgtgccgatggaggatacgggtgctgaaccgctactcctaaccgacgccgatcttgatcttgttagtggacgggaacctcaagcctacgagacgctgatggaccgagtgttagctcacacccgagcgtacgtttcgggattgctccagaaaacagagtcgattttcagaaggcaacttccggttttgagaaaaacagattttgggaagatatttttggtgcaccgatttgtaagaaacctagaaccaatgacatccataatccaactcttaggctcatgcataaatggatttccatgactttgtttcctagtggagatcttagacttgttcatgataatgagttatccttaagcttgcttaaggatgagttttcctcatttcttctccattttatttgcttaatccctagaaacaaataatactacaagtacaagtggaagtagattattctaaaataaatatgcattgcaagcatagctaaatctcctttattttagttatatttatggtcgtcattggtatataacgaccatcaacaccgtttcaagaggacgtgttgcaatgccttatcaactttgagatgacctttctactgtcattcttcaatgtaatgacgtatcttctatgtcaccttgtgaaagagatcgatattctcggtcctgtgtacctacacaacatgtttcctttagagaggtacatggctgttctaaagaagtacgtttgtaaccgttctcgtccagaagcaagcatcgccaaagggtatggaacaaaggaggtcattgagttctgtgttgagtttattgaagaccttcgtcgaatcggggtaccataatcaatccatgaggggagagtacggggaaaggacactcttggcaggaaagcaataatgaatgtagacaatgatttattccgtaaagcacatttcacggttttgcaataatctttgttggtagctccttacgtcgaggagcaccgggtgattgttcactcaaaaaacatcagcatgtccgatgcctggattacacgccatcacatttatactttccccacttggctgcaacaacatctcgtgggtaacgggatgattgaccgacaactagccttctcggcgaggggaccatcttgctcgatctcgacatttcaaggatatgaaatcaatgggtatatatttttcacaagagcccaagacagaaagagcatgaaccagaagagtgttcgtatcgatgccatgagatacgatggtacaactagcacgtattacagtgtcatcgataacatatgggaactagattatggtcccctgaagatccctctgtttcggttccaatgggttaggctgactggtggaggcgtaacgattgatgacaatgggatgacaacggttgaccttaacaaggtaggacactcagatgaaccattcgtcctagccaatgatgtaacgtatgttttctacgtgaaggacatgtctagcaaagcaaagaaggggaaagggctcgacgagccaagacgccgtgtggttctcccaggaaaaaggaaaatcgtcggagtcaaggataagactgaacaaaaattactatcagtttgaggggcaacctctgttcacagtcacggttgacccgggcatcctcctatcaaaggaggacaccccttactcaagcaacgatcatagcgaaggaacattagcaaggagaaagtatgtgaggaagacagtgaccaagcttgttgtatggatgatgtaaattatttgtaatatattgaaggtaaaatttgctacaggacacgcaaaaattatgtaagtgtaattagctgagggacaccgtgaaaacgcgaatttgctaaggacacaacaaaaaaccgataattagatgctggacacccgtcgaattattttattatacccaaaagaattggagagagaaacacctatttaagtacaattctacccttcaatttttttcttttttctttattggtccttatcttttctctctctcattctttctctatttctatttgctccttattcaagcgagctcgaggatggcagtgcaacgaggtgcgggccggtgcggtgccttgactagggagacccagcgcggttgtgcgcgggggatggggcctacttggtgcggcggaggtggcgctagagtaggaggggaggtggtgccgacgcggttagcgttgtcggcctaatgctaaggcaactgtggcttcgaggagagcagctttggccttacgggcacagggccaactgcgatgaggagtc

SEQ ID NO: 65941 - DNA, 41444 bp, Oryza sativa
tcgagaatatattttagagtcgttttgggacgcgacaaacctaccccccttaaacggaatctcgaccccgagattcggaagaactggcgaagagatcgggatgggctgctttcagctcgtcttcacgctcccaggtagcttcttcttcggcgtggttgctccattggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttgcccaaggaggcgggcagctccaactggtaagcgacttctccgcgtcgagcaatgatacggaaaggacccacgaaccgaggtgcgagcttcccttttgtctgaaacctgtgtacaccccgcaatggcgtgacccgaaggtacacaaaatcgtccactgcgaattccaggtcacggcgacggttatctgcataacttttctgccgggattgtgccacctttagattatcccgaatggttctgaccttcgcttcagcctctctcaggatatcagtcccgaacacttggctttccccaacttggtcccactatagcggtgtccggcacttgcgcccatacaacgcttcatagggtgccatttgtatgctggcttgatagctgttattgtaggagaactcggcataggggagactcttatcccaggtcttcccgaaatctaggacgcatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagccaccttggttaatcgatccacaactacccatatagaatcatatccaccttgggtttttggaagtccggtgatgaaatccatcccaatttcatcccatttccattctggtacttggagaggttggagaagtccggccggccgttggtgttctgccttgacacgctggcacacatcacacagggccacgaactctgcaatttcccgcttcatactaacccaccagtatttcttcttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagtggctttaccctgtttcatattcttgaggagtccacgcatgtccggatcattcttctgagcctcgcggatttgatcgagcaaggtaggcttggcttccaacgcagccaagaatccacgacccactatgcttagattcagggcttccatctgttggttaagttcgagtggaatgccacggacgttaagagtgttgcaatggctctttcgacttagagcgtcggcgaccacgttggccttaccaggatgatagtgaattcccacatcataatccttgatgagttctaaccatctcctttgccgaagattcagatccgactgggtgaagatgtatttcaaactcttatgatcagtatatatttcacagcaattcccaatgagatagtgccgccagatttttagagcatgaaccacagcggctaactccaaatcatgggtagggtaattgccttcatgaggccgtagctggcgtgaggcataggccaccacatgaccgtcctgcatgagcacgcaccccaatccttggcgcgcagcatcacaatacaccataaaatccttgcgagtatctggcaagattaacactggcgaggaaaccagcttttctttgagagtttggaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgacggtcttgggttgcctccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgtttgtgagtataccagaatgtcatcaatgaaaaccacaacaaacttatccaagtattccatgaacactttgttcattaagttcatgaagaaggcaggtgcattggttaaaccgaacgacatcaccgtgaattcatacagtccgtatcgcgtggtgaatgcggtcttcggaatatcttcttcgcggatacgtaactggtgatatccggaacgaagatcaatcttggagaataccgtggcacctttaagctgatcaaacagatcatcgatccgaggaagagggtacttgtttttgatggtgacttcattgagagctctgtagtcaacgcacatcctcttcgtcttgtctttcttctccacaaaaatcacaggagcaccccagggggaagtactcggacgtatataccccttttctttcaactcttccaactgtttcttgacttcagcgagttcatttgctgccatacggtagggtcgcttgtacagaggagtggttcctggagcaagatctatccggaactcaatctctcgtttgggtggcataccgggtagttcttccggaaacacgtctccgaactccctgacgatggggatttctgacagtcctatctgatgaagttctgaactactgacagaggttgggggtgcaaagaatacaaccggttgttccggccctcggtacagagtgacagtgcgtctcgcgcaatccactactccttggaattgagccaaccaattcatcccaaggatcacatccaagttcttggtgtctagcagaatcagatccgagggaaaaggaatcccctgaatttctatagggacggcaggactataatactttgctgtcataacccctccaggggtggtgatgaggagagggttcctaagccgttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggaggcgcttggccttgctggcgcctcggcttcgggcatttatccgcaaagtgcccgggctcgaagcagttgaagcacagacgctgcgggccttgagcgtccctgcggccttgaccaggctgcacagttggcgtagaaggacggggcgcacgagtcccttgctgactctgctgttgctggggctgtgggacgcgcaccacgaattgaggtcggggcgcggagcgaggttgttgctgctgttgctgctgcgaggacgatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgaacttctcttgcttctcctcatcttcccgcacatcctccggggcgtaacgggccaggttgttgaactcatgcaaatactccatcacggagaggttgccttgcttcaactctcggaattcccttttcttaagggccacgactccagcgggcacatgggttctccggaaagcggcggtgaagcgagcccaagtaataggctgcccctctggctgcgtagcctggaaatggtaccaccatagagatgcgggcccctgcagctggtgggcggcgaagatgactttctcctcatcgctgcactgcacagtgtctagctttttccccacggcatgcaaccaatccaacgcatccacggggttgttggagctagagaaggtgggtggacgaatgcggaggaactcggcgagcttaaagtgttgtgggggtggtggtggagcattctgttgtagcggatttgggagtgggggaggaaacagtcatcatgttggcctgctgggcgaggatttgggtgagaatggcgttggtatctggtggtggtggtgaacacgaaggagaaggtggaggtggcctgccatggttgttgtggttgctgccctcgggtttggttgccatcaccggtattaacacttctcctggtcgtcaccatctgaaaaccccacacataaccagcaaacagagagagctgacaattaaagctaaccaccccgactaccataattcttaaatttattactgctattaaattggttcattaaagttcaaattgcttaggcaaattaaataaagacaggctccgacacaattataccacacaccggcataaccatgccccacacgactccaacaagaagacaaacgagaaagaacacacgcgcaagcctactaacagctcgtctaccgctgcgacgggccagggcggaaggtgagcaacagcgcatcctccgtgctaccaacgccggaggcttccccctcctggggaaccatgggcgcgggctcggcacgaggggtctccatgaagcaggtccacgccagggactgacgaacaagctcgggcctggaggtgctcttgcgggcggtgatcttctggctgcggcagacgcggcggcgcttggggcgacagacctctccctgggcgatcttgagctgatgcagctgcgcctccaccgcgtctaggtccttcttcagctgcagattctcctgacgcagctccaggatcttcatgttgttctcgaccatcccacggcgcaccatctgatggaagtcgatacgagccgcgtcgtacgcctccaccatgcacgctaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggaatctccacccgcggtgactgccaacgaagtccgctcgggagagccagtgaggatcactgcagtaacctcccaagcagcgtggggctctgcatcgtcaccctcctgctccggaagcggcctggcctggtagtccactccatgcggataccccaggacaacgcacatgccccgcagctccaagacgaagccagtcatgtccaaaccacgacggctgacgctgccggccatctacaaacaaaaacaaaaagaaaaacaacattttaaaggtcagattttggcgataaatgaagcagcaagacagagagagactagaggattttcacaaatacaaaggatttttatttttgaagatattgctaaggcttgggatctacggctcgtcctagggtcaagggtggctctgataccaacttgtcacgaccggaaataacccaacgggcgttcctgacgtgcgtgcattaatccttgtcccaggaggcaaggtacaccaaaggttgatacaattcagagtttaacaagcggaagcgtaaatagttaattcattacatgggcgacgaaggcccaacacacacaaagacaaacgagaagcaacggaagactagggcgaccaccacaggcgcttgacggcaggcacgagctagacaccaaagccttcatcttcaaggggatcctcttctgggttgggaaaaattgagcaagactgagtacaaccaccgtactcaacaagacacacccacaagtgcataataaatgcaagggagaacaaaggagttacaatataaagggttagggttgtggtaaacagcatttaaagatatttagttgctcaaagctatttggtaaacacgattctagaactatacaatattatttatcaaggccgtgaacccacacaaacctgccttaacccaaggcctacgatgattcagaccgaactggcaacccgacccagggtcccagctcgtcccaagccaacccaggccaaccattccacattttagttgttaagcaggtttttagaattaaaacactaacttgggtacattgctcggcttgtccataaccgagggcgcggctattcgaatagattatactctgatcagaggtgtatatctttacccacaagacacatcttcctcacgtgtagccacgtgccacataccaccacggtatacagacggaagacgtgacatagtttccaacccatcctagctatagacaagagtaccgacccaatcccacctacggccgtaacccccgggacaggcaggcaggactgagcccctagcagcaggacaccggccctgtgccatgacatctcgactaccgagccgcagctcgtgtagccttcatttgccctggagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccctgagcccagcctaaaatcattttggggattttgaatagagggggcggtgtgaagccagttccacaataaaccaacaattccaaagtgtccaggtgttatgaacattcccaaagtctagagttgtaaaaccgcctaatgttacctaattaaattgcgaagcatctacctaaaattatactagtggtactatgagtagagtgtccactagttggggttttgtttaatctagggtgaacaaggtaataataacaataacaataataaggtcataacaaaggtaaatgggcatggctagataaaacagtgataacgcgagaatttaaataaagcgataatgcaataatttaaagcaacataattttataaactgggattcaatatgttcaaagatgatgtgacttgccttgctcgctttcccaaacgtcggcttcgacttccacgaagagcggatcttccgaagctgcagcgtctacacgaccaacagaaaagaaaaagcttttactctaataaactccatataacaagcagaaacaaagcacaaaaatgggttcttgacttcttaaggaaaaattagagacttgaacggtccaattccgagttcaaatggccaagttatgcccatttgaaggttatatgctctttaaatggatatttgcgaatttcttcatttaaattttaatttaaaattagatttattgcgtcagccgaggggaggggcgcgcggaccgggtccacgggagtggggcccacgcggcagcctcacggtccacggtggaccgggtgcacccggctcacaccggccggcgccgtgggtcccatgcgtcagccgcacccgagggcgcgggcggctgacggccgggccccacatggcagccgtgggacgcgcccgaaggcggccacgccggcacagccgacgggaggcggcgcgcccgcgcccctatggtcgccggcggcggccataggcacggcggagcggcggccgagagaggggagggaagggggaaacgaaacggcggtccacggctcaccccgggtcgacggcgacgacgggaacggcgaccggagcggagaaaggcggcggtgcggcacgggtcgacggggacggcggcgttccggtggtcggcgaccgaaacggagaggtggacgaggtcggcggggatgcggcgaagccgaaggaggcgacgccgaagcgggagaaggtccggggcgacgacggcggcggaccggagctcggcggtgacggcagagagagagagcgacggcgcgagctcgattccggcggagagagagagagcggcgagtggcgaaaacggcggagggaggcacggggagtgtttatatagggttgggagggggagagagcggccggatgagggggaaacgagcgcggaagatccggccgccattgatgcgccggcgaggtttagggggaaagatttcgaacgaatccgagggagagagagagggaaaaatggggggaaagagggagggaatcacggggaatatttcccccctcttgattgcacgcgggacggacgggagcggcgggattcgcggcggcggcgacgctagggcacgggcgaggcggcgggagcgacgggaggtaggggatgacgggtgggccccacccgtcagcgagggtggcgggcgggcccgcccgtcagcggcgcgcgcgcggggaggaagccggatgggccgcgggggagaggggagagagggagagagatgggccgagacggcccaagaggggggggaaaagactttttagggtttttctttttataaaaccattttaactttgtttatttcttcttaattatcattggtgctctgaaaattccactaaaatttatttacgcattttaggcttttgggaaatatacaaaaatcctccaagccttatttgacttttaacttagcacattttaattgttggaggctttcacatggattttacttattctatgcataatttcgagaatgtattttagagtcgtttcgggacgcgacacccatgatgctgcaagaaggacctcgtgaagcactttgtgactacagatgctacatcagcacccgagaccagtcaaagatgatttgaaccatggtgctatatcaaaccaagattacagaactaaatatgtaatggcaaatttgctacatgacacttaaaaagtatggtttttgctgctagacaccacaagaacgtgaatttgctcgaggacacttcaaaagtatgtaatttaccatagaacaccaaacacattaaaatacaatatccatccaattaatgacagagaaaccatgtaaaaatgtcagttttgtcctcatctacttctcccttctcccttctcacgtaataagggatatttactgaaatcgaaacctacgtataaaccttttaccgatttgtcttaaaccatagcagttctattactgttttatgcgtaactcataaaccatctaacagaatgtggcaaccaatacaacttcggccatctagacaaaattgtcttcaactttcatgttgcgcaaagaatcagattatgcatctgttggtgtcagattaaggaaaaacgaactgttgtctttattttcagacccggcagcagtattattttttttttgttgtttctcctaaaccgtttgtaggattcgagcgatgactacaaacttcatttaggacaactaacctgaaacccgattgtttgctaccagttttgataatacagccagtgcataatcaaaaacctcaaaaaattgtacaaacgaccagcgaattaatttctattcaaatctcttacgtctagggactgaaaacaagttacccttgcaaaggaggaacactaacttgcaacaaatttccctaatttacgagatcgctgaattcctcaaagttgctctgccttttcctctccttcctcatgttcaactgcttcctggtctgctctctggacccttctctctgatcgatgcagcagcagcagcagcaaggccgaagagatcacatcagcagcagcagcaaaccatgcattagcagcagcagaaaggaatagatcagatcggcaacagcaggaaacggtagaagaagaagcagcagcagcagcaggaactcaccgggaaaaagcaaaacagaaagaaacaaccggttgcgatggatggcgacggctgcggcctccagctatggccgtggtggcggcggaaagacggcggcggcaaccaggacgacagtggccgcggccacagcacaggagtgtggcggctagggcaggctgtagcgttctctccttttttcccttttttttatataaagagactaaaaggagatctaacggtttcaatccccggaacatcgtttggactccgattactataaacttcgagtctattttgcagtactcaacaagttctatgcatccacggtttttgagattgcctattcgaacaacggtttaaacgttgaacttttctgtgtttgttccaattttcctcgaaatatactaatttgaaactcgggacattacaagtatagggctccaccaacatgtgtttaattccaagtcaaagtatgcaggtgagcatgcattaaattctccattaatcatgttatatataattaagagaatttcctaaattaaaataattttacaaattaacagagcgagtaagcagggtgtgtctttaaataatatgcaaaagccagtttattaagacaacaataggcagtttattaagacaacaagtaaatttagtaaagcaggtattaataaatacatatgtccaataacacatcagagatctaatggaccattagatagataattgtttttacaactcatgatctacttaactaaattatctaaaaggatggggactaaaagttaaatttgctaatttaattaaaactaacgttaacgaaaaggaagaaaacatgtaaaggggtggtgggccgaaatcaacatgatgcggcccaccaggctggttagggttagaaacgtaaccatcccgcggtttctccgccaccgccaccgtcaccacccattttcgctgccgccatcaagtccacttcgccaccgccgccgagtccaccaccgtcacaacccgtatccaccgccgcttccccttcgagtgcatcgccaccgctgttcgcatccactgtcgctccaccttcctccgctgcagcatcccccttttccgaaagcggcttgctggccgaagttaggccgatagcccccactcctcatcggagtcagagtccggtcagacctatacgctgttccccactccgtccggagcgtgcggctcgcagaaccatgaggaacaacgcggaggccggggcggtgtgctgcaatggctccggcattgacagcaagacgaggacggactgaagagtgccggctcccctgtgcacgtggctaggattccggtccagccgaaacccggtggcacgggagttggggaacaggcatcggattggcaactgtgtggtcattggagatggtggaggtgcagtcggtggtggcacggtgacgacaagcggaaccggtggctattccatctcttgcgggagggatcactactcatcggtgggcggcaccatcgcggttcatccatggtgagtacaaaactatacccctagacttggatgcggtggagcgcccccagcgaccggcgaggcaggggctggcggagaaggaggaggagtgaccggaattgcagcgacaagaattcagtgttgagggtggtggtggtggccaccaaccctagtccgacgcctgtcatgctgatggtggcaactcctcgtcgagcgatggtggagatggcgaagaaggcgatgaagaaggccaggaatggtgtcgatcatggaactgaaggtaggtataccttcttttcttcatcactttttctcgtgaagatcaaagtactgataacgtgttgaaaaggcaattgagattgtaagagtgagagaatataacgttgtgtgctttattgattaactagaaaatttgcgtgccagttggcacgcccaacttttatagcccgtaatatcgtttgaagggcttttaaatttgggtttaaaatactgatgatcacacaaaaaatttgctggcagagctgttggtattttctgtcctgagaaaattcaattaatatgagtactttataaaaaccatacattccacgaaacccttcaacaggttttacttttgtgtttgcaaaaaggttgtggaaaaagtagtaacatacgttagctaggggatatcgagttaataagtaaaatgttttttaataaaattgcacgttcacgtttttatgttttagcactcggaatctgtggatttgttttattcaaaaaatgaacgatttttttaggaagaaatatatatattccaacatgaattcattttggaattgcattttttttaaacgcctaacaatgcaccactaatcttaagatcagcactcttctttccattcttcccacattcagatgggcttggatgggccattggagctgcatgtcacctgctgcatgcctgcatggcccatgatgctgcacgagcatattgcaagcaagcaaccgcgtagagccgtgtatgcgccgtggggaaaaaggtacactgaaggtccctcaatttgtcatcgagttccaagatcatcccccaaccataaaacctgatacaacgtatcccccaacttacaaaaccagtgcaaacttaatctcttagtggttttgacccggttttatctgacgtggcgactgtgtcagcgtgggacccacgtgagccccacatgtcaggatgccacgtctgcacgctagcctctcccttcctctcttatcatttctcctttcttctcaccacacagcaccgggcggagcagaacagcgagctcgccggccctgcctcatccctcttcgtgcgtcgctgccggcctccccgccttcctcgccggcctcaccgtctcctccctcttcgcgcgttatatgcagctgaagacaaagcgagagagagagatgcagcgggtggaagttgaagcggctactcaacatcggggaggagcggaagctccgcgacgtcatccgtctcgtttctgccagtaatgccggcaggtctaaccgcgttcttcttgctcctttccaaccatcccgaggtggctgccgcaatccgggacgaagtcttccgcgtcgccagaggcagggaccctacggctaagggtgtaagttgctaacctgcgaaacccacttacaagctaaaataagccgcgagcccgcttattttgacctataagtgggttcgcggctgacccacttacacacctacccacgaccgcggaccgcctccttcgaattcgaaaagctaaagttcgaccccactgccgcttggagtatgccaacttcctcgagagggttgagatccagttcgagttgggtcggcgccgagtcccagtgcagcggatgatgcctgccagccgcatgggtatccgggaaggtcgacgccttctggccggggctgagcttgagccttgagctagctagctctcgtcaccattcattcaggttgacgccgctcgaggactcgacgtcgtcgtcaaccgcgacgtgatcccgtttggtttgttttctgacgaattccaatttaaccagacgggttgttcgtcctggtcctgaatcctggttggctagtcgatcgatatatgcaatgtgacatgccgattgaaattcttttcaacaccatgcatgacaaatttatcatttcttttggtctggggagtgtgcgccggcgacctccactccctccgccaccgcatgcgctcccacagcttcccctacccttcacctacttctacgctactaaggtctcctccggttcaagcggcggcggtacgtagaggctgcgtgcctcggtggcgcctccggagttcatgggcaagccggtgacggagcagtcgtgctcgttcgtcggggcgctcgagagtacatggccccaaaggtggcgagcgacagcgtgcatggtgtcgccgtggaccactgctcgcccgctccgaccggcgcagtgtggcgaggagaaaagagcagagaggagaatgagaatgagtatgacatgagggtcctatatgaagccattattttttaattattatctagtgtaactgacacatgggtccctatggtattttttcccaatcgaattgccacgtaagcgcaacgtcaataccatataggacgaatacctagctaaaggagccacgtagacatcacgtcagctaaaaccagagacaataccaccaaaagatcttgtttgtactagttttacaagttggaggatgcgctgtatccgattttgcggttcaagcacgaagacaagtctctgtctatggtactttttccgcgccgtggtgtttgctcgaagcttcgccttagcgtaacacgcgtcaaaaactgatttcgccatctggaccaatcggcagccgacggaaccgccagcatgagaatattagatgcgattagagcaaccataggcgcgatggcaacccatcgcgcctgttgccgaggagtgtcgagaggatctgttgccaagtatcgagaggatgagaaggggcggggcacggtacaatcgccatgccaaaccttcggttaccaatctgagattgatcatctatttatttcataacaccataaatggacaaatacatgcaaaaaaattcgataaaacatatgcattctcttatcggtaacaataatattatacattctagatgctacaaatacgtacgcaaaataagatgaactcttctattacacgtgtattctcttaattatgtggtagccttctcaaaaaaagaaaactaaatccttttctgtacagaaaattgaaaaggagtgacgagggtaagccagccggggagggtgaggaagtgaagcgaagcagctacttgtagtgccacggcggccggaacatctggaacgacggcttgtgcgacgccaacaccagcagcaccgccaccaccgccgcgacggcccacggcgacgcgccgccgccgtcgtccccgctactaccaccgtagccgccgccccaccgccacgacaccggcacggcgaccctccctccggcgtccaccagcgcgtggctcccgagcaggaccagtgccaccgccccgagcaccagcagcacccacagcccggcctgcgtgcgccgccgtagctgctcctcgtactcgtccatctgccacgtcaggtagaggaagaaccccacgatggcggagaccgccaccaccggcgccggcggcaggccgacggcgagccatccctgccgccactggaggtcactcgactcatccatgtgagcgagctacaaacgtgtgtatgtgtctgcttcatcgatcgctggtcgtatatattttggaggcaatcatgcaagcgaaggaggtggtattggaagcgatgtgagatttggtcttgtggttgcggatgagtggtgggtggtagatgcttgtggaagatgacacggcgcgacgcgtgtcgtgggtaggagtgaacgagtgatggcgttggagtggccggcgctttcagcatcgctgtggaatgctactcggcagtctgccatcggttgctctgccttgcagatcgctttaaggattttcctagatctttttctttgacctggaattggactttctagtgctacgtcaacaaaaatcactatctgcattgaaagccggatgctgatgatttagtagtattattaaaggtatataaaccagaaaacgtaactaatgttaaactagtttaaagacaaaataaattaaaacaaaatagattataatcatataattttcataatatgagaaatgatcgaacgaactataaaagatcaataacttcatacaacaaaaagaagaagaaagagtatgtgatttcttcgttataaactattttagactcatacatgtatatacttattgtttgtatattatatattcaaatggtgataaatattttttttagaaaacattaacaataaagattaatatgtgatatatcacttcacaaatacacaaggtcattgtcatggttatggataccacatacctaatagtagttgagtaaacttggcatggccaaccatataccatgtcttatacggaaacaaacctcgtatatagaacgagttccggataagaaaggacaaatagagttctatattgaaccaacaaggattactcggattgtatccatctttatctccctagtcttacttggacaaggtgccatctatggatataaatacaagccctcctaggacgagaggggacacgccacaaagccacaagccaacacacgccgccgcatatcaatatcagagataagcctagacataccccatccggtgcctacagatgccggcaagatggatctagcgccatatctgatctcgatgagttcatactcaaggaggaagactaccctgtcgtcgactacgagttggtgttcatgccgccaagtcgacgatggctagataggttatttcaattgttgtgctatgtggttttctatattaatcccatataaacaggatgtagggctattacctatcatataagggacctgaacctgtataaaatctttgtcttcatttcttttacttcaatctcgcatataccctggtaccaacgatccccataccatccaaataccgtagccgtgataccaaattaatgtcgacaatggcgcgtcagatagggaaattttggtgctttaaggttttcgacgagatgggttcaacacgtggatttttcaactactcaacgtcttttgactgtgggagttacaatcccatcgatgtgcgttctccaaccagatcaaaatcatcatcgccaactgttttatctatcacgatcgagcaagcttcaaggcattgtcatcgcagatacccgacaaattccggagttgatccggtaccaattccttcacatgtacgacatcaaccggcgcgaggacgcagcactgaacccaactcggcaacaacgcaagcagtctggatcggcttacttatattaaacgtactcgatcaggactgtcactgaccaaaccgattcatgcacgtgtacacatatagagcctaccgtgtccctgtgcaacagacaaacaatcggactactacatcaagcaagcacgtgcacacgtggacacaaagcagaactaatgcacaagcagtgtcattacacatgtacacaacaaaggtaattggtggattagtttcttaaattatctactaattttggcatgtatctacaaagatacgcaatattttatatacaatttaccgtatctatatttagactgtaaaatattgtcagatttataatttattatgtttacctagagcatgttttttatacaatattattgtgcaagtgtttccggtgttaggccgactacggtctaatatttatacaaatcatgcttatttacggtttacacaatgtctaatatttaatctgctcgttatatccattcgcgcagtcttttaagtacatactcgatattctctactatatatcttgtcttctagaaaatatttttcaggaacaattgagcactcttgtaggatgcggtcgagtacaccgctttattgagaacgttcttgaaaaatgctgagttgtcacacccaacctaccaacgaagactgacgacttatctcatgtatagcgccggctgcggctggactatttgagaaaatgttgttaacggataattcctcgtgaacgttgtcggcttgatcacccgacatgattgcgaatagacatccacggatggactatttgagaaaatgttgttaacggataattcctcgtgaacgttgtcggcttgatcacccgacatgattgcgaatagacatgcggatatgctaaaagttggttatgtgagtcatgctagccacgtgagatacacatgtaatcaccaactctagcgcctctccaggtgatcaagatacgtctacacctggtccttggccaatagatagtagcgatctctcaccaactaaaaattcatattcaggtgattgagatacgcctactcctggtccttgaccaatcggttacagcaatatctcgacatctaacgcaacagccaacattgtcgtggtagcgacaaccaagacccactagatcatcgttgtcaccaggacgacaacgtccaggattaacgacatcaggacgacaacagacaaggttaacgacatcacgacatcacacgacgacgacgaaactcgagatccccagacttctagagggcccgaggatgaggtagtaggtccaggagccgaacctctgactacggtaattcttcattgccttcgtcatcatcaggaggcagttctcgaagtcacaagaacgtcgtctatctattactctggattcccttcaaatggtcgaggtacgactacgactagtcttctactagcaacgtagcgatcctcgtaccacgacttctaatggtcgagttacgactacggctggtccccgaccagcagcgtagcggttctcgtacctcaattttctagtggtcgagttatgactacaataggtctttgaccagcggtgtagcgattctcccactacttttgcgatttgttgagtataactatacacctggtcttcacccggtgtggaagtcgtctcatcacgtcttatacgtcaacttctgtaagtgtttatatgtgcaatattcgtccgatgatcctcttttcttatattgccttcgtcctgaagtcggtcctactatccctttacactgttcatgtaagagtgctcaatggacgcgtattaaccaagccgtgtagttggaaaatgatttttccaacttcactactgggagctaggatttgtcaagcttctgcatggtttgttataagatacaagctgtctttgtggaaaatggcttttccataaaaacagctgggggctaggaagggtaccaaactccgattgctgagggcgactctagcgagagtactcttttattgtaacatgcagattcaatttattttcaatttttctatacatatcatgtcatgttacccttgagcgttcgctcggggggctatttcaacattgttgaagactccctgtctctacgattctataccgggatcgactaagcgagtacggcaaatgttctgagtattgatttcaggaaaatcagacatcagaacaatcaagtcagatttcaaggctttgtcgcagactctacgcctactcgattactcgagaacggttgatggggctcgacaaggaatatgaaacaaagcgatggtgtacccgccgagatggaatttcttgacttcaatccaaattctcgattacagcaaggcgggagacttagtcacatgctccatatcttctcgcttgacatcggagattaacctagacaaacctaataaagtgcctacaaaggccgatgagatctagccttatttctgaacacaccgagaacggtcaagcgagcacggcaatagttgttccaacgtcttcgatcgagaaccttaactcgttcatttgctgatgaacccagagttccactcgacactcaaggctgttgttggcccgatctttcggtgagttgtagctaactatgatttgggagaaacgttgacgatctgattacaaccgtacgagacgttgtgttgcgccttagcgatcgatacacctctccgtgggttgttgaacttgctgatgcaaatcaaccttattcctgtaaacaaatcaaagaaacaagcaataacaagataaaagcaatctgaattgcaaataggaatgaatacacgagataagttggggtttcgaatacaagcagacggacggtctagccgacacgcgcgctgtaaggaagtagcaatggctaaactttcatctaaacaaaacccgagaaaccctaaaggggtacctaactatttatggaggtgggaggatgacctaggggtgcctaggttcgtgctccacctagttggggcgcaccccacatgagccccacttgggccggggtcccaaacgaagttacaaacccattggcccaatataggtgacccaagaacttgtttctgtaattgcggccaaacgacatggaatttggcgatgaaactagatctgttggaaagagggctctgagatctttccatcaagtactcacgggccgaaaacgaaggtcgtatgcagattcagcgaccgtttgaatacagtagtgtagcatgtggccgcatcggattctagcacttggaggacttgatctctatatcttcttgttcatccatgatgtgagcaatggttgcatccatggtagccttggtcacatcatcctccccttcttcacggaaaaccatcctcgatttttccatatgatgctgtttgcatagtccatttacaacaacctatttctactaatcaaaacaaggcaaattcgagacaatttggttagcaataacatttctctctagcttgcatgttttatacacatgtacaggaagctctaaatccgagcaaatgtaaactctatgcacgaaatatattccaagatcattatatttaccaaagatgtaaaatataacattggttggacatggcaaatcagacttagcaaataatttcttcttcaaattattgagctcacaaaaatcatcacactgaacatagcccaaagtatttaaagaagatgttaattcacgttcctctacttcattagcaatgtgaataacacgcttaaaatcatcacataaagaactaacattagaaaatagcatgttcattcactagttgagacattgatataagtgaagcattatcacacaactctgctttatcacaaggaacaacaaacaaatcaacttgtgacaaaggaatctcagtagttggttccactaatggttgctctaccatagcataaaaagtggacaaattcaattcattaacaacacacccaccttaattaatttcagcaccattaagtttacctttgatgccctcttcagatgatggaggtgcctcgactttgagtgtgaacaatgggactatcggctctttcatgtctctctcctccatttcatgattatgcacttcctgcaaatggttagtaatagaagacaaaaacatagcatgttgcttcttcatgacctcctctattttactttcagcattgcaagcaagttgtaacaaatgagaaagagatgtatatctttgacaatcaagcatgtcctaaatttctttgttaagcccacgtaaaaacctcaattctgtagtttctttgcattcatctaaaccacaacgtaataaacaagatgtttcgttgaacattgcggtttgttgaacaagatgtttcgttgaacaacgtaataaagagatgtattctgtagcttctgtaacttcttgttttaaacattgcagtttgttgaacaaaatatcagcataatacataggaacataaatatctctcaaatatcgttttaggtctttccaatattgaggtattttattatggttacaaagatgtttccaatcattagaagcttgattaattaaaacactagaggcacacataaccttttgtttctcagacaagccatgctttttaaatttgctatcaactgctagctcccaattaatgtaaacatgaggattataatttccttcgaaataaggtagtccatatttgatctttccaagaacaatgtcacttacctcatcttggtcatgttgatcattcctcatgactcgacgaagatgtcgatgttgagcatgatggtcgcgtattcccttgcttaatcctgccatggttagtagtaaacaagaaacacacacaagaatatgtacgctcctatcaactactaggtagtgatagctcaaatatcacacacactcaaacttttaaccaaattcttataagatcttaccgaggcaagcggaatggtgacatacaccgactcaactaagcaccccaatggaggttggatatatcgatgcctgtcgtaggctcttcggaccttccattatatttgagagatgaagtgaataattcaagtcatcaaacaagcataatgaaacatccgacgcctcgagagaggaatattggagacattgttaggcccttagcctgccagtcaacttcagcctgagatgtgcctgtcaaccactcgaaggcggcgaccagatgtgttacacattcaggagacttgacaaaaatagctaaagatctacaacctctcaaatattcctaactcatactcatgtgaatctagttcccaggatgtgcactagatccatactttcatcttaagcatgattatacatagcaaacacaagtaagatgaaagaaacttaagacttacaacaacttaataattacataggctgatcggccaaatggatttattagagaatagcggaagcttgactacccaatcacaagcacaccaactaggggtttaccccattaagttctcatcctagaagaagcaatcggaacccgcatcactcaaaaactaagtctaaacttgcaaacaaaaggttatatcaacagcaagagtcagtacattaaacaagttaacgtactggcaagcacaagtcaatcctaccatactacatgtaaggcatatattcaaatgaaggcaatatgtagttcaatttcagcataaagcaagttttgtttcgcaattctttagtaaaagagttgatgcttcaattaacaaaacaaattttaagtttcaatattaagttcatcataattccatcataatcaatctcttgctgtcatcctttgacaacaagtcataatatgtcacctcacacacacaactcaacacatttatcaatttcaaactaatgtcacatgaccacattttaaaacataaagtctatactcatgacacatcaccaaaacgctcatgaccgacggctaatcgattagtttaaagaactctgcagagtttgtacacctttacccacatgatgtgatagaagcccggaggctacactctaggtggttcagtgccggccaagcaccccacactctacattatgagtgcggactagaggtcacaacgaagcctttacactacttagagcctagccttgcaccagcacgatacgtgttactccatcctaagccgtacacgttatatgacctagaaccgttaagtggcgggcccacgccttaaacttaacgccgtggtggcggacacaacgggaacccaccacgtggcacaataccgttgtattggacacgcttagtcacctaaactaccacttcggggtaaataggaagctcctctgaattatttgaactcatacacaccggcctaccagaatgcaaggctagtcctaaatagattaatcagcttaggccatcccatactagcacatgtggatgtacgaatatctttaaatgggtgacacaagttcggtccttatggacttgggcaaatactccccctatcggtatgcaactaacaccatatgcacaccacttgccgcccaagtataaaatcacattttacacattgtagttcgcaaatacccatcatattcattttattccagcaaaggttcatgtatgaaaatcacattttaattatagatggaatgagcatttgcatagttctaagtatggctaagcaagtagttgcacatagagcatatataaacccatttgagcacaaagagtgcactctaaccatttctaagtgttcaaatagcaagaagatcaattattcaaggtggggcaaataggtcataactaccttaacccaattttaaatactgatataatctaagttcacatgcaactttgcaaacaaatattttcattcctcaaatcatgggattcaatgtgttcaaaggatgggaggagaaaacttgccttgatcagagaaatgttagcacctaatccactccttcaccaattatgcaattatctagataaaggacacgttatgcaattaaacaccaaaagagctgaaaatccaaaatgctctaaaatgcatgatttatgcacagtgattaggtactggtctaaaattaatttaggtgaaagaatttttattttatcttatttcattagggagttatgaattttataagttttatcggttatagtattatagtcttaggtagtgttatgaaatacttttgtaaagttatttttattatattagacttcacagaggtgtagaggtgtgttttataagactaactcatttggtttcacaatttttggagttataatgattttcttatagattttacaagttacaacatgttttaggcatatagtgttttatatgtgcatgactctcaagttgtaggttcagaacatactacttcctgtttaagttgaataaaaggaataatttggttaactaaaacatttttagttcacatgtttatggtctttactactatggttcatattttataaactagagatgctctaatctaaactagcaatatattatattaacctagaaattgttatatgagctaagttcttctaagttttagtggatgaggatggaactatggcttcactggtcaattaagtttttatttaggtttaattagacctaaagtgtatatatacttatacatgtttatgtattacttaaacaacactatgtgtttaaattcttatttcactaggttaaggttttgatctatattctctacaaaaggtgccaaattttatttcactatgttgaagctaactatttgctggttctatagaaactttgttcatttcatttggactaaaaatgaattttctacaagttttacaaattaaaggctactctatgttagtaaatctttatatgaatatttagagacttttactacacagtaagtatataatcttatttcataaacatggaaatacatgttttggtgatcctacagaacttaagtttactcaaactgaagctaaattgggttctacatgaatttctaaactttagcttatctacactaatcattctagagataatagttttagaggcatttgatgcaaagtaagtaattacttttatttcacctaatcagagagtgcatgatgatgaatctgtagaatttgattttgtttcaaaatgagttgagatgaattttctatgtattttataagtttgtacatgttttatgtatgacctatcttagataaattctagaaacattatttgtatagtgagtgtcaagttttatatttctaaaatagagttcataactttaagaattctacagcaactagaatcatctcaaaatgagttatattttacaagtttgggtgttttcctgttaaacatttaatgttttagttatttttcctttgcattttcagatttttatacacatgggtccactgatcggtggctgaaccaatatacaaaaaggtccctgggctttatataaactgcatttaggtccataggtccacatgtaaacggctgaagttttatagtttgaaccctatgtttttaatcatttacaggacaaagtcctcatcttcaacctccagcagcccgatggactgggagcttggccatggctttggcgagctagtcggcgacgattggtggctcgattgggaatgaggtcaaaagataaaatgaagagaatgctctcacgattccattcctctagttttcttggctaggagacatcggagtagcgccgatggtgagggtgagcggaaggtatacatgagctgttactgcatgttgcctagggctttgattttgctagatgcatccatgcatgtgtttcctaagaggtccaggaggctcaccaagctgtaggaagaaatcgccgaagcttggatagcagcggctttggttggaacggttcgacggcagcgctcctcctcgggggaacggcgacggctcgaacaactcaaggacctgccatgcatgcatgtccaagatgttcgtgaggttatggagatggtgtatacgcgaggaatcgaacaatggctcaccgaggcagcggtaatcgacgatgatggcggaggcgatcctagatcggcgccgggaagcaaaggatgcgttctccgagtccttcacaactccggctagggttcttgaggcgtcttgaagaggtggtcgaggcgagattcttggcacagcggcttgcttcgggatggacaagaatggccggtcgacaacgatgtcgaagcggcggcgctccggtgcgtgctccagggcgtcattggcgtggtcacgttccggtggctgtgatgcacaaaacgagaggtggtcaacagagaagtggttcggcattgtgtggagagatggaaacgcgaaagagatagaggtgaccttgactcaaacggagatggcgatggtcgtcacctccatggccagtggtgaggtcgctggtgaaggagaggcagaggacctgctcccctcggcttcttcggctctgagtgatgagtgaggaatggcgactcagactggaggagaagagagcgagaaaaggaaagcccgaggtcgtcgacacgttgtggccacgcgtcggctcgctcgatctctccgtgtctgtgttcttggtcggctgagggtgaggcacaaagaaagggcgagctggagaggctgccaagtgggcccaggacgaagtgctctaggtggaagagagaggtgtgggtaagattctgggtgaacacggttttagacgaatttttagattattttctctcccctaactttgtagcttcataacttaatgtgtggaccaaattaattagtgttatttttctggaggtaaatgattacacctagattccattttctttggtttcactcaaaaataatggatagactgctcacagaaattaaacaaagattggctattagaaaggtagattgaatttttaagaagcctaaacagaggaggaaaattctagaaaaattatatttaggcatgacaaataatctagtatttgaataaattattttccatgttcacttatgtgcagttaaatgtacttttggatgaagtatggctttagccgattaaaatttaatttgatttcttttagttttttctgctttgactgattaatttgtggtattaaacttagttattaacttgtaccaagattatagtgaattgtttatgctaaacatagtttacataaatttttccatgatttcatcttgcatagattattttaaagaataagaataacctttctttgtatatgtgttcctactacataattgcacctaatattattatagggattacattaaacttcttttggactgagaaaaagataatagaatttaatattaagtccacatgttatactcatgagacctattataaaaagcgagaccaaaatccaaatacacaatggactcaagtctaggcatgcgttatgcacaagtatgctgtcacaccttgaagttcttttccaagcctaaattgaatttataaatcacctagagaaaatatcggtgtaaaagaaagagagaaaccctaataaattaatgcaaataataatcggaattggcatgtggaatttttcttgagttctatatgtcgaaatatgctaacaagatttttagtgaaatttttagagctctagaactaattttaagcaattaaaaatgagcacaagcaatatttaatcctaggaaaattcatttccttctttttctttttctttttcccctttttctttttcgaatgggccgccggcctattcttttcctcctccccctccccgctgggccggtcgaaggccacggcccagccggaggaggccggtctcccaactgccgctcccgcctctccctcgccttccgggccacgccgcccacgttgccgccctccccacgatccccgcgcccactccctctctcccccgcctgctcccgctctcgaaattcgaattcctcctctctctcctccccacttctccccactccgccggcgaatttgcggccatcccggccacgatcgacccccgcgggtctatataaagcgtccccgcctcctcttctctctttttcgttttgcaaccacccgctcccgtgccctccatcgcctagcgctgtcgccctcctctccgccgccgccgccaccgctccggtcgccgctagccgccgtgccaagccacgccgtcgatgccgtcacgctcaccgtcgtgcgggccgtcccgtccaactctcctccgtcagaatccgccattggaaccctctccgccccatgcgccagtgagcaccgccatggccgccgccttcggccggcgttctcacccctcccattttcctccctccctgtaacccctctcatctttttcgctaggtggttccggagaccgtccgccgttcgccgtcgtcccccggtcattcctcgccgcggttcgccgtcgtcccctcgtgccggccgaaccccggtcagcatctccccgtcgtctttccccctctccctcttagcgccgctgccttgctgctcggggccgcgccgccgcgcgccacggccgtcgggtcggcttgagccgtgcccgtgagcgcccgcccgcgagccgcctccgccgtccgatctattgggcggtagatcggggccgtccaaccccgccacccgcgtggctgccacgtggccgccacgtgtgcgctaagtcggcgccacgtgtgcaccatgtggtgcgccgctcctccccggtccatggacccggtccaccgtggaccgccccccccgagtcactgccaagtggggcccgcatgtcggcgccaccccctctctcccccggattttaattattacgcaataaatcaattttggatttttctgtttatagtaaaaacacagtgaatcttctaaaattcatatctaattcatccgagctccgtttaagcccattcaagtctcagaaaatcaagaaaaatgcatagaatccattaaaaatggttttgttctctgtttcagtaatcttatagcctgtttgtatcatttgctttgtatgtcgcttaaattccggctctcccgacgctccggtgtactttgaaatagtcgccgaggttcctccagcagtagagcaaggcaattcatgcttgtcacttgaacatgttgatctaaattgcaaatgctctaccgttttcccttaaatactgcattgttttataatgttactatgggatgtttacctactgttacagccatgctatttttgtaccttgttcctttgttagcttgaggatataacatgactagatattggactagggattgcttagccatgcttagttcaactagcacacaatgggggaaatcacattaatgcttagacttcaggttctagtgttggtgttggattaaagccaccgtcctggtgttagtcaattaaaatataacatatggtgggctgtgggtgcttggttttgatggtcgcacccatggcacttaaagaccggttcataggaaaccctggaagaattcctcgtacttgccacaagccagcgtgggcaacggctgggcttgtagtgtagcttttctctagctgacgcatccaggcaagggtgggcatgatggagtttggatgggccctgcgacggcctatgcggcttcctgattcacctaggcacgagaggggactgcccgctgccttgcgaggagtgggggtgaaacctgaggtgtggtgtgcttggttagagggggttatgcgaagggtcctgtcacggcctctatccggtatgtcgtggtggcatgtcggcgcacgggaacgtgtcgtggggctgtgtcttgtgggtacagttgtacacctctgatcagagtaaaactattcgaatagccgtgccctcggttatggacggtcaaccagattcaccgtgattagtctcactctagtcaagtctaatggaattgattagttcaggtggatggttgggcctgttgcaacgtggggtagcgttggacagtggatggataatattgagtaattaatacaactgttttactgctttcaactactatttttaaatgcttgatttatgcaaatgaaccgctctagctatcctttggttataccttgcatcataccctctattccggtatgacttgctgggtacggtggttgtactcagtcttgctctatttttcccaaaccccagagtttgagtatgcgtcagatggcggtttctccgaggagtaggcttcgtccgtgccgtcgaggatgcctgtggagtggtgttcccgctgcgctccaagtcaaggcttagctccagttatcttttaattttccgctgcatttatgtaagacttttatggtgtttgtaaggtgtggatctgtatgtcaactttgttgtttgtgtaccccggccacattctgcttggaattctattcgggaatttctgggcgtgacatatgctcaaatgcttgctgacatttctagtctaatgttgggaatgaaaatgttttattttgttctcaaattttaatcatgcaatggtttaagttggtcatcacctaaattaaaacggaaatttttggctctcaaaattggataagttaacctctaactattttgacaagaaattttaagtcctgaaattttgggtatgttataatgccttagcaaatactcgttgtacagctgcaatcaaatctgtggagctgtagatagccttaaatatgtagcaaatgaatagcaaatgctcaaatcagagaatgcaaagttgaatagttgttcaaagtcaagtaccgcgccggttctaggctagaatgtactagagatgtgagcctagagataaatgataccacaagataacacgagaaacaactcaagcacactgatatatcaaaattcagctcaaagatacaactgattttttttctttcttcttctttcttttcttcttcctttttttcttcttctttttttttgtgcggcttttcttttcttcttttttttacggacctttctgcctttttctctatttcttttcaacaaaaactgaatcaaggacctcaatgtaaggtcatagggactcaaatgtaaatttgaaaattgcagggactcaactgtaaaagtccaaaccaaaattaaaaattatacagaaatggaatgctgagtttataccggttctgtttttgcaaactgaactcgaaaccgacgcaaaacaaaaattcacaaaagtgtaatcgagacggtggaggtcgaaacctctaataggtaatcgatcgccatggtgatcggctagcgatcatgaggcgcccctctccctccacctggttttcttttttggcaccgcattactttcctattttagtaaatttatgcacctaaagtttatacacctcaagtttatacatctaaagtttagagaccaaaagtttataagtcaaaagtttatataaccgattcaaatttgaatttgaattcaaatattttttatatatagtatttctatacatctgtcaaaagtttatatacccgtttcaaatttgaatttgaactatatccgatttgaatttgaattcaaatatttttatatatagtatttatatacatctaaggtttatagacccaaagtttatagtcaaatgtttatatacccgtttcaaatttgaatttgaattatatccgatttaaatttgaatttaaattcaaatattttctatatatagtatttctatatatctaaagtttatacacctaaagtttatagatccaaagtttataagtcaaaagtttatatagccgattcaaatttgaatttgaatttcaattttttatatatagtattcctatacataaaattttctaactttttttttaaaaaaaatttgtggtgtactgtagtaggaagagaagagggaggaggaagggggagaggagggaggagtgtatctgaggagggagggggcggacgccattaggcgtgcctggtggaggtacggtggggaaggaaaccgaaaggtgagggagtcggactttggcctcggcaactgggcacgtaggacttactcacatggaaagaaacgcacacgtgggggtggagggagaggactcggccaaattggaaaggtcagccttggatggaaacaaaccaacctgattgatctaatctacaaacagacgcccccttccttcttcctttttcaggcgcaacagcacgaccacgggagagggttcaaacacacgacacaaaacctggatgcaactcatcaacttcaaaaccgaccaacaaaaatttatgaaaactacaaaattagaaccgtggcagcaagctgattccgtttttgtaggtccggacaacaatagagacacggtggcggtgacgactgtggtacaaaacgtaactagaactcgaaactctaaacggactagacactaaaaccagcaacttgattcgacgatgtaacgcaaaacacaacaaggcaaaaactgataagaacaatgcaatagcacaatatggctaggtaatagatgagtttatttatttttggttattttctgggaataggtagatgaaaactcaccgaccaacgaaagctctgataccacctgatgaaccctgagtttcactcgagattcaaggctgttgttggcctgatctttcggtgagttgtagataactacaatttgggagaaacatcaccgatccgactacaaccgtacgagacgttgtgttgcgccttagcgatcgacacacctcttcgtgggttgttgatcttgccgatgcaaatcaaccttattcctgcaagcaaatcgaagaaacaagcaagaacaagataaaagcaatctgaattgcaaatagaaatgaatacacgagataagttggggtttcgaatacaagcagacggacggtctagccgacacgtgctctgcaagaaagtagcaatggctaaactttcatctaaacaaaacccgagaaaccctgaaggggtacctaactatttatggaggtaggaggatgacctagggatgcctagggtcatgctccacctggttggggcacaccccacatgatccccacttgggccggggtcccaaacgatgttacaagcccattggcccaatataggtgacacaacaccttgtttctgtaattgcggccaaacgacatgtaatttggtgatgaagctggatccgttggaaagagggctctgagatctttccatcaagtactcacgggccgaaaacggaggtcgtatacagattcggcgaccgtttgaatacaacagtgtagcatgtggccgaatcagattccagcacttggaggacttgatctcgatatcttcttgttcatacatgatgtaaggaatggttgcatccatggtagcatggtcacatcatttgcattgaagtcgggggctactgtcatggttatggataccacatacctaatagtagtggactaaactccgcagggcccaccacataccatgtcttatacagaaacaaacctcgtatatagaaggagttccggataagaaaggacaaatagagttctatatggaaacgacaaggattactccaattgtgtccatttttatctccctagtcttacttggacaagggggcatccatgggtataaatacaagcccccctaggaggagtggtgacacgccacaaagccacaagccaacacacgccgccggatatcaacattagagataagcctagacataccccatccggtgcctacggaagtcggcaagagggatctagcgccatctctaatctcgacgagttcatactcgagaaggaaaactaccctgtcgttgactacgagttggtgttcacgccgccaagtcgacgatggctagataggttatcccaattgttgtacgctgtggttttctatatcaatcccatataaacaggatgtagggctattacctgtcagataaggggcccgaacctgtataaaaatccctgtcttcgtctcttttactttaatctcgcatatatcctggtaccaacgatcccataccatccaaataccgtagtcgcgataccaaacgtcgacagtcatgttgcaagaaaaaataaatttgattacggatatatcttagctagctataaacttgatgcctcttgttgtattggtttaatgtggtaacataaattctcaatttttttattttgctatcacatccacctcctagttccagatctagatctagatcttgtaatatatagagagagaataaaatttttaatttctatttatttggtgcaatcaaaaaataattatattagtttgtaattgatgtgaccatgactactacggatacaaccattgctcatatcatggatgaacaaggagatataaggatcaagtcctccaagtgctggaatccgattcggccacctgctacactgctgacttcaaacggccgccgaatctgcatacgacctccgttttcggccttgagtacttgatggaaagttctcggagccctctttccaacggatccagcctcttctccgaattccatctcgtgtggccagaatcacaggaacaaggtgttgcgtcacctataatgggcctatgggcttgtaactttgtttgggaccccggcccaagtggggcccatgtggggtgcgccccaagctagtggagcacgaccctaggaccctcttggtcattctcccacatcctataagtagctaggtaccccttcagggtttctcgggttttaatagattaaagtttagccattgctacttgcttgcagcgcgcgtgtcggctagaccgtccgtctgctggttcttcggaaccccaacttatcatttgtattaaattcctatttgcaatatcagattgcttttatcttgttcttgcttgtttcttcgatttgcttgcaggaatagggttgatctgcaccggcaagatcaataacccacggagaggtgtatcaatcgctaaggcgcaacacaacgtctcgtacggttgtagtcagatcgtcaacgtttcttccaaatcgtagttatcacaactcaccgaaagatcgggccaacaacagccttgagtgtcgagaggaactcagggtccatcaggtggtatcagagctttctttgctcggtgagtttttatctacccataaccagaaaatagccatacaaaaaaatttgtatcatttacctagccatattgtgccattgaattgttcatttctatttttgccttgttgaattttgtgttgcatcgtcacgtcgtcttgctggtcttagcatctagttcgtttagagtttcgagttctagtcacgttttataccacagtcgtcgtcgcctccgtgtctctgttgtcgtcgggacctacgaaatggaattggctcactgccacggttctatttttgtagttttcagaagtttttatcggtcagttttggagttgcatctagcttttgcttgagttttggtttgcccgtgaatagatcgctcgtgcttgttgccggcgctgagaggaggaagaagaatttccaaatttgtttttggaagtttgagagtttaatttggaaagaaatagtagatcagattgattgaagatcagtttccctttttctctcaccaaatccggactcctagagatgccgtatccatccacccgtcgcccactaccaccgtgaggagtccgattccctccctcttccgttggtttagatccataccgtgtcttcccgcatagcttggtgaaaattttcagtgtgtccgattgtagatccgtttggaaaaacggaaccagtataaatttagcattccatttttgtataattttaattttggatttgcacttttacagttgagtccctgtaatttttatatttacatttgagtccctatgaccttatattgaggtccttgagtcggtttttgttaaaaaaaaggcagaaaggtgcttaaaaaaaagaagaaaaaaaagccacaccaaaaaaagaaaagaaaagaaaaagaaaagaaaagcaggaaagacaaaaaaaaaaaagagaaagaaagaaagaagaaaaggagaaaatcattttgttatcattgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctgcacagttttgattacggccgtaccgcaagtgtttgccaaggcatcgatacacccaacctccattggggtgcttggttgagtcggtgtacattaccattccgcttgctttggtaagaacttgtaagagcttggttaaaagcttgattgtgtgtgatatttgagctgccactacctagtagttgataggagcgtgcatatttttgtgtgtttcttgtttgctactaaccatggcaggattgcgtaagggaatacgagaacatcaacttctacaccttcgacgagatatcacgacttctccacgtgatgcatatgaggtacatgactataattttgaacaagttgcatctaagttaccattctatgatgggaagtacgattctgttgcatacattgattgggagctagcagtagacaatgaatttgatatatatgatttttctgatactcaaatgattaaggctgctagtaataagtttacctcttctgcattattttggtggacttatgttagtaataaacctgaaacttgggatgaattgaaaaccatgatgagaaagcgctctgtgacatcttattacaaatgtactcttcgggagaaattagaacatctgaaacaaggtgatagaactgttagggagtacattcatgaatttaaggtctgtatcatctacagtggtctcaaagagtgcaatgaaaatacaatgcgtagatttttcaatgggcttaattctgaaattcaggttttgcttgataatgtgacatataatcatattgggcacctattcatgcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagatcagcacatccaagaaaaggagaatggtatacttgagaagaaagaggatgaagcacctgcgatgtctaaagaaagttcgcaaggtaaattaaatggtgctgagagaaatgaaggtgagtattctcaaggtgagctacacttgtccacttttcatgctatagtagagcaaccattagtagaatcaattgctgagttgcctttgtcacaagttgatttacttgctgttccttgtcataaagaatagttgtgcgataatgcttcacttatatccatgccacaactagtgaatgaacatgctattcctgttgttaatactaactgcgctgattttaagcatgttaccatggctactacggatacaaccattgctcacatcatggatgaacaaggagatataaggatcaagtcctccaagtgctggaatccgattcggccacctgctacactgctgacttcaaatggccgccgaatctgcatacgacctccgttttcggcccgtgagtacttgatggaaagttctcggaaccctctttccaacggatccagcttcttctccgaattccatctcgtgtggccagaatcacaggaataatgggcctatgggcttgtaactttgtttgggaccccggcccaagtggggcccatgtggggtgcgccccaagctagtggagcatgaccctaggaccctcttgatcattctcccacatcctataagtagctaggtaccccttcagggtttctcgggttttgatagattaaagtttagcaattgctacttgcttgcagcgcgcgtgtcggctagaccgtccgtctgcttgttcttcggaaccccaacttatcatttgtataaaattcctatttgcaatatcagattgcttttatcttgttcttgcttgtttcttcgatttgcttgtaggaatagggttgatctgcaccgacaagatcaataacccacggagaggtgtatcgatcgctaaggcgcaacacaacgtctcgtacggttgtagtcggattgtcaacgtttcttccaaatcgtagttatcataactcaccgaaagatcgggccaacaacagtcttgagtgtcgagaggaacttagggtccatcagtaatatgccgatgatatgattttgttagatttttctaatatactaatttggcatgtctgtgtaaaaaaattgaaataaactttgtttttttattaatttacaaataacctttagttaattagtttttaatagcgataagttttttcaataaaccctacaaatttggttttaattgtgcaaataatttatgttcattttttagagatatggaaagtcgggaatggatgtatcattggccgaggtttttgtctccatatagaaacgaagtgtctaaatttattgctattgccaaggcacacgctgagaagaacaatatgaggaagataatttgtccatgtgctgactgtaagaatgaaatagcctgggacttcgacgatgcttttaaagtgaaggagcgcttagtaactcgtggatttatggacaagtatgaaatatggacacgtcatggcgaagaacaagtggacgggcctgaaaatgtagttccgacacaagttgaagacatggtgcatgacgatggttctgttgaggacaaaatcgacctagaggaaatgttacgtcatgcagaacccgaggtgctgatggggtcggctagagctttacagaaggcagctaaggaagttttgtacgatgagtcaaagggctgtgacagtgagttcacaacactacggtcagttcttgaacttatgaggttaaaggcgaaacatggatggtctgataccagtttcgacagtctgttagaacttctgcagaaaatgctcctgaggcctaactcactaccatccagcacatatcaagcgaagaaactcatatgtcccctttcacttggtgtggaaaagattcatgtgtgcgttaatcactgcatactgtacaggaaagagtacgcttcttttgatgaatgtccaacatgcaatgctagccagtacaaatcgaatagcaatactggcctagaaccgtctgacacaactgagggaagacagagaaaaatcccgcagcttgtgatgtggtaccttcctgtcaaagaccgcattaaacggatatactcaaacccaagagatgcggaactaatgtgctggcatgaagaagggcacaagaaggatgggatgattcgacacccggcagatgctcgtcagtggataaactttgatgctcagtatagagagtttgctaaagacccacggaacattagatttgccctgagtattgatggagttaatccttttggagacatgagcagctcacatagtacttggccagtgctgtcaccatgtataatcttcctacctggctttgtcaaaagcgaaaatacgtactactctggatcctcatacagggaccccgtcaatctggtattgatattgacgtatttcttgaaccattgttggaagatattgctgatttatggaaagagggattgaaagtgtgggacgagtacttaagggaatacttcacgatgaaggccatcatcttcgtgaccattaacgattatccagcaatgttttcagtttcaggtcaaattaaaggtaaaacaggatgtgtgatctgcttgaatggaacatactattggtatctcccgggttccaacaagcttgtgtacatgcggcaccggcggttcctacgcacaaatcacaagtaccgcaagatgaaggcggagttcgagggcactgaagagattgatcctgcaccaaaacctacatcgggggaaaaagtgtgtgcaatgacagaaaattgtttgcgaatttggaaatgtgactaagaaaccatcaaaggggacaaagcgcaagaaacccgagaagactatgtgggatagtaagaagcaagatgatagttcgaagtcagatgataaactcccttccccattcaaaaagcattccatattctttaagtacctcccgtactggaaagatctggaggttcggcatgccatagacgtcatgcatctagagaagaatgtgtttgataacatagttggaacattgttagacatgccgaagaagactaaagatggtctgcaatcaaggatggacatagtcgagatgggaatcagggaagagttacaccctcagaaggagagaagaatggcaaagtatatcttccaccggcctgtttcacactgacacctgaggagaagaagtcattttgcaagtcactccgtgatgtcagagtgcccataggtttcttgtcaaacatcagtcgactagtttaaatgaaatatttgtcggtatctggttataattcacacgattgtcatgtcttgctcaccgtgtttcttgcaattacaataagggccataaaaccagagtatttaaaggttgctatcacaaggtagtgctactttttcaacgcagtgtcacagaaggtcattagtctcgaagagttaggaaatctccgtacattcgcacatgagacacagtgccaacttgagatgtgtttccctccgtcattttttgatatgatggagcacctcattgttcacatagtgccgcagatggttgcgcttggcccactgtacctacatcaaatgtggtcatacgagcgttacatggcggttttgaagggttacgtccgaaatcgtgcacatccagagggatcaatggttgagggttatagtactggagaggttgtcgagtgctgtatcgattacctcaaagatggatatgcaattggagtacctgtgccccgacacgagggcagattgagtggtaggggaacgataggaaagaagagattcgtcacccatgatcacaaatcattccaagaagctcacttcagtgtccttcatcagtttgctatcgttgagccttacatcgatcaacatatcgagctaatacgagctaacaataagggtcgcaccaccgagtggataatgaaagaacacaagcgtctcttcatagattggttgagagacctagacttacctaagggacaaactacagatgaaataactatgaaacggttggcttgtggtccatcaactacagtaaattcttggcaaggatatgacattaatggatactcgtttagtacaagagcccgagataataaaacctgtacgcaaaacatcggtgtccgtgtggaggcaattgatgaagccagggaaaaacaatcatacttcgggtttattgaagaaatatgggaaatcgactatgggcacacaatgcaattccccatatttaagtgccagtggcaaaaatacccgaacggggtcaatgttgataagttcggtcttattg

SEQ ID NO: 65942 - DNA, 1882 bp, Oryza sativa
tccgttcggccgcgcccccatcacaccggcgctgccaccgctcgttgcgcccctccggcctaccactctttcatcgtcaccatcctaatggagattttttttttggtgtgtggtgatgcgcaggggcaatcttggtattttgaaaaaaattctcaccactttaagcaaggaaataataaaataatacgtccagtgtcctacggcaaatttcacagtttttgtagtgccttgggcagtgtcacgttttcgcggtgtcgctcagctaattacacaatttttacgtgtcctgtagcaaattttgcgtatattgaaggtccatctatttggattgatttttaatatattctccttagtttcatgattattgaaaagtgttgggaattttaaactatttaaataggtcatatgttaattatatgtggttattgaaatacattaggtattttaaactatttaaaataggtcatatgtttattatatgtgattcttgaaatgtaatcggaattttaaactatttaaacaggtcatatgttaaatatatgtgataggaattttaaaatatttattttctttaaatgaatactactaggcttttgcccagtagtgtaattttataaatagaagaaagttatttacaaaaaggaaaacaaaaaattataagaggatcaaacccccaaagcaatcagaaatgttgtatccagtaagaaacatgttgcctaagttcaccattcattctgcacatatgaagaagaatatcattcctaaaagcataccaccaactatcaaaagcaggattgacgttctgaaaaatctttccattgcgctgtttccagatatgccagcaagctatgaaacaaatctccaagaaacccttccctcttaatctcagtctggctgatgtgcgctagggttcccaatcttccgaaaagttctgataaacaacgatttgggtggagtcgcgacacaaatcgatccggcttcttgaacacgcacgctcttgggccccgcaatcgcagcaccacgtctcctctggttatcacccgtgtcaaaacgcggatgacctcgccgagaaggcaaatccctgtttgccaatcgaagaacacaaacaagaacgagatagaaaaacaaccaaaattgcagatgaatgattaagctcacgagttacaaaccgatctaacggcgaaactgttctcgacagattaatcgaagtaaaacccaaaaacctaaagatggcggcaggtactgatatatagagtttagggtcgtgcaaacccctctcgacgcaaccctaatgggttccaacacgatacacgggccaaaggcccaaatacggtgacgcagcaccgagacagattctggacgtcaaattgttcggtcaattcctgttgactcggaaagaatttggacatgggactaaaaccattggaaaggttatcttcttagctttccatccatataaagaacgccccaatccgagcacgtatgcgacctgggcgcccgttttagtgcagactggtcctggactccgaattacacccgacgtcgacttggtttgggcctccaccttgacttggacgtccccgatgatcctccatggctctaagtccttctccaagtgtctccttgtcccctccattgttcctaatcacaatataatcattaggtagcaatctattctcgaattcatacaaagaagaacataggaacgagctcacctctaaatttaattgtcgcgcacgagctcttgttatctgtccttaaatgaccgttggaggattgttgtgtctatccgaggtagtgatgtccgcatcactagccaagacaagcatatgaaagaactccaaagatgtattccaagaaattccacctccaacatctttta

SEQ ID NO: 65943 - DNA, 20500 bp, Oryza sativa
agatcagtagttggtacacacatacatagccgaatcacaacatatcacgaatgaatttaggctaagaaagttaagtgcttacattagggccaggtaggccaacaattatcagagaacaacagcggaagacaaaataattcaagggcccggttgacatgccacaagtagtcgactggggaacgagacctagaacggaaccgcactccggtcatcttgttaagtacgcaagcgtactaacaagggcttctcttcatcactctgctaaaagatatatatatatatagagcaacaatgagtacaaaagtactcaacaagccaccccacaaaatgcaataatgtacaggataatacaagacatggctatgcttactttgcgtaaagctgagttttcaaataccatttcataaacttaagacctagcataaactgatcaagttttaactccattgttcattaaacagcgacggttctgtccaccatccattgtgttcccaaggatagcttcccgccattggtcgtcatggttttctggggtctacctcttcccgcctctcgagaagttgatcaaccagtacaaaatcatcatgcatcatcccacccaatcaatttaagaatttagactctagccaagtgtaatacatgtcccagtgctcaataaccgcgagcacggctattcgaatagatttggtttactcacactgcagtggatgtacactttacccgtactccgcgacttgcccaacacatgagcctacgtcccaacgaatgagacttgccacggcaaagcctttcaacaacctcacattgacagtacccgctccatgaacttgagtcctcatgcactctagacgtcataagtttctagtagtgataggagttctagcactcccgaggggaaaactcatgcaagcctaacattgtatcctgttgttgaacccaatccatgctttcctcttttgggtatctctttgtagtcttgtagtcctgacaagtcagtctctggccatccgtatcgggtatcagccagcagactgcttgttcgtccacacacctaagtgaaaccactatgcaggggtactgcctccgctctgctatctactccgctaggtctatacccattcgagaagtacggctgtactagggtcgtttcatgcttaacttcatggatcggtccttaactgaccagggatggcattagcctttaccggacaccacccaaatccaccagccgccccagtcgaaaacatttgtttagttttaactttctttcacaaatcatctcatcaatgtcatggcaatgtggcgctcatgtctccacattccatatctcaactaccttccccaaagtagtttcccaagcatatagcattcgataaatataagaatgcatgaatctaaagaagcattactaagcatttatcataattgactagggactcatacgtaattatgggtacaagagaataatgagataagcaataatcaaaggcatggcataataacaagtaggatattcatcactgtatgcaattttatttgtaaacaaaacaatgtcaattgggatcaacatgcacaagggatggggtgatgacttgcctgctcgggatagttcttattcttgatattatcttgatcaatcttcaccttttggaagctacatacgctgcctcacgactaaccgatatacaatttctataatacgcgagaaaaaccaatattcaaacaacaagcaaatatgcatgagcaaaattaattgttggggtcgaacatagggctgttcatactactcgtgtttgctaatggattgtaaggtgctacgaagtttaaactatggggtgctcacatatagaactcaatactcaggactatatgtctatggctcaattatctatcaactatggctatggggaggattatggctacacatgcatctatctaaataaaatggtttctgtcgttggatggatcaatttaggatcaaacaagcaatcagagggaatcatttatattattattttaccaatggggcattattttaattatgatcatattttacttgtcattataaattataaatgggttaataattatccatgcagtatatgctagatctgtgaggttataggtgcagattatttgtctgtgtggtctcataacgatcaattacagaaggtcaagatttataattagtatttatctaatatatgtgcttatcatgtacccggtagtttaatgtatgcaaaagctaggttattgtccatcgtataatttaaatggaatgtacagtaattgcgagtgcaaaaatatactaatattagatcatttactgagcatgagctatttactctaagctatacagtatatatgatgtaggtggatttggtgagttggtactgtttaccaacttaagattcactactaactaaaaatatactattccatgggacatgacattaagtaattagttccgtataggtgatttaatcacactagctctgtcattattcctcataaacaagtcaaagacttatctatgtgtattcatattttatttacataatcacaagggtaaacttgatttaaataacctataagtcatgggtttaatcatatggccatcgaatattaaataagtactagcattttcctatacatccattcatttgagacattacctatacttagtttacatggttgttattgtgacaaaacatgctagaaacaaatattagcatatttttaagttgaccataatctaatcatttgatattaattatttaataattataaatatattttattaaatagtgagttatataccattggaaaggttatgaaattagatgaatttaggttcaagtttcactcaaatcggagttaaaatgagcaagttatgttagtttaaatattcaaatttgaattagtccaagaaattgtaaaaaggcactatttataattcatttatttttaatccgaaacatatccacaaccctagtgaccgacaggtgggacctggagttccttttttttccaccggattaatttttgctaggggaaaaatgggagtgggcccggcctgtcagcgacttggccaggagtcgtcttctaccttcgtcttcttcttcctcccgaccaagcgggagcagcatgggaacacggcgcgcacggcaaggccggccgagggtgacccgatggctgccaggggaggcgcggagcagctctggcgatctcccgccggtgaccacggcgcgtggcgacgcggaggcgagcggcgtggcatggctaccattgccgagctcgggctgcaagtggctagggcaaaagggagagtttctgattgaattggtggtcgtgggagtatctacggggtatggggatttcgtttttcttgctagatggagaggggagctcccgggatagtctacccacggggagcttgccggcggcggaacggcggtcgggccggcacagccataggcattaatcgtacaaactggagccggtgctagctattagaggtatagagtacaaactggagccggcacagccataggcattaatcgtacccagggatggagagtgctcgaggtgacctacccacggcgagcccgccgatggcgaagcggcggccgggatgggacgccgaagggcgctaatcgccaaaattggtgggggatttagcttctacatgactaggaggaaatataggagcgaggttttactgagagacggcgggatgacgaagttcggcggtgcgctgctcagtgttgacgaaacagggggggctagcagtcggcgacgcttgcaggtgttcgatgcgtggttcccgacgtccagcggtcctcgactccctcaatggcaatggcggcagcacagctcttcctccactccctccaactgttagtgatatgccctagaggcaattatagagatgattgtatcacatacaatgtttacatatttatccgatgttgttccttgaaatagataactccttattggttaatgaatatgtgattctttcatgagactctttatgttgtttgttactatttctaaaggatccctgatcaaatatcatatgtggaacaaatatgtttatatgatcagtacatgtattaattgatgatcatgtctcatggatcatggtatagagataccaaattaataatgtggacatatgttggtgaacatgttgttggatagacccaacatgagacactgcaagagccatatgtgttgtgtcatcagtgatctcattgagtgttagtgttgaatccttagacctgagattatcatggttctcaacatgtgtagtagcttacttagggactgctaaacgctactccgtaattgggtagttataaaagtagttttcgggtatgctatgaaacatgtagtgggatatgaataatcaaaatgggatttgcccctcctatggagagatatctctgggcctctcgatgttgtagattatgaaagtgcatggccatgccaaaggtgattgaggagtcaatcacaagttatataatctatcaataggttcgagtgaatgattgagctattagaggatggcacatttctagccttgagcttaatcgatatcgtgaggcaaaggggttcatacaagtatacactagaggttcagccgatatgatctttatgtatgcccggtgggtcaatacgttctgctaggggcctctgttgacgcgttgaccgaaaaggagttttcgggttacagccgagtatatatgaacctacagggtcgcacgcttaatgggccagaataaggggattggatagagatccaatatgagcttaattcggatagggatccgaataggagtcctactggccttggaggcccgagtgatggatcctatatattcgtgaggggtgtgaccggcggaggcattgcatcacatgagaaaccctagccgtcacttccctccccgagcaaaaccctagccgcgcgcgggtgctagaggcgccgctgtacgtgtggataccggtagaggcgccgctgttttgcggtgctgatcggtgtggcagtacggcgaggagaacgcacgaggaggacaaggtcgagccggtgcgattgactacttcctctacatcgacgcgcgctacttcgcgagagttccttcgacttctcagcgtcttcttttgctgcaccgcgcgtcgagtggtaacaatctatgatctaatacttgcatggttcctggtttacgcgatagaaaattttgatttatgctatcgtagcctacccgtatcccaacatgtccggccggggagcctcgcaatggtgatctctagcggtggtgagaaagtgatcgcaaggtgttcgatgaaatgcattcgagggaaaaaggcagagagggatggggtatttatgggggcttggcttggggataagccaggatggcgtggaggataagatcggcggctggcgcactcgatggctgtctacggcctaggttagggaggttgacgcggctaagtttcctcctctctcactaactcggggatttggggatccatggagtaatggtggcgctagggttgcaggcctcacagctagatggcttgaggagaagccgtttatccgatgggcacgacgagggacgatgtgacacgaggagatgggtgagaggacaatggtgacgaagaggcaacgtggtggccgttatccgtcgtggcgacgcgacggcgacgggatggcgatggcgcagctccgtgtttcctggagggaatctgggagatcggttggaggtgcggcacgggcgtggctggcgctggcggatgcggcgcatgggcatggtagcggtgagacgcgatttagggaatggcgcggcgcagagggatggatgcggcgcggtcggtttggggccagacccaaatcgagcatatggtgggcaatgaatagttctagctagaaaaagagagaaaagagagaaaaaggaaaaaggagggggaggggctaatatgcaaaagtggctgagattggaattgaattgagatgtaacattatacattttttatttgaatatttcatttaaatatttattcatttatttgattatttgttacaccccaactgaatttacttcgcccaaaattatcctatataccatggatgctttgatatttataggaatcactgcacattggttgaatttatttgtatagcaatgtattttacatggacatgtttaatctattattccataaaagtaaattgagacttggtaccatattgatctaaatgtttagttaaacactcacataaatgtattttatatataaagctcaattcatttacatgatcaattattttatgcgagtcaattttattccatgagagactcgatgaatgttataaatattaatttaattattctagtggaacactcctatatatacagagtcattgtagtggcgactatttcatggttacttagatgtcatgacacttgtcacatggttccaatatttaatatttaacctataaattaaattagtaattaaccttctctttgtattgctttgttgtgtgtaaatatttaataataaatatcttaattttataagtattacttagttgtacagctttagctaaattttcaattgtgacaatttatagtttggcaagcaataacaaccataacatccagcatgatgcaaaagttttaaaaagttcaaaattttagtgatttttattgtcgtgaattttcaggatgttacacaaatgaacaccttaatcttcatgacacactttgtcttctagatccatctaaaaggccttgagggttgcatggcagcaaagttcaacttgtaaaaacttttagaagtatagcatgctttattctagatgaagctccaaattatccccaaattgtccagacaaagtcaaggcatcaagctcctctctgagttctaagaattccccataagaatcataagttaaaggcaacttaaaacaatcctcaaaaagcttggcaaagataactgcaactgattcattcctatcaaaaacatgagcacaaatatgagtatgggaaacacttctcactcggccattccaaagatcatcccaatatagaacagatgttccagaaactagatcacatttagcaattcctctgaagaagtcagagagagcaattatatccctccaccaaaaagagcccttattaaagatctgatgaggagtttttgactgataataagaccttcatattaacttcacccatggaagattaaactatttaattaggtcatatgttaattatatatgattattaaatgtaataggaattttaaactatttaaataggtcatatgttaatatgtgattattgaaatgtattaggaattttaaactatttaaaatacgacatatgttaattatatgtgattattgaaatgtattaggaattttaaactatttaaattgttttctcataaaatttgtggttttattacatgtttaatggattacttattattgttttaaatctatatttaatgaaattaatttggcccgtttaagtttgtaagcactaaaatgtacaaatgttcaaatattagtcccggttattaaccttagctgggactaaagataaaatttcggaatagcgagaaaatatgttttgtcccggtttatatctttagtcccagttagaaccacgaaccgggactaaagatcccggactataaatatgggtccatcggcttccccgtgcacaacacttagcagtttctcgatctcaatctcggttgcgcgccatctccgccgagtacactgccgcccgagccgctgccaccgctgccatcgtcattgttgcagcagctgacctacgccgctctcaccatcgtcgcctccctcaaggtgtgggcgccaccggatcccgctgtcccactctctctctccctccctctctctctttctcggcccggacgacggccacaataaccacaagcgccgccgtcatcatcatcgttgtcgccatctcccgctgcccccgccgcgctccaccgccgctgctgccgacgccgacgtcactggtgccgccacgcgggcaaccactgcctctgcactactgatgctgacgccgctgacgccgctgctattgatgttgccgccactgtcgccaccacggccgacgccgagggctgcaactgccgggactacgaacaatgaacgaccgaatgcaaatgaacgcatgaacatgaacgaacgaaccacgaacgtacatgagtgttagaacaacaaatgaacaaatgaacgtaagcgaatgaacgaacgcacgcgaacgaacggtcgaacgcaggcaaatgaacaaacaagtttcacgagttagcaacttcaacgagtttaacggcttagcgagtttaacgaatgaattaacgaacgaaggagtttcatgagtttaatgacttagcgagtttcacggacgcgaatgaacgatttacatgagttgcttaacgacttagcgacttcacgagcttaacgacttagcgtgtttcacgtgcttaacgacttagcaacttcatgagcttaacaaattagcgagtttcacgacttgagtcactacctctcacataacgatgtatatatgtttatgttttgaatttagacttgggaccattgtatatgtatatgtacatgttttaacttaatttttttcctactcataattacgtggtccagctgctggccgccgccatcgctcaagcataagtggtcccaagacctccaagcaaaataaaggcaaatttacatgaattccctgaatttaatatgtacatgtaggtgtcatatttcttaattagatagctaggtgaaattccattagttgtggttcgtagttctccgtagttgatgtgtactacttacactacaccacgacatacatatgttgtctcagaatctgtcggcaaaacacccatgtgctgacaaactatctgtcagtataggttttcccgacagagaaggtctgtcaggacaactgctgccgggaaaagtatttcccgacagataatcttttcccaacagaccgattgatggtactacaaaagaattaccgacagacactttttagcgacagatgacccttttccgacagttaatggaatgccgacagataagtttttacaaagagattgttgaatacactcataaggttcttatatttcctaccgacaacaagtacaatttttgaagacacgctcgatagctccattgaaaacagaggaaccttgctgaaatcatgtcattcatgttccctattattgcatcctgtaattacagttgatgtctttgcatttatattatcagtgtcatactgtaatacgtttctctaagttcgatcaaaagctacttctaacttctaagttcatagctacggttaacttttgcattccaattatgacatgaacctagaatagtgagtcagaatggtctaaaaaatagcacgagggtaccatttgattttttttatgcaaaaaataatgcaataacatgctagaatagtgagtcacgttgttggctagctggttgtaaaaaatgatgttgcatattaactttgtacagtttacctcaggagtagcaagatagaactattagattaaattgtcaataggatatggctgcaattagttttcaatcatgcctctttagctctattgcagtccacacagttcgcatttagtgtttgtaagaaaaaaatcaagagccaacctcaatttgtacattctctcagccattcatgcacgacagatgaaaacagtaggtacgaaaaataaaatactgaaacatcgcaaaagcatcaccattcaacagggcagctaacctgtataggcttcactgatccagaagatctttttacctgacaattatatgctagctcaagttgttcagaaacatcttcacgcaaggggatccaatcaagccctcctttgcgagcaaaccagtggcccctcaagacacgcctgttcttcccattccagtacacagggaagcaatgacgtctcattaaatcaacctgcaatagtgtatgttcttataacaaagacatattcaatatctagcatcagctgcaactaaggaaccttttggcccttcgctgcatttagcgtactctctccaccagtatgcaagcatagcttcctccctctacaaaccagtaaaccagtattgtgatctcgaagacaagtggtttaaaaagactgagatgacattatccccttgtattgtagagggactagcacaactctcttggaactagattgtctagtaatatcgcttttcaagtggattgtttttatcactgttagaacagtccagttttcacataaatgagtatacacttaaggcggcattggtgttaaaaaagataacctccaagaacgacgcctccaatgcaagagaatctctcatgctgaaccggaagtagtcccctttttcccattatctctgtctgtggaactgaagcagagagcatcacgtcaacagcgaaccgcacaaaacataagatcagtaatacgtttaccacacacttcataattttaaagtccaaaccgatgatcaatttaattgagcacagcagttctgaagtatgaagacatgccacggtcaaatatgaatctaatgtaaatgggcgttgcttcgagttgcaagttcaatcagcgaattcattagcgcacgcatgtgaacgcctctctaaatcacagtaccctatcaattagtatattcaaatcagcaacagtctcacatgaaacctacattctagctaccacaagtgactgaagcggtcggttaaactggtggtactggatgtagcattctgaagcaggagagcccgagggccaacacacggtgagcggatgcagaaggcggggggggggggggggggtgccccttgcaagaagtaccagcggacatcctcaccgtcgaaggggctcttggtgcgggcaaggtacttgcggcgcgcggcgcagtgctcgatggcgtcctccagcctggcgatgttggagggcgtgttccgcaacgagtccggcgacgcgccgcatccgcgcctccgggggccacctggcttgtaacttttgcattcgatcagaccaaccactacccgtaccggcaacaccttggaagccatgaacctagggtttggagttggggatttacctcgtagaggctcttgctctctgcggcggccggcgcgggctcctcctcgccgccgccgccgccgtcgccgtcgcgggaaaccctagccctcctcttgcagcccatctggtggaagcggtagtggaggcggcgtgaggtggtggatttggcggagaagtgatggcgtgaggtggtagatttggcggagaagtggcggcatgccgcggcggaggaggaggagaaggaggccgcgcgccgcggcgatggatttggcggagaagtggcggcgcgccgcggtggaggagaaggaggcgtgcggtggaaagcgaagaagtggcggcgcgcggaggaaaggggacgaagtggaacagcgcctagggttttttttggcgtggattttcttttcagagtgattttttttggcggttctttttttatttttccgcccgagccggccgagcgatcacctcgctttatccgaaccgtgggatcaagatccgacggacgaaacattgctgacagatggattattgataagttttccccacatataattggtttctactcttaatattgctgacagttattttgacccaataaatatttggaattgctgacatataatatgtcttattatgtagtattgccgacatataatttgccaaaagcctttaccaacaaatagtctatcaattattgtttatctttaccgacagatgtctgttggtaacatagtgtcatggtgtagtgttaataggacattttttttggtacttctagaattatcgtattccttcagctcgaataccaacagaaataaaaatatgaagttaaaaaaacacatttcccgtaaagtaaaataaaggattttgcttacttatattttcgtgatacgaacaactggcagatcgcgatgacgaatagatcctcaatgactagatcgcagagggcagaggtcagtattggatggataaggaggggaacgaggaccccaacgaagagggcaaccaggatggcaacatggagggaaacgaggagggaactgacaggcaacgaggtgctgcgaggaagctggagggcagacacattattgctgatgttgccccaaacggcgaaccagtagccccggctggtatactaaggaagtttgtgggactcagtggttgggtcgtgagggatcacgtgcccatcagcatagtgtactggcgtcaaacaaggtcatgtggagatgaccaaagttttctcccagatacggagaaagagatgctgtggaccaccatgctctagactttcatgatccctgaggcagattaggccagagtgaaagaatggactatgaagaaaatggccaaatagttccagagctacaagtcatatatgtacaagacatacatcgtgaagggcataacacctgatttcgacgagtttacgaagctaatggatcattgggatgcgtttgtcgcatacaggacaggagagcgtggaagtgcagatagaaaagaataaagccagtgcaccagctagggttagggggttataagaagacaatccccaaataggaaaaaatggaagccggattgatagaaaaagatatcgtgccggccacaactaactggcttgaatgatgaaagaattggtactatgcacatggtggatcgctcattcccgttgatggctccctgatatacgcaatgagattcgcgaatcaacaagccgacttatagatgcagtggatggctatgctcggggaatagggaacattccggcccaacagagagaaggacgagcttatgctcgcaatacataatcctgagcatccaggacgaacgcgaggcaaatgcatggttccttggaaataaggatttcaagaggacatccgcacgtacaagagtcacataaggagcatgagagataccgaggctaagattatagatcttgagtatagagcctcgaactacgatgcaaggattacagagaaggtgtcaagacaagtggaccaactcctggccgaacagcggggacttgatacacaactgtctattatgcccgtcatggtgagcacctcaggcaatcgcagtagcagctacgcctcaacggggcaagtaggatcatagagcatggaagcagtgcaagcacatgatgaacccccctgccccattgatgaaatcacgcagcggataccatgtgagatgcatattcccatcaagaatttgtcaatcaaggtatgctcgtagttttacgatatgaattgtacattccgaaacttggtgcataggttgattactaattaacaaccttgattcttgtgaaggtgacgtctgtcatggccataccaacggacccttcagggacataccatcgcaggctaattccacctggatacacaagggttgaaattgagctagtggaatgcaccttcgaggatctcgagttggacatccccggaggagacagggagacgaaactagtagacacaacccacgagatgtgacttcctatctggccggatctagattccgcttcccccaaccacagtgggattcttcttgccaggctggggcttcagttggtacaggtagcagaagaaggcaaaatgcgggtagataccataatacccctcgcacatgtaattgaatatggcaatctgaagaatggagttgggattgagatgatggacattgatgccatggaagtgtagcagaccttggaagaaattgccggtcggtagcccaagtctgaactggaagaaggggaggaagactacaatctcattggtgtttggagtggggaaatcttcctcgacgtcctcccaccagttgatgagcgcttgcaggggaggtatccctccgccaccaccttctccagattccccgccattactgtaaacggagcccaggcaacagtttggttgaggattggcacgaattccgctgttgactgggacatggcagaggaggaagacggagaatggctggaggagcggagaatcaaggggctattttgttggatttaccctgagagcaaaaccctaaatcgccggaagcaaagagcagttggggatgagcgaggaagacgaaggggcgtgccaaatatcaagggaagtgggcaacggcgctcccgccgggggtatttatatctcttggtttcctaacaagctggcccatggagttaccctaatttggaaaatcgagtctggttttcatccctgtccaataagacgatggataccggaaaactttactcaggtccggatgagtgcctctatctgcatgctttggaaagagtacttggccagattcgactccgtcacttgacaagtctcgcttcatattcttcatcaagcaaagtactcgggggtactatggatattaccgtacctaggtggtacatggaaggcctttgggtcataactcgggggtaggtcatgggcctgggcccacgggttagtaatgtaaatggcagggataggaaataaggaaacctatcctgcctgatctactcagatggcaggtaccccgattataagggataccgcatcatacttgccactgatcaccctgtcatcatataaagggcatcagcaggaaccctaagggtcaatcactcctcgcattccgataccggacatagatccaatcacatacaattggactagggtattaccttgccttgaggacctgaaccagtataaacatatgtgtcaccacttctttctttgaccttgcgcaccctaaaaatttcatttccgatcttagaaatcgacacttgttgatttgtgaatcaacatctgaatatcaaaaatttacatggttagattatgtatgctgagtcgctcagtgactcgtaaagggcgtagttgcaaacgaaaagcttgcatgtaaaaagaattgaattagaaattagatgttcaaatcaaataacaattaaatagtactaccttctttcatattataagactttcgagcattacccacattcatataaatgttaatgaatctagactgtctaaattcattaacatctatatgaatatgggcaatgctagaaagtcttataaccttaaacggaggaagtagcaattagagctcacgtgttgttgtgtcgttcatcactgtcacgaccggaaataacccaacgggcgttccttacgtgcgtgcattattccttgtcccaggaggcaaggtacaccaaaagttgatacaattcagagtttaacaagcggaagcgtaaatagttaatttattacatgggcagcgaaggcccagcacacacaaagacaaacgggaaacagcggaagactagggcgacgaccacaggcacttgacggcaggcacgagctagacaccaaagccttcatcttccaggggctcctcttctgggtttgggaaaaattgagcaagactgagtacaaccaccgtactcaacaagacacacccacaagtgcagaataattgctcaaagccattttgtaagtatggtcctagagctatacaatattattaaacaaggccgtgaacccacacgaacctgccttaacccaaggcctacgatgattcagatcgaactggcaacccgaccctgggtcccagctcgtcccaagccaacccaggccaaccatttcacattttagttgttaaacaggttttaagaattaaaacactaacttgggtacattgctcggcttgcccataaccgagggcgcggctattcgaatagattatactctgatcagaggtgtacatctttacccacaagacacctcttcctcacgtgtagccacgtgccacataccaccacggtatacggacggaagacgtgacatagtttccaacccatcctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttacacggccgagatgctactatcaaaaccatgcaccccgagcccagcctaaaaccattttggggattttgaatagagggagcggtgtgaatccaattccacaataattaaaccattccatagtgtccaggtgatgagaaaattccaaagtctagagttgtaaaaccacctaatgttgcctaattaatcagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttcctaagctgcagcgtctacacgaccaatgaaaaaagaaaagccttttactctaataaactccatataacaagtaggaacaaagcacaaaaatgggttcttgacttcgtaaggaaaaattagagacttgaacggtccaattccgagttcaaatggccaagatatggccatttgaagtttatatgctctttaaatgaatatttgcaaatttcttcatttaaattttaattaaaaaaaaaggtttattgtgtcagccgaggggaggggcgctcggaccgggtccacgggagtggggcccccgcggcagcctcacggtccacggtggaccgggcgcacccgggctcacacctgccggcgccgtgggtcccacgcatcagccgcaccccaggacgcgggcggccgacggccgggccccacgcggcagccgcacggtacacccgaaagcggccacgccggcgcagcggcgggaggcggcgcgcccgcgcccctatggtcgccggcggcggccataggcacggcggagcggcggccgagagaggggagggaaagggggaaatgaagcggtggtccacggctcaccctgggtcgacagcgacggcggaaacggcgaccggagcggaaaaaggcggcggcgcggctcgggtggacgggggcgacggtgctccggcggtcagcgaccgaaacggagagtggacgaggtcggcgaggatgcgccgaagccgaaggaggcggcgccgaggtgggaggtggtccggggcgacgacggcggcggaccggagctcggcggcgacggcggagagagagagcgacggcgcgagctcgattccggcgaggagacggtgcggcaagggcggaaacgggcgagggaggcgcggggagggtttatatagggttgggagtgagagagggcggccggaagaggggggacgggcgcgggagacccggccgccattaatggcgccggcaaggttaggggaggggtttccaaacgaatccgagggagagagggagggaaaaatggggggaaagggggaggggatcccggggaataattcccccctattgattgcgcgcggggacggcgggaggcggcgggattcgcggcggcggcggcgctagggcgcgggcgaggcggcgggagcggcgggaggaaggggatgacgggtgggccccacccgtcagcgagggtggcgggcgagcccgcccgtcagcggcgcgcgcgcggggagggggccgaatgggccgcggggagaggaaagggagggggaaggagatgggccgagccggcccaagagggagagggagggaaaagggactttttagagcttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgtgacaatcacgatgcgagcgacgtcgtttctgttatctggctcacaggatcacagtggaaatagcaaatactcaacgtgaagacacagtggaagcagaggatttggtgctgcgaaaacttgctgcagcttttctgaactttgttcaaaatataaagaacagacgcggccgggcttctcgccacgaacctcaacaagtgcgccacgatcagtttgcaacatgtgccatcccacacgtccttttcgctacacacgacgcgcacgaacactcaaccacgcagggaggtgccggctcagatcctaaaaaccagctaacaagctaactgaaaaaaacagaaacgctgaagaaacgaaaacagctagacacgctacaggatacagagtaactgatttcatgaaaaagcttcaggattatccaacgatgccaacattgctcctcctaatcctgatgtttgggtttttacctcaacgactccacttgtgtcacgcagttcttggaacactgcacgacccagcggcttcgtgagaacgtccgccagctgatcaccggtggggaagaaatccacttcaattcggccatcctcgatgcagtcacggatgaaatgatacttagtatcaatatgtttacttccctcatgcagcattgggttcttgcacagagagattgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgagacaactagatcgtcagatctataatacacccggcggattcaattccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgagtttcctatcaacgagcacgatggaatcaatttcatgagtcgccgacttcgctttcgctttgggagttttcacttcctttccgtcgaccacttcttcaagctcctcttctctgacttgatccaaatcagtcggggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggtctattatgccgccgctgttgagcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctacacggtcggttggtcacaccaccgttgatgggcatcgtcatctacaccgccggcctgcctccgtcgccaccgagtggtgcctccgcctacacggctggcctattatgccgccgctgttgggcgtctacaacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgcccctgctgtggggcgtctacgtcttcaccaccggcctgcctccgtcgccgccgactggtgcc

SEQ ID NO: 65944 - DNA, 1680 bp, Oryza sativa
acctataaaggtgagttttcaatcttattaatccaacctttaacattattgataagctttcttatagaaaaggtatatcttctcaagtatgcggaggaattgttttcattgaaccatttatggtgtggtaaataaggagtgcaataatatactctctccattccaaaatataaggcataaccactcataacacaaaaccaagaaaacatttaatcaccttcttagtttggatcatgttgatacatacaaacaatgtgattgggaggtttgataatataagatttaaaacaaatcaattttataggaccaagatatgctagttaatgtatctatgcatgcatggcttatattagtatgagatatgagaaaaaagtggttaatccttatattttgggatgtagggagtaataaataacggctgtgtgctatacggtgcaggggctagtaatttttaaagaaagtgcaaaatcatataataactaacacagacaccatgtatatacgcgaatgaatgagatttttattttcaaatgtgagagcagaattacatcatagccagcactgtgtcaaattaatataacccttttttctcatctcatctcagtggtaattaaggcggcggacatggtacatatgttgggcttccgcacgcgggggaattgggcatccctctggtgatggccgtgggacgcacaccttgttgacattggcgcctctcccggcggcagaggccatgaccatcaacagcgtcaggacgaggaggaggaggacgggcaccaccagctgcctgccgccgccggtgctcgccgtcgacgtccagccgccggccatagctaggggacggcctggaactaactagccactctttttattttctttcgtcacagcctgaagcctcacgacttgtagttactatacctttggttatgtcgaatggtagtactgtatatatagccgtttatcctggaactgttgcgtgatcaaggccgagtttagttccaaactttttctttaaacttttaacttttccaatacatcaaaactttcatacacatataaactttcaatttttccgtcacatcgtttcaatttcaaccaaacttccaattttaacttgaactaaatacaccctaagttaaataaaatggaaaaaaacaagggagatcgactagctgcctaggagacccgtgcggtcaactacacccgatcgatcgactggtcgaagtgttgtttgtggtctctcaatcgagctcaattttgatcttccctcttccaaacagcacaggtaatactatttttttgatgatgcaagcttttattaaaatcggtctattacatcaagataatataatataactgcgcactgagaaggcttccgacttctacataactagaatacacgtaaccaaaacaaataccagtaaaagaagtatatgaagaattaagaaccatacactagtacggagagctctgacttcggtatcctgttgcatagttaatttcacaagactgaactgaccaactttgcattggaactgatgcaacttgaggagctggggtgctgcaaacaaagctattgatgtgatgacgatggcgccttaccgttgatcaaccttctgagaagtgacatgtcgtttatcttctatgaatgtttggatactttgcgagaactgcccttga

SEQ ID NO: 65945 - DNA, 1575 bp, Oryza sativa
gattaaactgactaattgctcgatgaaccaaacctgcataagcttgctgttctgttgcttcccatacactgaacggaccgactttgattagcctgaccttgaccagaactgctggtgctcatagaacttcttttctttggattgagttgctaatgctggaaatttcggtaacctgaaaattcaccatgctgaaaattcacaaacgcactcctcggtttcactattgatttcttcccttgcgaaggcgaaatcgaaaccttcacaaactttccgtggcacactacaaccttgggtgctcaccggcgacgccttgtcgtctaggagacttttgtccccaagagtaacaaacacaatcgaagatttgcttgctatgaactcgagtgctcaaagaatggagtgaagctcactaactctcaacttctcaatcactcaatccaactctctccccttctcaaatctttctcacaaagagacaccacaaggtagggagatggggatggctatttggctttggatatatctaatactccccaagaacagcagccactcaaaggaggggtggaggggtttatatacccgagcctctcaaaaactagccgttggggcaaagacaggaattttcggaacttccaaaaatttacagaagctaaactcagaagctaaactcagtttcgcagccattttcggaacttccggtaatttttcggaacttccgaaaagcacatagtgaaacgaccataactttttattcgggagtccgtttttgacgatcttggactctatggaaagctcacttagaggactacacaaatcaaccaagaacaaggtctaaaaccacttaaaggataggttaaagcttgggtttctctcaaggtagcactatgataggtcactttgatcaccgagacatacacaaacacatcgacgttgtatccctcttaatagtacagcattcctatactcaaatataaataggaagagaattataccagtaggaatgccttcttttccatttgctttctttgtcttaagggacgccaatgccaaaaccgtttcaccgtatattcttcaaatgattgatgcggttacttgtagcttcaaatggtctcgcacggtccatcatgacaaagccatcactcgcccttcaccaccggatttggttcttcggcgccaagccccttgcttgcccttcaccgttgcatggtccatcgcgaacgagcatcgcttgcccttcaccatcttgccatagtagccacttcgtatcccacatcttcaatatcttcgctttgttattcttagtgttttaggtgtaatcatatcacttgagcgtcaacaccttttcaatccttggaacctatttttctcattcaacttagtgaaattattagtctcaatgatccggttgtcaacctccacatgttgactaaccgatcgcatgtataaaaggatatgaataaatgatgagtattaatcaacaccacaagtgtcatatactcaaatatatgctcaaatgtaaagatcccaattaaatgaaagtgaataacttggatcaaatacatgcataactaaggcata

SEQ ID NO: 65946 - DNA, 2913 bp, Oryza sativa
agagaaatcacctaatatatgttgaaagttcatgtttacacctaaaggaaatgtgtactctcatgttgtctaaggggatcaagtggaacaagagcaggtaataactagtcttatcagaaaggatctctttggaatttgaaatatattagtcattgctacatgtttaaaaatactggaacttcctggtgtattattgctggctgaactatggaatagttagccccaaaaatgaagttcatagtgtacacacaatacacaatgttttcctgagattatcccctagcaacatcacactgcaataaaattccctctggtgtttgcatttctatttttcagtcctgtttgtaactttgtatatcttatgtttcgttccttcctcatccttacctttctactgagcttttcaatttaagagatgccaaagataaaaatcactacttattcttctgtgtgtgtgatgcttgtcttttcaggttgcactatgtaattggcataagcttaactaatccttttatttttgcttctgcagttttatgcaggatatggctaccatgggagtaactttgagcaaacataccgttgttatccagcatctttctttgacaaggtatccttctcccctgtgctgttattgaaatatctagcattgttttatccttttacatgatgaactggatttaactgtcttttttttccttttttttttttgcttcatttcttcagccacacctggaaggtggcgacaaaggtatgtcttcagacccctcccccctcctctcacacacacaaacaattcaaaccgcatgccactgacattatattttatcatcatcaatgcagtaattatgccaccatctgctcttgatcggcttggtaagctcaatctcagctcttttatactctggccttagatttacattaattgttttggctcctctaacagcttctctgcacattgaatatcctatgctgtttgagttgcataatgatgcaactcagcggatttcacactgtggtgtgctggaatttgtggcagaagaaggcatgatcatcatgccctactgggtatgtaatatgcagtggattttctttactgatatctgcaattatattccaaagaaacatattgactgatttatgctataattctttcatatatgtgcagatgatgcaaaacatgcttcttcaagagggtgacactgtccgtgtaaaaaatacaacccttcccaagggtacatatgtcaagttgcagcctcacacaactgactttttggacatctcaaatccgaaggccatgtgaggatatgataaaaacgctccatattaaaaccattccgtttcttggggaaatcatcattctaatgataatgctttgctttgtgacattgcagcctggagaaaacactaagaaacttctcttgtttaaccaccggcgatagtatcatggtagcttacaacaacaaacaatactacattgacattgttgaaacaaaacctgcttccgcagttagtattattgagacggactgtgaagtggactttgcacctcctcttgattacaaagaacctgaaaatccgcagcaaccatcagttcctgcaagtgaggcaactgctgaaggtttgtctttagattaagtgcactttagttttcagatgaacttgtattgaaaggctgaattttatcctcctcttctatagcaatttttcaagtgtgctgccatctgggagcatgtactccacaccctgaactagtattttcatctactcccatagtcctgtattttgcatagtaaactgcaacataagttaaacaaagaacaatagaaggaaaactagaactggaagacatgcttgaatcaaagacgtcaagcactctgtccagtggtgtgaagtggcactgttctggattgcttggttttggggttgacagcctttctgtcaacttcttgtatgctactagtttgtttactgggttgtcagcctttctgtcaacttgtattctatggtttgcttctttcttactaaaattcagccggtcatatttggcttgcctggctaaaactacataaaaaaaattcattctttttcatgcttatgtattgaaattctatataaggtgtattttcgtcatatcaagtgtgaacgatctgcaatgttaacgtttctataaaagaaaatatgcgctgttaacatgtattccacatgcatgtttgcatatgtttatcaagtgcattcaatacaagattccagctgccaaggtgtgtagtggtggcatttttgaatttctccttttaaaactatccttttggcgaccttcccaccagatgaaaatgctaaagttgaagatgaactgaaattcaagccgtttactggttctggaaagcggctggatggtaaagcctcaaagctacaagcaacagaggtcccttctgcctcacgttcttccccttcagactcaaacaaaagggtgaatcaggaaacgttagcaccagcatcttcaggagctagcaactccacacgccagaaatcaggaaagcttgttttcggttcaagtgcaaacaacaacaaagaaccgcaaaaggtattacatttttctcgcacttgaacaccctcctttcccttcttttcatgcttcattttttccctactgaatctgtttttttaatctaataaatgcgttactaaatgtgaataaatttgcaagaatgatgagcttgttttctctgcatatgttcacagaatcaccggccaggatggccagctaattgaagggttaaccttataaattctatgtattggccttttgggcgacaaacagaggatgctagccggaacttagattcatctatgatctagaactcaaatatatttagatattttttgttctgtcagttgctttcctagttagtagca

SEQ ID NO: 65947 - DNA, 697 bp, Oryza sativa
caaaattacatatgtaagtcccaaaattacatagtaattatatatgtaagtggtgtgtaagtgggatgtaagtggggtgtaaatttgtataaagtatagtatgcatacgtgtaaaaccttgaactaataaagacgttaagctttaattaatcatatggacagccgcaacgttagcctgccatagcaatatgcacggacaggatcgtattggcacgggacaaagaaaatcggactaagaaaatgtgtcgacacaattctagcgattccgtaaataaatcccttcgaaagcccacaagttcttccagtggagcgatgcccagtctaaatcgtgcatgtgttttattaatttttccacttgattcccgaatttgcattagtttttctacaggaaattcccaaccccgtggactacaactaattcaggatatgaccatatcactcatgctagcaaaataaacaaattaactagatgacattatcccattgttacagggtaaattgatccacatataaatttgattctaaataatggtttagtcttcctaactctttagttaatcgattttgctaccccatccctacaaaagaaaaaaaaatattgaagatagcttctacgcatctttttctccgtaacaacatgggaaatttgaaagcaaggaatcggagtgtagtagcagaagccaacatctcgcaaaac

SEQ ID NO: 65948 - DNA, 981 bp, Oryza sativa
actcttttcccgcctatcctaagaaataaacccgaacatcaaaatgcacgccctttgatcaataggattttttatattccaatatgtcctgtctcgctacaggttttgatgctttatatagtttgtaacttgtacatatgagattacacttatgccctcattgggcctatgtaaagttacaattgtgcccttaacatgttagcaattccaagggcaatttagtacatctcgaaggtttttatagtcttttggtgccagctggatggagtggttgagtggtccccggaaatcttctcgtggcatctttattgctcgaactgtcttctccatgagaacgagcctttttcatggtagagagtcttctccttggcaagtagtcttttccatctcgaccattcgaccaccttttcctgttcacctagtgactgatagtttacctgtcattggcttagacaatactcaaaacagatctggcttagtaataagaaattgcttgaatagtgtttccaactcgcatagcattttaccatttttctgttctaatggcacttttccacccgtacacttacaatagaaactcactcttccttctaaatgtttctggcggataaggagggatggtggtgacccccaactactgcaatatatgcgtgcataaagccattaaaccatcgtccactacaaaactaagggggagagatggagcgaggaggaaaaatggagggaggcactaccgtgcggcggggcgcacagaccaaaggccgacgagccgggaataatctccccggcctctggcctgggaagaagaatgagagggcgcgccctgagtccccttccgcgttcttgctcatgccggctcctacgacacgcgcaacgacgaacggcgacaacgaacagagcacgggggcggcggcaatggcgcggaggcgaatgggagaggaagggaaaggggaggctggggtttataggatggcaatgtcg

SEQ ID NO: 65949 - DNA, 3712 bp, Oryza sativa
ggcgatgaaaacaccaaggcaaaggtaatccatctcgctttagatggcatcacccgttcttggtatttcaatttaccagctaatagcatttactcatgggagcaattgcgcgacatctttgtccctaactttcgaggcacttatgaggagccgaagatgcagcagcatctactcggcattcgccagaggccgggggaatcaataagagaatacatgcgtcgtttctcgcaagcccgatgccaagttcaagatataaccgaagcgtctgtcatcaacgccgcttcggccgggctgctcggaggtgaactcacaaggaaaatcaccaacaaggagccgcagacactcgagcacctgcttcgcatcatcgacgggtacgcaagaggcgaagaggattccaagcgacggcaagcaatctaagccgagtacgataaagcctccatcaccacagcccaagcccaagtacaagcacaggtcgccgaaccggctcctctcaccgttcgccaacctcagctggcaaaccaaggacagccgccaaggccaagtcaagctcccatgacttggaggaaattcagaaatgaccgcacgggcaaggctgtgatggctatcgaagaggtccaagccctccgcaaggagttcgacgctcagcaagcagtcagcaatcagcagcctgttcgcaagaaggtcaggaaggacctctattgcgcattccacgggcgatcctcgcacactaccgagtaatgctgaaacatccggcagcgtggcaacgctcaagacccaaggctgcagcaaggggcagctgtcgaagcacctcgcgaagccgcccaagaacaagcacccccagtcgaacagcgccaggacatccagctcggagtaattcaagtgattacaagggccgatccaccagttcaacagtcgaagcggcagaagaagatgcagctgcgaacggtgcacaacatcaccgcggcaggccaaggggctctgaggtacttgaactagcatatctcttttgggccagaagacgccgaaggggtgctattcccacatcaagaccccttggtgatctcggtcgaagtagctggcttcgaagttcggcgaattttggttgacgggggaagctcgaccgatgtcatctttgctgaagcatatgccaaaatggggttgccaaccctagccctcacctaggcaccagcctcgcttcgtggttttggcggtagagaagttcaagttttgggccaagtacaactggtggtagctttcggcacaagtgaaaacaggcgcgtagagcaaatactgttcgatgtcgtcgacatcccatacaactacaatgccatcttcggccgcgcaatcttgaacaagttcgaagccatctcccaccacaactacctcaagctcaagatgccgggcccaactggcgtgatcgtcgtcaaggggcttcaaccttcgaccgcatcaaagggcgatttggccgcaataaataggtagtgcacaatgtcgaggccgaaccacatgaccatgctaaacgaatgccgaagtccgcccctcatggcaaggtgatcaagatgcaagtcgatgacgccgatcccacgaatttttccagctagggggtgatctagcgaagaggaagccaagaatatcctggaggtgctcaagaagaacattgacatcttcacctggagccccgacgaagtgggaggtgtttcgacgaacttcatcatgcatcatctggcggtcaagccggatgccaagccaagggaacagaagctgcacaaaatgtccaccgatcaccaagaggcagcaaagcccgaagtgtagaagctgctcaaggctggggtgatctaagagatcgaccacccagagtggttggcgaacccatttttggtgaggaagtcaaatggcaagtggcgcatgtgcattgacttcacagacctcaacaaggtgtgcccgaaagatgatttccccctgccgcggatcgaccagcttgtcgactcgacagctgactgcgaactcatgagctttttggatgcgtactccggctatcaccggatccacatgaatccggccgacatcccaagacagccttcatcacgctgttcgacacgttctgccacctcagaatgcctttcagcctgaggaacgctggagcaacattcgccaggttggtgtataaggtcgtttacaaacagttggggcgaaatgtggaggcctatgttgacgatatcatcgtaacaagccgcaaggctttcgaccatgcgtctgacttgtaggagaccttcgacaacttgcgtgcggctggtatgaaacaaaaccctgagaagtgtgttttcggtgttcgcgcgggcaagctgttgggctttcttgtttctgaaaggggtatcgaggcgaaccccgagaaaatcgatgccattcagcaaatgaagcctctgtcgagcgtacgcgaagtacaaaagctcacaggctgaattgcggcgcttagtcgatttctctcgaaggcagccgaaagaggtttgcccttcttcgagacccttcgaggcacgggaaaatttagctggacacccgaatgccaagtagcgttcgactagctaaagcagtatctgcaaagcccacctgccctggtcagtccagcgccgagaagcgaactgctgctttatctagcagcttcgccggtggcggtcagtgcagctctcgttcaagagacggagccaggccagaaaccagtgtatttcatctccgaagcgttacaaggggcgaagacaagatacatcgaaatggagaagattgcctacgccctagtgatggcttcgcgaaagcttaagcactactttcaggcccgcaaagttactgtgccatcgcagtatcctttgggcgaagtgctacggggcaaagaaatcactggccgactcagcaagtgggcggcggaattatcccccttcgacctacattttgtcgcccgcaccgccataaagtcccaagtcctagctgacttcgtggccgaatggacactggcattcgcccctgaacccgagcccgtcgaatagccttgggtaaatgtactccgacggctcatggtcgcacaacggggcaggcgccgcggcagtactcacttcgccagggggtgtgctgattcggtatgccgcaaggctgtagttcgacacgaccaacaacatggcagaatacgaagctgtactattaggcctaagaaaggcgaaagcatttggggttcggcgcttgctcatccgaacggactccaagctggtggcaagtcatgttgacaagtccttcgaggcaaaagaagaaggaatgaagagatatctggaagcagttcggtctatggaaaagtgcttcaccggcataacggtcgaacacttacctagaggccagaatgaggaagcagataccctggcaaaatctgcagtctgtggaggcccgcattcatcaggcatcttttttgaagtcttgtacgcaccaagtgtgcccacagaaagcctggacatcatggcaatcgaccaggcaaagctgggcgaagacccagaagattggcgaaccccattcgtcaagtgtcacgtcctgataaattcatcccgaaattaaaaatcattctctaaaaggaataatagaattaattaaaattcgaaaagaaattggcaaacactaaaatacgtacaagaaaaattcgaatgtggcccggagaatttttgttaaattctccttggtc

SEQ ID NO: 65950 - DNA, 535 bp, Oryza sativa
aaacattacattgcgagtggagtggaggggcttggatattggattattacccggacgatgctccccccccccccccccccatatccgatccgctgtcagtttgtgtccagcaggcgtagcgaagcagcgctggcgtagtggttgggttgtgggttggtatattaaaatccggcgttcggttagtgggccgaagtggggggcagcaggtcgatcggtcgatggactaccgatgcatcgaccacgacgaccaggaggaggatcatatcacgccgcggccgcggccgcgcgctctcgctcgctcgcgtgaggtcctcgtctttacagcctgtgctgccggagagggaaagaggaggtggatgccgtttaccaccagagacttgtgtatactatattaccacgtgcccgcgcgaccacgttgcctgcgggcacgcgcggggggcgcacggcgggtgaccgcgacaccctcggtccacggggggcagaccggcagatgggatcacacgtatgtatgtacgccgtacgcgcgcgcgggggg

SEQ ID NO: 65951 - DNA, 1398 bp, Oryza sativa
gggtgcggctaacgcgtgggacccacggcgccggccggcgcaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcgtaaatatccatttaaagagcatataaacttcaaatggcatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcggcttcggaagatccgctcttcgtggaggttgaagccgacgtttgggaaagcgagcaaggcaagtcacatcatccttgagcatattgaatcccagtttataaaattattttaatttaaattaatgcattatcgctttatttaaattcccgcgttatcactgttttatttagccatgcctatttacctttgttatgaccttattattgttgttattgttattattaccttgttcaccctaggataaataaaaccccaactagtgggtattctattcatggttccactagtatgaatttaggtagatgcttcgctgattaattaggcaacattaggtggttttataactttagactttgggaattctcatatcatctggacagtatggaatggttggcttatgttggaattggacacacacctccccctctattcaaaacccccataatggttttaggctgggctcgaggtgcgtggttgggtttggttagtcgtacctcgggtactataaggattaagctcgggcctctgttgcaaagcactaccgtacttccacatgtctagtgggtaaggcttaatttgtggctcagtctggttataaacaaaagtacacggatggagatggatgaagtcgggggtcgatggacattctccagggcaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaaattcttaaaatttgcttaacaactaaaatgtggaat

SEQ ID NO: 65952 - DNA, 9995 bp, Oryza sativa
  unsure (1)..(9995): unsure at all n locations
tgagcatggagaaatgcataacttgtccctataatgcacaagtaacaagaatcacctcagaaatgtagaactggcctctatcgtgaaggcttccgcagcctcccctattcagtaaaattaagcattttagtattgatcaatcgcctaactaacacaattcataagcccaatctatttttagatacctattatacttgccaaatttcataaatcagtataacgtagtcagataaaaaaaatgcaaatagacatggtacataccatttaccacataaacatactggagcgaagttactatacactgcaacaactacatgtatctcaatcccatgatacgaccactgatcagcaccttaatcttggaataccgccaatttgagtgtagatgtatgtcaacctagttttcccaaattgatccgtacttatatattgtccatgcttatcttacatgtggaatatttctgtaagaaacaatcaaaatctgccatatatataatccctctaacatgaatgaaaataacagaatgacaataaaaagcactatttagcctagtattaactacagaaagcaacagcctagtgaatacaaacctgaaagtcattaagctccacatcactgtgtgcttccctgtcatggtcacatagactaaatatctgctacaaagccctcacaaaccgtcgctttagagattgtgcctcttataaaacaatggagctattgggttaagcataaccttttcagcatagtagaagacctccggaacctgcaaatatccataaattatattatatagttaatccaagccttgcacaatatctggaattctatctcagggaaggcactggttaaaattatcaagtgcatagtacagtagatgtttgatcaggttacacaaaaaattatcaaggcagatatgggcaatacacgtagtacattgttagagatggacagcactgtgttctcaaactgagcatcaggaaaattagtgatccaaatttattactaaagccctgaaaatcaagtattaattccataagactacagagcatttcatcaagctgtagcaatcaagttgtgtacatcaaaatagcaggcaatgcaattaaccatgcataaatgcaacagtgggatttagcttgcacaacaacatgtatcttccatcacagtatcaacacagagtcaggaatgaaaaaaatgggatttaacttgcacaaccaaatcattatagcttcatgtgccaactctttccccttagccttctatgtaacacatgattggaaatatgtgtaaatagaaaaaaaaaatgtcttataccaaggaattttagtgcaagtattttttttacaaaaatgtggagtaggaagcattcctttccttccaaatcacagaaaaaatatacactctcctgctgaggattttatacatgaaggaatacaaaggaatgttagaaatattaacaaatataatgccgagttgatgccaggagtgtatcgatcttagaactgctttgatatatcgggttcccacccacctagtacgcgacaactgtttagaaattagaagagtatcaaggtttgacatccaccgagaattttgaaaacaaattacaattacagttgatagaaaatattagcctacaggatatcaattattaactattcactcttgagagtagttcaaaaaatatttgcttaatctcctgtcttagcactttgtcgagcacttggccggcagaatgtactcaagcaattcatcaagtcctgcaaggaagaatcaagcaattcgtgaagcacgtaccaataatcaaggcggcccggcccgttgccgatcacgatcatgtcctgcacgatgtcatcccattggtcccgtggccgcccgtcaccaccaaccaatgacctgggcgaagcaactgagggcgtcgagcagcaggtgttcggggacgaacgccgccaccaccaagcacgccgccgcagcacggccgccccgggtcttcgcccgacaccgcccaagcacacgggcgtccgacggcgcccagccagccgccagcctcaccgctagccacgccggctcttcggccggtgtcatcaaccgctgccacccgcgtcccaccagccagccacgccatcgcccgcgtctcccgtcggccgtctctcccgccaaacgccgccgtcctcacgacacctgccgccgtcgtccgctccgtcagctcaccggccagatccggtggtgacgggccggatccagccacggaagggccggatccgacagcggcggcggcggatccgcagccacgcgccgcgccgctgcgaggccttcccggcgcactgtgccgcctcctcgcgccggagacgggccgtcgccgccatcccagcgtccacgcggtttccggcggcggcgaggcggtgagaggaggggagggtggcggcggccgggggctcgcccgcacgtggacgaccgaaggcgcgtgaagcaaaatttcagtgttccttcatacaagaatgtctcggtcgtcttctttgcctgcaggcgtcggcgtcggcctccttgttcttcttattcctccttcgcgtcagcagtagggtctcgacagtcgacggcggggcgaggagatcatggcgaaactggggtgggggtgaggtaggcgcggatgcggtgcggggagaggcggatctgggagggaggtgagagaggcgcagatgcgcaaatccagtggtgccgtcggatgtaatttgtcgtatgattttgcaccgttggatatgtgatatgataaatgatgaatgagtaaaaccatttgttgaactatatggtagataatgtaatatgattcatcccattaatgagctaatgtttctaagcatggctaagcaattatatataaagcatttagttgaaccaaaccaatatataaagttcaagctaatcaatttattacccataggaaaataaagtcatctttggccattaattaattgggaaaggcccaccacccgatgacattcaaaattaatgcataagttgaaataaaacattaactttaaacaagttcaacatgctcaaagggttgtttgggatctgtgtgactttccttgagcttcttcaaatgcttttgaaccttcctcaacgtaaacgctctcctccggaacgtcggaaactaaagcaaataaacaaaatcaacaaaacagtaaaaaacaagcataaacagtatatgtggatatttttaacatgtagatctcgattttagatgaatttagcaactcgaaccacttgaatctgagttacgatgatttagttatgaatttctgaagtttaatcagattttcatctaatacagaaaattattactatttaaataaaggatttatgatgtcaggatgacatcatcgtagccatggcactggaccacgactccgccagcgatagagagctcgggcgactaaaccgaaggcacctacacaaagaggacgacgagacgaactcaccgaagcaaagaactacgacaaacgacggcgaacgaagaccgacgacgaacttgacggcggcacggctcggctcgatgttgacggcgacgctccggcgaattgcagcagcggcgaaggagcggacgggacgctcctccacctggcgaacctgacggtggcgacggaaagcggcagcgacgaccacagcggcaacgcggcgcggccgaagcggctacggcggcgacggcactagggtttacgcggtggcagcggcgctataggcgacggctgcagcttggacttgaggcaaacggaagaggacgactaggggatgctttaaataggcatggttgagggagatcggactccaatcgagaggatttgagccggaaaaatccgatggttagtttggagagataaactcgaaaacgaatccaaattcgcatcgaactcaaagggataagatcggatttttgggggaagggagagaagaggataagggaaacaaatccactcaactaattttagaaatgcacgagaggaaaggccagatttggaggggaaaaaccgagccaattcggcctcaggtcggctgcctgaggtttgaagaagaacagtgcacagggaagcaaagtaaactttcagtcttgggccggctgaaaatataatagagaaagaaagagaagggggaagctcggctgtgctaactgggctgcacaaccgtgctcccaaaagagggagatgggctaaaatcagtccaacggcttatgggaagattaaaaactttttcaattaaaataattcgtaaaatgatgtttcatttattaaaaatactttccttgctcaaataattcacagaaaaatctagaaaatagataaacaagcaaagtatttaatgaaattttatctaactcagttttatgttgctatttttcctagattattagagtttaacttgtaagcctttaaaataatttctaaaaatgtgttacagaatgaattattaaattaggcgattttcagggcgtgacaagcctacccctcttaaacggaatctcgtcctcgagattcagaagaactagcaaaaagatgagaatgagctgacttcaattcatcttctcgctcccaagtggcttcttcttctgaatgattgctccactgaaccttacagaaccgtatgatgcgattcctggtgtttctcttattcaccacaagaattcggactggcttctcaacataagttaaatctttttgaagctctatatgctcaggatctgcttcctccgtaggtacacgcaaacatttcttcaactgcgacacatggaacacgtcatgtattcccgccattgacggaggcaactctagttgataagctacttcacctctccgactcacaatcttaaaaggtcccacaaatcgcggtgccaatttccctttggtctgaaaacgatgaactccccgcagcagcgtaacccgtaggtatacataatctccttcttcgaaagtcaaatccctacgacgattgtctgcatagctcttctaacgtgactgggcaatacgcaacctttcttggataatcttcactttttcttctgcctctcgcaatatatctgtcccaaaaacttgacgctcaccggtttgatcccaaatggagcggtgtacgacactttcgaccatacaatgcttcatatggagccatttgaagactagcttgataactgttgatataaccgaattcggcgtacggcatattcttatcccaacttccaccgaaatctagaacacaggctctcaacatgtcttctaaaatttgattcactctttttgtctggccatcagtttgagggtgataagtagtactgaaattcaaacgagtacgcatctcttcttgtagtttccgccaaaacatcgaagtaaactgactacctctgtctgacactattttcttgggaacaccatgtaaacatacaactcttgccatatataactctgcaagcttatttcccgagtaggttgttttgacaggtataaaatgagcaactttagtaagcctatcaaccactacccaaatagaatcttgtcctgccgacgttctgggtagaccggtgatataatccattcctatttcctcccatttccactctagaatcttcaacggttgcagctgacaggctggcttctgatgctccgccttgactcgctgacacacatcacatagagccacatattccgctatctctcatcgcatgctagcccaccagaattgttgcttcaggtcttgatacatcttagtgctcccaggatgaatggaatacaaagtttcatgagcttctttcatgatagttgttaacagtgaaatttggtaatcggcaaagacgtcatcggcttagaatcattatcggttgtagcatctcggaatcagccgatgggagttatcaagtcgccaataatcggattcctgctatattcggttaaggaaatcaatctactaaaggaagcttatccctaagtgaccgagtttagagaggatgcggcatggcagtttatatattaattaggaatagtttgttagtttccttttatctttaggaaagtgtgtttagtgtccgataaggacttcatattttccttttatctttaggtgagtttctttcttgtccgacaaggacttgtatcaacccatggttataaatatgtacacccggggtctatgtaatctatctctacgatcaatacaattcggctcatcgccaccctttttacttctacttttgttttttacgttccggcggaacttggcacccgacgcggggctgcatcgtcttcgatctccggcgaagggataagtccaatgttccgtcggcccaggcaattgtctcatctacgtcggcgtcgttcaaggctgcatcagtatattcgacctcttggattgctctggtttgaatgatatatttgtctacctatttattatatgtctctgttaatctagtcttagcatatcaatttagctctatcggctgcttctcgttttagggtttctgccggtatcggctaaatcgcgttgctagattagattagcttagatatctaccaccctgaaaatcagtcaacggcttgattgtctagatattgtgtttcttttcatacttagtgctgcatcagttaagtttgatctactaagtcgtgcttagaaccataatctctagcctgcttcttgattgccaataggggttgggtttcagccgatgagttatctggatgttgcatcggctcataaggatttcatatacatataagttggatttagccgatgacaacaaaagtttcattgtttaatctaatcttgtggatttcatggcatcggaccaccagccgatgtgtgctttaaccttcggatcgatgcttatctatcatataaatgctagccgattggtttatactggactatattattgttatattttattatcagtagccgattgcctttatatcatcatctacattggacatatagccgattgcttaaaccctatcgctatcggctggtatcggcatcggctattatcggctatcggctggaactactccatcggcttgtcagccgatcggncttgtcagccgatcggcttgttttgatcctactatttngcatatcttgtcagttgcaggatcaaactgactagcacgcccgcatctcatcaatctttggacttgcactggagctaagcagatctcccaggccggtgtgtccgatttttttttgtcaacaatagtatccttcaactccttattatggggcacgcaaattttttctcctagccacacagttccttgctcatcttctaataaccgatggtttttcctcttctcatgttcttttcaatttcttagatatcaagatcattcacttgagcctctctaacttgatcaaaaagagtaggttgagcttctaaagcggcaacaaaacctttattgactattcccaagttcaacttttccaattcctggcataactcccaaggtaggtgtcgtccttctgacatattacagtagcttttcctgctgagagcatctgctacaacatttgctttacctggatgataatgaatttccatgtcataatccttgatcaactctaaccatcttcgttgacgcatgttcagattaggttgagtgaaaatgtactttaaacatttatgatccgtatacatctccgtacggttatcaaaaaggtaatgacgccaaatcttcaattcatgaaccacagctgccaactctacatcatgtgttggatagttattctcatgagggcgtaactgcctagatgtataggcaaccaccttcccatcttgcatcaaaacacaacccaaaccatgtctagatgcatcacaatacacctgaaaacctttccttggatcaggcaagactaacattggcgcagtcactagccttttcttcaattcttgaaaactctgctcacactcttccgtccacttatacttcacatccttctgaagcagtcgagacattggtctagcgatctttgagaagttctcaataaacctgcggtagtaccccgcagaccaaggaaactacgaatctctgagaccatcttaggttgcttccaatttagcactcactccacattgcttggatccacgacaactcctccagctgagatgacatgactaaggaacttcacttcgggcaaccaaattcacatttactaaacttggcatagagctgatgctcacgtagtttctctaaagcaagacgaagatgctcttcatgctcttcttttgtcttggagtaaataaggatgtcatcaataaacaccacgacaaacttatctagatattccataaacacgttgttcatcaagttcatgaaataagccggggcattagtgagtccaaacgacataacgggactttcaaacaaaccataccgtgttgtaaaggcgatctttggtatatcctcctcacggattcaaaggtggtgatatccggaacaaagatctttcttggagaagactgtggcaccttccaattgatcaaacaagtcatcaatcctaggtagaggatacttattcttgatagtgacctcattcaacgctcgataatccacacacattctttggggatgaactttcttctccacaaagatgactggtgctccccacggcgaagtactgggtctgatatatcctttctgaagcaaatcatccacctgtctctttacctctgctaactcaatagctggcattctgtaaggtcttttatggatagggttggtttcaggtactaagtttatccggaactctatgtctctcttaggtggcatacctggcaaatccctttggaacacatctggatagtcttgtactattgggatctcttgcaaagcaacttgatttaatgtcaaaccatgagatctaggggaggacacaaagaaagacactgtttacccattgctacttgttaaagtcaccttacggttagcacaatctataactcctctgtgatgggttagccaatccacccttaagataacatcaagatctttggattctagcaagataagtgtggatgggaaaggaatttcttgtatttctgtagtaatggaaggacagtactgcgttgaggatacttgattgcctggggtattaactagtaaaggcctcccaagactaataacttccattccatgattgctcgcaaaacttttagacaaaaaggaatgtgtagcaccgaaatcaaaaagcacagttgcgggtatagagttaacaggaaacgtacccaaaaccacatcaggtgcattctaggcttctgcagctgcaacgtgattaacacgagccttcggtgctggagcattggagttgttctggacaggagcattcttcacacgccgaggctttggacacttatcagcataatgtcctggatcaccacaattgaagcacacccctggcttgattccctgttccttcctgacaggctgattttgagttggagctgctacaggacgagtgaccacattacgattgtcgttgctgtgattaccagtgttgttgttgtagaactggcgttgagggcgagcaactgaagaggatcctccctatgggtatggtgcagcttgaggtcccaaagcaatgcgcggcctctggctattaccctattgagccttgaaataagcagccctacgcttcttctgttccatcctattgtacttgtcttcttggcgaatcgccttgtccaccaactgctggaaattccggtattctatagccatcaatgcataagacaactcatcattcagtccctctaaaaacttctcctgacgttcttcatcagtgcgaacatcatctgggacataatgagctaggcgattaaagtcatggaggtactctgtgacagaacaggatccctgattgagtgctctgaaatctctcttcttaagtgccacaacacctgatggtatatgtgtcttcttgaaagtagcagtaaactcccgccaagtgataggctcttcagcag

SEQ ID NO: 65953 - DNA, 662 bp, Oryza sativa
tttctaggtacatatcgtcttcaggtagcacgtaggaaattggttggtttctttcactctctcgatctcccttttgtctctctcactagcacgtccactttggtttttaaaaatggtggattaggtcgtagtgcatcaactaatgaaagcagcgtgtgtgtcgttttattttgcatatctcctgatcaatggagctagcactgcatgcttctgaatggtcatgcacctgtcgatattagcccgcacgatgatccatcaccatcttcttcagagtttattcagacctaccacatcttataaatctctagtacattagtatgtacatatcaggtgtccgacacaattaattcgacggggaactggttatactatggatttcaacacagagatatatctctgatatatacacacacacagtacgtaactagctaactgaaactcttgcaaaaagaaaaaaaaacagaaagaaagaaagaaaaggtagctagcgaactgaaacaataatcggaatgcagcaaaatacggccctatatatgctcgtttttcctctttaatttactagtgctttgtactgtataattcgctcatatatacagcttgatttctagctctatctagctagtgttagtaccacactctcgacgcagcaagttaaacaatgg

SEQ ID NO: 65954 - DNA, 1635 bp, Oryza sativa
catcccaccaatgatgtaagcaacacgcaaaacccacacacgcacaagcaaactaacacatcgaactatggcaacggtctaactaggcaactaatcccgccttgcatcggaacgaagagatggatcttcttcctctggagtagctggctctctttcttctgggtcttcctcctcttcatcattacttaagacatggatgataggttcagcatgatcaggcacaacatctcccaccacacgagtcttcgaagccaactggatacgaggtggtggacgggttctcttccttgcggtgaggcgaagtttgggtgctggcggtggtgcttctcccttaagctcggccagttccttctgcagacggtacaccttgctctccaacttgcaaatcctgccacggttccagttttccctgtcatcagctgttttctcccgctccacgcctactgcatccatggcgctaagcatatacacagcatgcttcagagtggtgctatcttcatcttcagggcagtggtaaactccatagtcttgaccatgaggcttgtgtggatgatactggaaagctgatgactctaactcctcatcaaagcgatgacgtagctctccaatggccaccaaggctacctcctgacaagcatgactatactttcttcccccagcttcaaactttatcgacagaaggtcttctcgatcactagtcaacgtcacgcgaacacgacacttctcctcgttggggtcatagggaatctggcgatactcaggggcaacgtcgtagcctacttcaaatgccatcattctcagctccctgacgaatcctaccgcattgatcaagctttccggcggatggggcggcgtctaaaggagcacagaaagaaggaattaatgcatatatttaagttagctgcacaaactagacttaattaatttgacccaaaaagaaaaataaaagaaaaggagcaaacagaactaatttttttatttttttaattaaatttcgaatttttcttatctggccgaaacataaatttttagaaaccaattcgttttattttttcagaatttttttcgaaaatttttatttatacaggggcatagactttggaactaaacaaaaagaagcaaatatattttcttcctgtacagtactcgtgggaacagaattaaacaaagttttgtttggaaaatgaaatcaactttggacagacacaaattgctttacacaaatgaataaaataaaactaaaatacttagtatctaccataagaacggtacagtgtcaccattatatattttcttcctgtacagtactcgtgggaacagaattaaacaaagttttatttggaaaatgaaatcaattttggacagagacaaattgctttagacaaatgaagaaaataaaactaaaatacttagtatctaccataagaacggtacagtctcaccattaacaaggatgagtagtactggtgctatcttgattgaatcgataccataatagatgataatagatgtacagtgccggctaaccaatgaaattcataaaatcaaactacttaacaccatgaacagtaaagttttttttttaaaaaagaaaagacacaggtttctgttttggtaaagtaggatttagtaaat

SEQ ID NO: 65955 - DNA, 3271 bp, Oryza sativa
tctacatatacgatactcgatactccctccgtttcaggttacaagatgttttgactttggtcaaagttaaactattttaagtttggctaagtttgtagaaaaaaatagtacaccacccattttaggtaattagacgttttgactttggtcaaagtcaaacttttttaaatttaactaagtttataaataaatatagtaatatttataatactaaattagtttcatcaaatcaataattaaatatattttcctaataaatttgtcttggggtgaaaatgctactattttttctacaaacttggttaaacttaaaacagtttaactttgaccacagtgacgacgtgctataacccgaaacggagggagtcgcatttgcaacccaagacaaatttattatgaaaatatttttcaattatggatttgatgaaactaatttagtattataaatattagtatatttgcctataaacttagttaaatttgaaacagtaagttaaaacgttttataatctaaaacggagggagtagtatatatatttgatatatctcttgtcgtcttgtcgaaatggctcggcatagcagaaaccaagagtgacatgccacttgcacctccatgaatgtacgatgacatccatgatgcgctaacagctaccacagctgatatagatgcaaatttatgcacccatatgcatctgcatgcatgcatgggtaagttgaaatgtcatttggtaattaaagaaaaatgcatgcaaagttcttgcatctacctaccgttgttaaactcgtcgatctgtgttcacagaacgaaaagaaaagaagccagataatcttttcgtggtgatgcttacatgctaccagttcagagtgtaatgcttgtcttaacaaagcaaaatgagacatcacatcacttatggcaagcaaccgcgttctctttagctagctagtcactattattacatgcatgctaaacggtactttatccaaccatatgtaactaacaagagcactgcatatttttggagcagatcgcgatcgagatattaagctagctcttgccatatattctaactagcatggtggcccacgcaaattacgcgtctagcattattatatttttctctcatataatagtatatatatatattttctcattatattatttaaatatattaaaatgataacataattttaaattttgcaataagtttacaaaactactaatgtgtaatattcatattatattttatatatgtgttagttattaattatttttaaaatcaaattttagttattcgtatatatcctatatgtactctagactcgtctttttaatatttctttttttcaattccgaattttctgtaaattgtatttctatatagactctatactcttcttttaatattatttatttttatttctgaatttacatattatattttatatacgtgttagttattaattatttttaatatcaaattttagttatttttaaattatatatattcctatatggactctagactcatcttttaatatttctttttaaaattttgaattttaatattctttaatttttaattttgaatttcagttacttctaaattgtatttctatattgaccttaaactcttcttcccatgtttttcttaattttgaattttagttatttgtaaattgtatttttatacggattctaaactctaattttaattttattatgtttattccaaattttagttagttttaaattcctatatggactctatactctacttctaatattccttatttttttaattccgaatttctatttttttcttaattgtatttctatatggactctatactctacttctaatattccatttttaattccaaatatatattatttcctaattgtatttctatatggactctatactctacttctaatattccttatttttaattctgaattttagttatttcttaattgtatttctatatggactctataatctacttctaatattccttatttttattccgaatttcaattatttccatattgtatttctatatggactccagtctcctcttctaatatttcttattttttaattctgaatttcagttatttcctaattgtatttctatggactctagtctcctcttctaatattccttattttttaattccgaatttcagttatttcctaattgtatttctatatggactccagtctcgtcttctaatattccttattttttattccgaatttaagctatttctaaattgtatttctatatggactctgtcttttttttttctccgattaatgtgagaatttctaggccatgagagcgaatgtattggctcttttttttattcctttaattatataatagatagattgctggacgtgacaaatgcccagtccaaaactgattttaagtgtcacgacttccgtacaaataaggtaccaaccctaactacatgatttgcccccacgtaactacgtactagtaagagtatatggcgagagctagctagctagctgtctggactatagttggccatatgggccgcccggcacggcacggcccaggcacgaccgggcctaggccgaggtcagtcgggccggcacggcccgacgaacaagctgtgccgtgccgtgccgtgccagcccacgggctacaaccacggcccaggcacggcccaagtagcctccggccatgccgggctggcccgacggcccggctagcccatcgtgcccgtgccggcccaagcacgccctggcaaaataccccttcaaaggttcaattgaatacaacaaattgacataacacatcaaattcatgaaattcacatgtaattcatcaaataagtcaaagaatcacaaacaattcatcaagtcaccagtttatcaaatcatgcatacatcaagtcacagatttacaaacaaatgaacaattcttcaagtcaccaatttatcaagtcacagtctcacagatttacaatcagttcaaatcaattcatcaaatgcatacatcaagtcatctactattttccatcaagtccatctcagaatcacaaacctcagaaagttagaatataaaaggggtttatataagctgtgattgtgcaatggctgcctcattaaaaacctttataggtaaaaactcacacctcgtgagaaaaccctagaaaggaaaagagtacgcccatagctaaaatgttcatatcaattacaatcatccagttcaagggtttacatcaatttcatca

SEQ ID NO: 65956 - DNA, 678 bp, Oryza sativa
catgcaatacgtttgatcatattgtacccaatctacaaatatcccccatttctatcaaatgttgcatccttttacaatgtcatgtgggatgggtcctaatactcacccatttattgtttaccttatgccattgataacttgggtatcaaaatgactagatgttggtttaggaaatgcttagccatgcttagttcaactagcacacaaatggggatcaccttattacatagactttgtctattggtatagctttagattggtgccaccgcaatggtgttagttaattaaaatacactgaatggtgggctgtgggtgcatggttatgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagagtggtgtggatggttaggggagggttatgtggagggtcttgtcacgatttccccctttgcagtatcatggtgatacttcggggcatggcgacatgtgtggaat

SEQ ID NO: 65957 - DNA, 798 bp, Oryza sativa
attaatgttctagtggtactagttttattgtgaggtttaaacggatgagggttgtagctgagtcaatgacatgtcagccacggcaaattcaaatggacgtggctttgcatacaatattttttacgaacgcaaaaaatttgcacgttaatatattataagaagatggcataatttagttacacaacacaaacggtcagaaagccgttgtcaggggccaagaaaaaaaagaaacaaaaaacaaatacataaacggttagctacagaaaaagaaaactcctaccacgagggagggatgggtatggaaacccactacactccggcctgcatctaggcagggagctggagaagagcgaagatagggcgatgacgttgtaagccgcaaccgtctcgatttacacaggaccctccgcctcgatttacacaggaccctgcttagacaccaacccaagcttgcatatcagattgtgctgcgcacacgagaccgtatgactcgggccgtcgagcgcgagtttggccgcaatcctctcgctgtggctcggcacttccccatggccgcgatggcaggcgacggaggcgggtccagtgggagcaacgcagggggcaggccggcagaggcctagagcagctggcaagaaaggcgcgtagagcaacgttcaagtccgccatcggccgaccctcaagatcgagaacgaccatctttgcatgccaatactcgtattagcggattgtcctgcctgaaatcgttggaattttcagtcacctttgaatttactggatgtgcaatatagaccaatattc

SEQ ID NO: 65958 - DNA, 3973 bp, Oryza sativa
cccagtccttttcactgccagaatttccaccagcctagggtttagacgccgccgacggtcctcgatgatcctgccagttaagctaaaagtagactcggacgatatagtagaaacaggaacagtcataacatctttagctaagattgaaagaacatgataagttagtttgtgctgttgccatcaactaaggatattgaagtcatcatcatattggttgacagtgtcactgtcaagatatgcagacagttcagaagaattgagattagcagttgaagaagctgcctgaagcaaagcagtagcagatgtcatcctggataatgaaccagcaccaagcccagcacctggactggcaccagcattaccagcacctggactggcacctgcattaccagcaccaagcccagcagcaacaacagaaccaaaaatcttcccccatgcagtccttttcttaccagtggaagggcctggaatagtggaactatgcaatctaacagaaccaaactttctttcatacttagcaaaagtatcagacaatgaagctctaacagttgttaaataagcagagtaatcatcaccaatgagttgagccataatctgaagcactttactaaaccccctaatcttggccctagggtccaagataaatgcaaatgaataaagaattggaattttagaccagtagttcataaacttagttttcatgggaccaacaacatttgcaatgttttgaacattgccatatgtgtttagatgtctagcaatctctaaaatgtgatgcatgattaatggagatgttggataataaacaccagacaaaacaacagttgaatcataaaattgttcgaggaaacacaaaacagattcagcacatgcccaatgtaagtctgtgagtaatggatggtcattaacaaaaggatgttgtgtactaataaatactgtgaatggttccctatgtggtatgagatgcttaagcattagataagttgaattccatctaacatccatgtccaaaccaaacatacgaggacgataaccagcagcaatgcaaacatttttatatgtagcaatgagctgattagatgcattcaagaatgaaatggcagctctaatgtcatttagcatgggcttgaacttgtcaagtccagccttaacaatcaaattgatgatatgacatgcacagcgttgatgcaaaaataaatcaccaatataaccagacagagcaggagtaagggtgtccatagctttagaattagcataagcattatctaatgtaatagagaaaaccttatcagtaataccatattcttcagcaacagcaatcacacgctcagcaatattagcaccagtatgtgactcatcaataagcctaagacccaagaccctcttttctaattgccaatcagaattaacaaagtgagctacaacactcaaataatcttccttagcatgaccagaccatatatcagatgtcaaagcaatagagctagcagaattgagacgatcaataataacagaacgacgatccttaaacaacttataaaaatctctggtagtagtttgtctagagacaggaacaaatctagggttatgagcagccttaatatagttcacaaaagcaggagattgaccaaaactgattggaagatcctctctagcaatcaatctacacaattcaaacctagcaacttcaggactatattcccatggaataacagaaccatctgcactaaatctaagcatggactgaggcaaagcattagacccaagctttctaggtttgcatgacttaatatgcctaagcaaatgtccagtgccagcagaagaacgagcactcaaagttttatgacagtaattgcatttagcaaagactcgaaccctattaccattggtcgtttcataaagttcctcaaagtcatcccataccttggaggttttggtcttcttgttggtacaagtcgcactagagccagtcggcgtcccattgcctttgtcgtcaaccggcgggtcgtcgtcatcgacattcacatggatcgggatgtcggaggtattgccgaatacctccacacgatcctcctcaacatcatcatcgtcatcaccgcgcatccccatagtcctcaactcgtagttgacagaggtaggatcgtcgtccatcgcaggcactctggtccctcaacggcggctgccgctaagcaacaggcttgcgacctgcaagcagccaacaacactcaaggttagggtcggaaatggagaaaaaaaaaagaaaaacaatggttccatgcttgtaccttcgcagccggagcaccggagttgccgttgaagacgataggctcacggatctacgagaagaccaagggatctggcgaagaagaacaaaagggaaagagacgaagaggaaggctggatctgaaagagtggaaggacgatgactcaggcgaccatgcgtggccggtggcccccatcctcatgcgcccctcatgcaagtcaggcgaggaatcgatcggagacgaagaggaaggctggatctggaagagtggaagggaggcgactcggtgagtctcaccggtgcgcgcctgaggccttgagcgagtgagcggcggacggtggaggaggagatctggtgggcggtggagcgtcggaggcggatcggcggaggcggttgagcggtggcggctagggttagggttaggcggagaggcggagagcgagaggcgagaggggactggggaggggaggggcggcgctcgctggcttatatatgcgggcgcacgcggcgcggcctggctgtctgttgggctgggccgtgctcgtgcctaccgttggtacgggccgtggtcgtgccgaccgttgggccgtgccgtgccgggccggcccatcgtgccgacctcggtccatgccgtgccgggccggcccaccgtgcccagccataggcccaggcacggcccaatagtcgtgccgggtcggcacgggcccgactgctaccgggccgtgccgtgcttgggccgggccaaattcccgtgccgtgggccgggccatcgggcctcgggccatatggccaactatagtctggactggtccttggtgtgcgctagctgcacgttgtccagagagaccgaatgtggcaacagcagccacaataaatacgagctgcaatactagacgagcaatgcatcaacaggcggtcctagctgcctgctggttaagttgttgcttttacacaaagcaacaaacacgaagcctatggatcaactgcgtgtctgcctacgtttagcaggcatcttgtgctcgtcggggagtagtagtggcggatggtgtagtcaaggctccaagctaaacagattcaattcagcgcacgcgagctagctagctttgcaattgtcgctatgagctggagcttggggctcaatcaagggataagccgatatgagggacaagagcacaggaagtatatagctctagagagaaagaaacaaaagtctagaccaccgaaatgattatgataatgacagtacactggatatctgcagcagtttaactaggggtgtgtttagttcatgttaaaattaaaagtttggttgaaattggaacgatgtgacgaaaaagttgaaaatttatatgcgtagaaaagttttgatgtgatggaaaagttagaagtttaaagaaaaagtttgaaactaaacaaggcttagagccagtttagaaccatttctgatcaacgactgatgaataatgtacgtacatacgtcgcagtttaattgaccagctggccatttttactacgtacacagactataagcgcgcgcacggaggcctgacacggtacgtcaggcgcctggcggcacagaaggttcgcttagtacttgcgttatatttctccaggcaaactggtaccgtggaccggccgcgtggtacacatactcctacgcgcgcacccctgttgcccgaatcgtaaacgaggcgcgcaacgcaaggaagg

SEQ ID NO: 65959 - DNA, 4167 bp, Oryza sativa
tttaggatagtatgcactttcaggtattcttggttgctaaccattttaggttgaaattaagaacgagggtcatgcgatgcctaagaacacggtagctacatcaactgtacactttggtgatccttggtattggaacacactctataggagaatctgacatcacacacttggtttttgttgtcttgcgacacaaaagtccaagtgggggggagggggggaaaggtcgatgagcttttcatgacgagttccatcaaccaaggccatcttggtttgaagatggtgttagtcctagcttgctagaaaaaaaggaagaaaataaataataaaaaaaagaagaggagaaaagagagaccgaagaaaagaagaaaaaatgggaggagaagaaaagagcaagagagctggcgagctacatttggatcaaagaccgcattatgtgcgtgtcggctatacacctcactagtagcaatcatgctgcctggctacacctagtccctctctcaagctcatgtgccgccttggctcagcctatatccactcctagctgtgcacaacctttcgctcccgcagcacctacgcgcatacaagcaagaggagatgccctcttctttaataggtgtttgctgctccatttcagttggcacttgcacatttgccaaaaagagatgtatcctacgtctctacagtattgtgccaacggatcacgccttcaagacacaaggttcttgcacccgaggtgtgtgcatgaccaaattgcttgcctgagttggcatggtcaaaataccttcctccggtacaatctgcatggagatggaggagaaatcgccaatcatatgtgaccatgccactgcctagagatttcaaaatatacatcatgctggaggtaagtacactcaggtatgtgaaagataaaataaggttcaccattccttttactcatacttatcttcatttgaatgagacttgatcatacatggttatgtttcttgtgtctatttgcatatgctctgttttagatgttcgtgcaagacatctataggctttttaaattaagcatggtgcttaggttaaaatagtctgctttaatcaaattagacatggagtttagtttgactaatgaatttcagagttaatatgttcatagacattggatatatatcttctgtggactaacccctgcaagaaagttttcaaattgacgagtgagtcctcaagttcaattcacaatggaggtagatcagggtcggaaacaaatcaattgctaacatacaaaggagacacatatcacctatcaaggtgcacggtgcgtatattactaattactcctttagcatgttcatgaaaatttacctccgccctgtatgagttgtgcttaaacgaaaatttggtgaataataaaaaaaaattgaaaaaaatatgtttcagaataaaaggattgtctctcgaaaaataaaataaaacgatggcaaatttgtgggatccacgcttcttatgttttgaatccgatttctttttagcatggatgtgaacaattaatcttgaggctacaataaaatcatttcaaatcttcacagtgcttcgagtatttgttgtccactaaccttttgcaggaaataaaaagacgatcaaggagcagtgtacagtaacttcaacacttatatcacgctccttattgttggtattccttacgaccacagataaatccgcaagcgcacagaataccgctgtagcacttcaccttcgggtgaccccaaaaggatatcgaacgcagggaacgtatgtaatctacctaaggctaagactatccaaggccaacaactgatgataggtaggctaggctagagaggactttctatatttcttaattatctaagctaagcaaaggtaatttcctatctattgcttcgggcacaaacccctgctggtctgcaagcgtggttccgattatagctctatgatgtatccgaacgtggaggattactgggacggaatttagggctgtcaccacctgtcgcctacctctgacaaatacgtgggatacacaacaaacaaaggtaatctctaacctagacaccacgtctaagttactaattactactctaatactcgtacaggaacttccttctttatccagagtcctagtactagagcacttagcatgaatactaaacaatgaacccgcaaagatggaaatatatcttactcagactaaataattaaataacataagaaaagaacacgaatgcttactttatagaagaagttctccgaacccggagcagagtgtaccgacagctccggtactcctccagaattcctcttaggaagctacactcgtcgagggagaagtcggatgagcgccaaacttccgggcactcctccagagcttcccctcactctctactttattcgaatgtacaaaagatacaatagagcctcttataattccgttctaagttgtgtgtgttggaatgagatgaagacctccttatataggctccaaatgatggttaggggcatgggaaatgaccaaaacaccctgcaaccaccataggggaggaatctaagccatccacgtggaagtagacggtgaacggccgcagaacgggttcggccgaacccaaaaagtgtcctcccggcctctcttttggccgataggttgcttaatgggcccccaataacctgcactatgttttggccaaattctaaatggtttttattgacttatggggcctccaattcatgtaaacatgtcctgaatgtagagaggtgcattttgtcgcatgacggatgtgttttccctcaaattacctgcatacacatatttcaccaacactagtggaaatgattagtaataatacctaccactaagttggataccatgttttatttcactatatgcaagcattgacggtcagatattatgatttaaggaccgtctacaatacccccacacttaacctttgctcgtcccgagtgaaggctatggactctacaatagagttatgacttccttactaataatcatgcaaacaaattattcaaagctatacctgtacttgtggatctttgtagtgtctaccatgcaatcctaagcaattaagaaatggaacaatcttgactcaagtcaccctaacttttcgtgaagaacaacttggggtttttcatgtaacacaaaattatagctttgctttgctcctccattgattctatcgatcactcaaggtgtatgattcctcacaaaggcatatgattgtgccttttcttttcctaccatctagtaaggcttatgtgaagctcagggtatggaaaagagtagagcattacttgcatcacatatattgcaaagtaaaataatggatccacggaaatacaagatatactttatggatcaagaatgtgcacgtgtatgtgtatggtgaatttgtgggtggaaaacggaaaataaaagtaactccttttgtatacctcctcctccatttattttctcttttgaaatttaggagagtacatggctatctttttttttctttttctttcttttttttttctcatcatcttgctccatacttgtatgagcacttcttttttcttttttcatagccatgcctcttatcttttttttaaagaactttggaggaagaggcataaatgatatggagtatttattttgtggaagatggatgaaatcgatgacaaatgaaagatgctaacttctagtgtagaagtcaagcattggtgggtgtatgtggaatttgtgtgatcttgaccatgaaagtatgaaaagtatttcactagggtcacaaaatttgacaacgctcaatgtaatgacaagcagcgtatgtagcaagctaatcatggatgatcaacctatggctctagtgggaataaaaaatatcaatgaggagtttagcatcgttatattttttttatataaaattcccaagtgtgcaacatgtagagctggatttctatcatcagactatatcttattcatcaattacctagatagcatggggtccctattggatatatcaccacaagcaacaggtaatgagcaaagaaaaataggcatgcatgtcattttcagggagaccatgaactctagttgtaccatccctagcttgagttcacgtggaagcaaacagtgaacggccgcagaatgggttc

SEQ ID NO: 65960 - DNA, 4851 bp, Oryza sativa
atggcactgaaccacaactccgccggtgatagagagctcgggcgacgaaaccgaaggcacctacacgaagaggacgacgagacgaactcaccgaagacaagaactacgacgaatgacggcgaacgaagaccgacgacgaacttgacgacggcacggctcggctctatgtcgacggcgattctccggcggattgcagcagcagcgaaggggcggacgggatgctcctccacctggcgaacccggcggtggtgacggaaggcagcggcgacgaccacagcggtggcgcaaagcggctgaagcgtctacggcggcgacggcgctagggtttacgcggcggcggcgccataggcgacggctgtggcttggacttgaggcaaatggaagaggacgactagggaatgctatatataggcatgggtgagggagatcggtctccaaacgaaaggatttgagccggaaaatccgatggttagtttggagagataaactcgaaaacgaatccaaattcgcatcgaactcaaagggataaaatcggatttttgggggaagggatagaagaggataagggaaacaaatcccctcaactaattctagaaatgcacgagacgaaaggccggatttggagggggaaaaccgagccaattcggtctcaggtcggctggcagagcttgaagaagtacagtgcacagggaagcaaagtagactttcagcaataggccggactgagaaaaggcagctcagctgggctgactgggctgcacagccgtgcacacaaagaagggagatttaaaaactttttcagttaaaataatttgtgaaatgatgtttcatttattaaaaatacttcccttgctcaaataattcccagaaaattccaggaaacagataaacaagcaaagtatttaatgaaattttatctagcttaattttatgttgcactttttcctagattattacagtttaacttgtaagcttttaaaataatttctaaaaaagtattaaagaatgaattattaaattaagcgactttcagggcgtgacaaactcggatatgccaaacacaacatactgtgaggctagcaccagggtctgaccagctggagggtaagactccaaaagagattgctaaatacaagaagggcttgcacaaggagaaattgattattgtcgcacagaacattggacgaggcttcttgcactttcaaaacaagagagtcgtcatggctgcttataattttaagtaagtctggtacatttatcttgtacacatatatcttattttagctggtactaactaactatactgttgttaatatgtagcgatcaattatatctgtttactcatccaccctaaagacggaaccgtggtagtcttggaccctctcgattacggtcacaagcaatacaaagaatttctagcaatcttacggtagtaagtgattatgactcttgcatttttatatgaatgtattataaataaatatcctccttaatgtgaaacggtacgacatccatacaatgcgtaccaatactacaagttcaagggtggagaatagacccgaacaagggagaagctgctagcacgtaccttttggccggtaatactccactcacttaatgttttccaattgttttactaattgcaaattttaactattcttttctatgatatgtcctgaagagtcacaagtaaccgcgaggaatggtcctttgcgggtattatgtgtgtgaatttcttagggttaatgggaggtacaagattaacgcggaggatgtaagtctctatactatgtactagacagcttcacatatttatgatactaatatattgattaacttcaatgcatgcagttgccaagattagaacgtcgaacaagctttgacgatacagacatcacaaatgtccagcgtgatctgtgccatttcatccaccatgagtgctgtcatgtgaaaggagatttcttcgacccagagggtgccctagcgacaagtgacgaattcaaggatctttgggagtggaacactgctatgccataatgtaactagacggcgttatttgaagtgacaatgtaaaaaaatattgtaatatatatatatatatatatatatatatatattggcaacactttagatttctcagtactataccaaatgctcgataatcttctaatatatgtacataataatctacctagaagaatttctattaatgggcaaattattattaaattttaatattttctacctattttcgcaggcggattttttttttgcaggcggccgattcctattttcacaggcggaccggacaagccaacgtccacctgcgaaaattatcttcgcaggtggacggccgccctgtctgcgaatatcggcgatcttcttcacagtcgttggcttataggcggacggctgccccacctgcgaagaccgttttggcccgcttgcgataatgcttttcctagtagtgggcagccccatgcacggccaccttgaagttgtcgtgctcatctaagctgtcgatgtgctcctgcgccgtcttcacaaaatcgctcaccacgccgcctccaaagtgcctagccaatacatcctcgtgtggcgcgcacaatgctctcgccgcgaacgccgccttgttctttgactgggaggagctgctgcgctgctgcccggcatggtcacgaagagctcccgatacacaatctcgaaggagccctcggcgctgactgcctccaccacctcctctgagcaaggctcgtaaatgggcagattgaacatctcgagcttctccttgtcaaccattccctgattagacatgtatcgtaccattacatcgaaatgaaatatggagatcatggaggtacctctattttttaacgttgttcatagtcatatgaaaatatatataagtcatgtctaaaatatttttatgataaaaaagtcaaatatttttaatatattttttttaaaaaaataaaacgaatgatcacatattattttacctgagctgccattttattgaggatgatggagatgtgatcccacatacgtgtgtctccgcttctgaggttgtctatacatttcctcccttttacggagattaccagccatcctcccgggatgatctccttgcctcgtgactcgagaaacaatgtgaagtcgttcataaactgtagagcgtatgcgtcacatacttccggtgaacatattttgcccgcacatatgccctccttgtttgtcagcttgccgatatgcacttcttcagggacctaaatcagtaatcacgattaatttcaagaataagtttctctgaaatcattgtttcttctgtgacagtaattaagtctctgaatatcctgaggacggcaacaaatgtgttaggaacgactcctaacttaataccatctgcgttacaaaaataattgacattttggggatagcaaaatggtcaccaggatactattttgattattagttactcgtaaaaagattattgttggcatcgaaaatcatttcagcaccaacatatagagatcatatagctcccttctgtaagcgtcacaccaagaagtgtaaaatcaaatgtgtttttgattattattctgtgatgaacaattgggcattggagattattggttttgttatttgtaatttattcacgaagtggttttggagatgattggatttcacaggtgaatatacaggaactgctgtggttttatgtggaccggtcagaccgggctctggtagccggtcagaccggcgtgtaatgcacggtcagaccggcgcagcccgtggtctgaccggccgatactgtgttggtttcggtttcgggttgtttatttggatatccgagtttatttcatgattatgacttctggatggatactatacgtatgtaatactattgtttgctgctaatgagtcaagttggagatagcttggtctcggaatatggtttctttgtttgttccatgtgtaggttactcgatgtctcgggagagtatttgcggtgatggaccgggagtcggcttggggataagacgacgtccgtggtggtcagagatcatgcggaatacttaggctagagttgttgcacgtggttgatggagattccatatggcatacgatggaggaattgtgtgcgtatgggatgcggagtcgaatttggaaggagtccaaatttggtacgtttggttatgtaaagtttatttcttcgatttgtgtttcaccgggtttcggcggtctaaccggcggcgcaccggcggtcagaccggcagcgcaccggcggtcagaccggcggcatctcggcggttcgaccggcgggcacacggcggtcagaccggtggctacaggagtcagcaacaggcattttcggcggttcgaccgatcgatctacatcggtcagaccgacgttcatcaggcggtcagaccggcgcaactacttcggttagaccgtgatccatcgatttcgagggtaacttttattttcgctaaaagtttttgatttttgggtataccaaccattcacccccctctggttggcttagttcctgtgattcgatcctacaagtggtatcagagcctcgttttcttctttggatttttatcgatctaaagtttttttgccatggctactcccgctaggttttcaactaagcctcatgttttcgatggaacggatttttcttattggtgtagtaggatgcaatcttacattatgtctgaaaattatgatatttggaggaaagtttctcatccttatgtgattcctgaagccattaatactgatgctttaaaaactgaatttgaaaataattgcaaagctcgtaatattcttttgagtgggatttc

SEQ ID NO: 65961 - DNA, 1625 bp, Oryza sativa
agaaaagcagtcctatttttcaaaaaattttgaaggctacttaaggtttaccatttggcttgtcctaaggtcaaggtggctctggtaccaacttgtcacgcccgaaatttctatccaaaattccaaacgcttacatgtgcttaaatcctcgtccaggaatcagccgaggcacacaataacaaattgataatagagtactatcaaactactaattaatattcgcaaaataataaattattacagagatggatagttcctctcaaaagaataaaattctacgcagcgaaaaaacacaataacaaattgataatagagtactatcaaactactaattaatatttgcaaaataataaattattacagaggtggatagttcctctcaaaagaataaaattctacgcagcgaaaaaaaaacaaaagactaaacagctatggcgactccactccgcaagcaacttgacccaaacaaagcctactcctcctgatcatcaccttcactgaagtactcctcctctgaagaatgaatattgcaagaatgagcatatgacatactcaacaagccacacagcaaatatgcaactgcacaggatagcaaaggatggcataataaagctcatttgcacaaacaacacttaacaaatatttgagagaatagtcaaacagttaaataattaagcaatattaaataaacactatacaacacacccgtgttgcataggcccaacctcatctgaacaaccaaccccggttgtacaaatccaacctccataccaggaatataccattccaaaccaggagtcaatttaattatcacaggttatcaccaataatgagtaatgtgagactaatcacgaaaaacattgttagacccgcccataaccgccggcacggctattcgaatagttttactctggctagagatgtaccactgtacccacaaggcacagctccacaacatgtcaccatgcgcctcaataccatcacggtacctcggaaaggaactgtgataataccccttgcacaacacaactcaccatagtgcaccatacctggatcatcatcaacccctctacaaccagaggcatggactccctagcgaccccatggacttctcgccgcttctcagtctggcaccccgtaatgaaccatgctatacaaaaggtaaagccgttgcccacgctggcttgtggttggcacggtaaatgtttcacaatagtagctcgcgaaccggtccttaattgtcatgagcacgaccatccaaaccatgtgctcacaacccacctttaatcaggttttaattatcaagtaattattgtcgcgtcccaaaacgactctaaaatacatcctcaaaattgtgccgagaataattaaaatccatgtgaaagcctccaacaattaaaatgtgcaaatttaaaagtcaaataaggcttggaggatttttgtatatttcctaaaagcctaaaatgtgtaaataaattttagtggaattttcagagcacaaataataattgagaagaaataaacaaagttaaaaaggttttataaaaagaaaaaccctaaaagtcttcttttcccccccttcccttcttgggccggctcggcccagttcttttccccccttttct

SEQ ID NO: 65962 - DNA, 11951 bp, Oryza sativa
gggggggggggagcatcgtccgggtaataatccaatatccaagcccctccactccactcgcaatgtaatgttttaagacctgtttctttcggcttggaattattataatctagattattgagtcagattactgtaatagaataagcggttagttgtttctttactaaattattaggtttttaagtctaaagagggagtagggtggcatggtggataatttttcacccaataatctagaaaaagctcatctaatgagcttatcaaattataataagttgggctccagattataataagcgaaacatggcctaaagttaattgttttgagaccacttttctttttgaaatctgaaattaaatattgtcctgataggctgataccctacatgtcagacagcaacaaaggcagctcccagtcaggtttgggcgattgctcgagctccgccgctagctgccaccttcactacaaattaccaatttgccatcgatgtataaaaaatagtaaatcaccgagaaacacaattaaccgtttaaacttgacgatgttgtttgctccgtcactaatattcagtggcacaatgggtggcatatttcaatcgtatacgagagaatttcactcactcttcccattatcgaaaagtagttgcaagtattactcgtatgatcgtatctcactgcaagttaactaggtacgaaataatgattgatggtaagatgcaaattgagctatgttggttgcatatatatattttgagcatacacatgtgcaacaggacggatgggcctcccagacacaaaattgtgcaattccacaagcttaggtggtagtatttaagggtgttttattggttaagatcattgaaacaatatttaatgctgtcttcctctagttttgatatgcaagcttcactttccatgttcatcgcacacgccattagacccatatatttacatctctttgtgagattcacaagtcatgattggggatttacatgaagcaggaatttctaatgtaactgaaagaaaaggaatgactgaaatagaagttgtcaaagtcaaaaagataaaacctcaaaggctattcacgtttttccttctcatacctctccaccatctacaggagtcatctcttctttctttctcctctagtccttccatagtgcgtcatccatactcctatagaaaccttgtgatcaactaactattcatgtaccagtcagtagaaccaaccaatgactataaacgtaattactaattataggaagctcgagagtatagaaaacaaataaattaataaactttcagatttttcaccttatttagttgttagttgaaaaaaacacacgttagcaatatcaagtattttgttatatgtttgatgtggttgtaggcttgacacaccatagttaaaatcatagatttggaatcaatgtattttaattttagaagtacggtgaatatatacacacacttacttatggtttgggagatatttgatacatatgggaatattttaagcctacgtgagattcatatacatgcaaatatagtgattcgatacaaaggagcgaaattttaggatttttgattcctctctctcgctggttttgatggttttggagtccatctttcacaaaggccaactctatcattggctggcgccgcttcgtttggggacctgttaggattatagtagggtttcctccgctccaaatctccctcttgtaggagcaacaggtacaactttcctttttcatagttttttcccttcacagttcctttgcctgtccccggtaatggtcttttcgtccgttgtgttgtgtaatatattaacatataatttttttacgcttttgcgtttttttagtgatgtgacgatgatgtatatggaccgtgtgttctcaattgtatactttcaaaggaactagtaccattcgtattgttgagaggataaacacacaagcgtttaaagtttttaacattgatgaaggggtagtaaacacgcgctgcaaaaaggtgagacaaggtaaagccgagagacgagtggtattaagttcgctcaaaaataaagttataaaaccagggaagcaaaggcggcccgggaaaaaaaagaacccatcgcggccacccgcctcgttcgcttccatcctctccgcagtccgcacccgcgcgcgcgcgctcgactcccgcaccagccgcgtcatggcgccattccagctgcgcttcggcctccggatgtccccctcgcgctcctccgacgaggaggaggaagacgacgaggacgaggaagggttcgagtacgaggagatactgagcgacgacgggacggactcgccgccgccgctgatgatgcaggcggagaagggagggggagggctggtcggggcggtggtgggggcgctgcggaggtcgctggtgatgtgcagcgccgggaaggtcggggaggaggaggacagcgaggacgaggaagaggaggggatggagatcgggcggcccacggacgtgcggcacgtctcccacgtcacattcgaccgcttcggcggcttctcggcctccccgccgacctcgagcccgaagttcccagccccacgcccagcgccaggtgagctcgccggcgctaactctatgcaattcctctgtttcttctactcttcggtctctctctttcagttttctgaggattttacctgaaagaagctagtagctacgtactctacatacccaaatattctttggtacttgtatttttcaatttcacgcagtgtatttttcaatttcacgcagaaatatgtgttagtaaatttgttgttttatccttctctgttctgtgttctccaatgcaattagcgtataacctctttacaaaatatattgtgttcatagaaaggctcccaagaaagttgatagtactaatatgatgtttcagaacgatgatagtgagctttggtttcttttctagtatgtttagttgatcgctcagatgatacagggtagaaagagggcgatttgtttaaggatgtaagattaatttattccacaagtggatctagtaattaaaaaaggacaagtagtacctttttaataaaaagttcagttcttaattctagtatgcggttatatagttagattgctgagtcaagaagtacatgccatcaaacaaggaatggaagtatggaacactatgaaggtatgtgaaggtatacgattctgaagatatatgagggcataagagaagaataactcatatgtaggatttggtacaatactaccatatgacggccatgggttgaactttcaacggatcagacttgagttacttcgttctgtgcttgagctttaagcaacggggctgtttgaggtggttggccagcatgagcaacaaatgggaatcttcaaacctatcttttttattttggattagttctcctgtactttgcatcatcatatatagtaatgttctgtgaagtttgtccttttgcatttacaaatatcatttacaccatctttttaaggttgttaacgtcaaatcagtatttgatgtacaacctagttaaatgagctaggaatataagacattgtcctgttgctactgctgttatgtcataatctcttttttacccctttaacttgtagtggttacagaagtgaagattcaaagtttattcaccttaactacgatccttccctcctttttctttttcttttttaccgtgaaacagtaggggaggcctctaccgtatattaattttcgaaaagtttatgtacatgatacttaacaatttccatgtctaattttccatgcagtgtaaatgtatttggtgtttcaccaacctctttgcaatgttcatttgatcacaaaggaaatagcgtgcccacaatactgttgatgatgcagaggaagttgtatgaacgagagggacttaaggtatggccaccgcaacctaacgattagcattagaaaagtcagtattcaagccttcggaatacttatccattgtgttcttacttcttagatcgaagggatcttcagaattaacgcagagaatagccaggaaatctgtgtcaggaaacaactaaacagtggtgtggttccagatgaggttgacttacactgccttgcagggttgataaaggtagcatgaacttcctcatctctccttaatttttccggtccacggcctgagctgtatgaggcaaaaaagatcgttattatttatcggcaatttgctcttgtttgtttagtttttcagtactgagcattacctcagattgacagacgactaggcagttgcatctatgtatgtgcatcccctttttatgcaatctgaacatttcagaacctgaaatgtttgcagacatgaaggaatacagaataattggtgcaaggaacagtactttttaagtaaaaagtcgaataagtatttgcaggcaactgactattagatgtgcatgctattagtcatatttcttgtacatgggttattggcttactggaggatctattccatgatcactatattccctttttataggcatggtttcgggaactcccaaccggtgtattggactcactgacaccggaacaagtaatgcattgcaacacagaagaggactgtgctctccttgcttcaatgctaccaccagtggaagccgcattactcgattgggctatcaatctgatggctgatgttgtggagcatgaaaactacaacaagatgaatgctagaaacatcgctatggtctttgcgccaaacatgactcaggtattagaaacaactctggattctttcgttagaaaagcatacacatacactaacctgcaatgtttgttttccagatggccgatccattgactgccctgatacatgcagttcaggtcatgaatttcctcaagacattgatcttgaagactttaaaggaaagagaggcagccggaacacctaagacaacggaaccatgctccggttctccaaacggacaagataaacctccgacgccagagaatttggagagacccatcatttgttcagatcagaaaggcatagataaacctatgtttgatatggctacttgtgatcagctgctgtttggacctaaacaattccttgatcatcgtgagaacaacaaatttgaaggaccggagaagcatgacataggccaaccgaagcgccatagcgaagcttctcctcttggtaatgattcgaataaccaagtcagcagccctggaaaagaatttggcaacagaaatgtggaaggcctgttcgacaaatttagttttaggaaaggtgtcgagaggctttgcaggcaccctgtgttccagttgagtaggtccatgaagaagtctgcagacgttgtggtctttgatgctcctggagaagcaagacaagcttggggtttgatatgataatggttgtatatgtagttggtgtggatgtaatgctatcttttctctgtcttgtttgtgtgagcagaagcgattagcatgttagatttataggtgctgcaggttgttgtgtgcattataaccatttacttctgacgaaagcgtctgcctgtggctgctacaagtaaacgaaagccagctgaattctggctcagtactgtatacctcaatagctgctgacctatttattcttcttataaccgtccaaattaatctacccccacaaatatcccttcccaatcctaacatgcatccaaacgccacagtaatgcaaccactgtcagtgaacagcagtataagagcatccccatagcttatccatatttgatcctccaaatacctatatagatgattatccaaaaaaagattcatcattcatattccttccaactccaacaaataatctatattacatcatgcatatcgcaccatcctgtattttaataatatcttccaactaactttatatttgtatttttaagggatatattttgaactactaaattttaactgcgttatttatcgcaataatattttaaaatgagtaaattttaaccgatatatttttaataaataattttttaattgatgatgtatttacatgaatggacttctaatccacattagctagctagcgactgaccttatcctctcgcttaaaaaaaaagaaaaacagaaaagaacggaccttctctcgctaaaaaaaaaaaagaccctaccttatcctctcacgggtgcgtgcgtgcggcatacggaggggcgatgcgggacggcgcgggcggcgctgcatggcggcgcgggcggtggggcacggtggtgccgagctgagcaacggcgcgggctactgggcgacggcggaaggtggcgtccgcgcgcatggtgacggcggcggcggcggaggatgcaagcggcggccgcgagcatggcgacggcggcggcggaggaggcaagcagcggccgcgcgcatcgcgacggcgccagcggtcagccgcgggcagggcgacggctacagacggcggtggcgcggctccagatctggtacgcctctcgatctccactctcactccaccctccctctccaccgtccgctgactcaccttcgccggccggcgacgacggcgatggaggggaggtcgcgctggaggtgaggtcgcgtcgcggaagtccggatgggggcgggagaggcggctgttgcaaaatggcgtgaggagagagacactccatttttgcctcttctctctcctaatttggcgcatccgccacttttggagggcctgttagcgtatctgctggagctgatttttccccttttatacggcaaatgaaggatggatgaccggttagaggaactgctggggatgctctaagtgcattttctttctttcttgaggaggatgcattcaatatcacccaaaaatttataagaacttgtcagtgaattgctgaacaaatgcatagatgcattctctttctctattaactaaaacatggtaacagaagcatataagaacaactgtccgactgcatacggggactactactaatctactattgcagtacggctaaccgaaaatcttctggttcagatcctaatgtgtcaccccaattggtactgctgacaccatgcatgttagtccttttctatctcttcctgaagaccttgtcaaatagtacaatacaaagcagacgcagaaagcatgcatgctgcatgccaaattgccaatgccttgtgtatgggaatatatgcagttgtagagacgtttcagtgttgcatcatacaaaagatggctgtgcttcatccgccctgccgctcttccctcttcttagtagtgacgctgctagtttttcgttcatctccagcattgcctcatactttctttatcttcggagactcccttgttgatgtaggcaacaatgactatcttgtgaccctctccaaggccaatgctccaccatatggtgttgattttgcgttttctggtggcaagccaactggaaggttcacaaatgggaggaccattgccgatgtcattggtaatgtcaagtatgaatctcacgaagaaactctgattttcctgtctcgatctcacatttcttggcactgaactctcaggtgaagccttggggcagaaatcttttgctccaccctacttagctgcaaattcaagtgctgaaatgatgaacagtggtgttaattatgcctctggttcttctggcatatttgatgagaccggctctttttatgtatgtgaacactcaattgttgtgcttcctcatgcttgctttgtttctgaaatatagttgtatgaaaacatacttgatctgtgctgtagattggaagagtgccactagggcagcaaatcagctacttcgagaaaaccagagctcgaatactggagatcatgggggagaaggctgctactgggttcttgaagaaggcgctgttcacggttgctgcaggatccaatgacatcttggagtacctttcaccttccatgccattctttggacgagaaaagtatgatccttcagtttttcaggattccttggcttccaacctgacattttatctgaaggtgctacaacttctaactcgcgattactgaatttttctttcttctaatgttatttcaagatgatatgatactttttgttcctcaatgaagcggttaaatcaacttggagcaagaaaaattgttgttgctgacgttgggccactgggatgcataccgtatgttcgtgctttagagttcattcctgcaggggagtgttcagcatttgctaaccaactcactcaaggttacaacaagaaactgaagaggatgatctacaagctgaaccaggagatggggcctgagagtagatttgtttacgcaaacacgtacgagatcgtgatggaaatcattcagcagtaccgtcaatacggtgagctttcttccttgctgcagctacctcttgcgaaaaccacctgcgaatgctgtgctgcagtctgcagagcattagaaaatgcagaatatttcagtcttgcatttgtcttcaggttttgagaatgcgctggacccatgctgcggaggcagcttccctccatttctctgcatcagcatcgctaactcaacctccaccttatgcaatgaccggtccaagtacgtcttctgggacgcgttccacccgaccgaagccgtcaacttcatcgtcgccggcaagcttctcgacggcaactccgccgttgcttctcccatcaacgtccgagagctgttccaataccaatacaaatgagagatgtgcttttgcccagttgctatggcattcattcctgtttggctgtatcaattcccatcctctttcagtcttttcctctgcaatcttctcgggcataattggactggacagcacgcctttaacgagtagaatgtgactgaaagtgcgctttacgacaccagtttatcttgcttttttgcacttttctgaaggcccgagagaagattcaaccgtcagccaatgaaaaagagacacgtacacgctctccggctagtcgctgtcagtgaacaagaacttgccggtgcagtgcaaacttgaccaacgagcgatgcaacagaagctggcgcactacgtgcaaagaaactgacgaacaattgggcaaagtagcgcccatcttatcacagagtaaataacctatctatgtcactatgtgtgcacggtagccgccggtcagccggtgcaactcacagtggcgatatgcctatatattttacgtgcacgagaaagttgggctcgggtgccccggcactgccaggtacggccacctccggctgatcgatcgatcgatccatggagcctgccgccgcggcggcggggcctgggaaggccggtcaccacaacgccgacgctttccacgcggtggcggcgggcggcgtagctccgcccgcggagacgacgcggtggtcgtccctggcagccacggccgcgagcctcgtggcggtcggcctcggcggtgccgcgctgctggtgtggtgggcgctcgcgttccacccggcgaacgcgcgcctctggatggtgcccgcggggctcgtcctcctcggcacgcccatcctcgcgtggctctccctctgcctgtccgccggcccgtgcgccgccgtccgcgacgcgccggtgcgcgtgtaggagctcctcgcaagagtctcgcgcatttttgctgcttccagctggtccattttgggatcagatgtacatacatgttcattgttcactactagctagtcgtactatgcttctttctttgatttcttgctgattcatttcgggatcagatgcagatacacatacatgttcactactgtacttctttgatttctttgtgaattcagctgggagttgcagcgtgttgctgctagagggagagggacatgtagcattgatatggacatatggtatatatgatctggtgtacacagttgctttccaagattacttccccgtgtgtgtgatctggtgagtgcgaactttcgatcggtttctgcgttcacgcggcctggaaagtctaaagttggagtgtgccggatcgtaatccattggtcggcgtctcgtcgagaaatggacgcgcaatacaagcgcatgggccctcgaatttgagatatttcttaccggaggataggtatgtgtggttaatggtttcccctcgtggattgctttagtgttagattggtgatggattagatatgtgattaatggtagtggattaacataggaaatggagttcaacggaaggctgtactgaaatgctttagtattagataggtgatggattagatgtgtgattgatggtagtggattaacataggacatgaagtttaatggaaggctgtacctgcaatgctttaggactagatatgtgattgatggtagtggattaacataggacatgctttaggaccatgttggagaacgtcgccggcggccgcggcttccgtcgtccacgccccacgtcggaggtcgtcgccggcggcctcgtccttcgctgccacgccccacgtcggagcttgttgctggcagtcgcgtcctccgccgccacgccccacgccgggctcgtcgccggtggccacatcctccactgtccacgctccgcaccatgccggatctcgtcactggaggctgcgtcctccgccatccgcagccatgccacgccaggaactcgtcactggcaaccgcgtcctccaccatccacaccccatgccgcgccggagcttgtgcagcaatacgcatgctttgacagagatgtggtagaatggataaggtagaaggagatagaatcggtggattggttggttgctgccctatcccatttatcacggttgggacgggatcccgtcaggtagcatttctgtaaatttttatatactttttgatactggtacttcatgattagtgctaggatgctatattcctcatacatgtaaaggtccataaaatcatatactatgggtctttgtgcaagaaaattgtaatggaaatgttttttttatcggttcatgtattataatagatactgatgtttaaagttcccaaagttgaccagataagatactatactattatctttatatttatttgtgaacagagtacataacacggaattgtcggtgataagaggtgccattgtgcatccacagatccacttgtaagcgcagaggattaaggggggaaaggacaaaactaaaaactagttggaacatgacgagatacagagatagagatgctccagtccaacatccttattgatatgctacaatgtgaatatggattttcctgataagcaattgctacgtactaacaattgcccaatcattgaagtccagaaacacagcaccatacggatgggcaatattctgttgccatctcctctgttttgccattaactgacccacccttattaacgcattcatcagttccgtaacaggcttcttgttgggtcgcgaactgctcctttcagaagttgccgtcacaaccagcattttgcgtcatgttttcagtttattagtgcccaatcaaaatacgcaaattgctaataagcccccactatttttggtgtaaaccactgcaactatcccccactacttaaggtataaaacactaagactatctgtttccattttttgccatagaaaatggtagccccagtagaggacaggaccattggttggttgccagtcgtggtgcatttaatagttatttagataccttgctgacctgctgttctcctctcaagaaatgtaaaatcacacttagacaacattgccaagatagtgcctccttaacgaaataaccactttcttttatgttgcaattactaatatactaccgccttccccaaatgtttaatgttggttagttcaattttgagctaaccaacgtcaaacaaaaaaaaaaggagggagtacaatataacgggtagtgttcagaggcagaatgcacgcaccagggttcataatttcagaggaacaacatggttcaa

SEQ ID NO: 65963 - DNA, 42163 bp, Oryza sativa
tgacttatggggtctccaatttatgtaaacatgtcctaaatgtgcagaggtgcattttgtcgcatgacgaatgtgttttctcctcaaattacctgcatacacatatttcaccaacactagtggaaatgattagtaataatacctaccactaagttggataccatgttttatttcattatatgcaagtattgacggtcagatattatgatttaaggaccgtcaacacttatccatgagaaaagagatgcacatggaaccaagtagaacaaatgcaaaacttgttgcatccttgcattcggttcgaatcctggtaagacctatctggtaagaatcttagacactatgtgcatcctcatctcatgtctccatcctgtcaggatacccaccatatccattgttgccataaaaaataagaaaaaaaagaaaaataaaataaaataaaataaagttggctctttggtcttccaaccaagtgagtcctttttgcttcattcgtgtctttgtttttctttttgtgtccaataaagagttccaggtacaaagacaagtgtgggggtgatcttgcacatcaacgccataaccaaagcaagatcactccagaagtgacgagccatgacgaaccacacagggaaattgatgcggccagacccaatgaatcgtcctctgttttatatagagcgtaggtttgcacaatttttactttggacatccattctatcttgagtttaatttgattaccaattctaaaatatcgaagataattgaactcaagctagggatggtacaattagaaatcatgatctccctgaaaaataacatgcatgcctattattcttagctcattacttgttgcttgtggtgatatttttaatagggatcccatgctatctaggtaattggtgaatgagatatagtctgatgatagaaatcctgctcttcatgttgcacacttgggaattttataaaaaaaaagaaaaaaaaataacgatgctaaactcctcattgatatttttattcccactagagccataggttgatcattcatgattagcttgctacatacgctgcttgtcattacattgagcgttgtcaagttttgtgaccctagtgaaatgcttttcatactctcatggtcaagatcacatacacttcacatacacgcacatatgcttgacttctacactggaagttagcatttctcatttaccattcatttcatccatagtccacaaaataaatacttcatgtcgtttatgcctcttcctccaaagctctttcaaaaaaaaagagagagagaggcatggctgtgcaaaaagaaagaaaaaaaagtgcacatacaaccatggagcatggtgatgaaaaaaaaaaggaaaaaaagaaaaaagcaaagagaaaaaaatagccatgcactctcccaattttgaaaagagagaatagatggaggaggaggtatacaaaaggagttatttttatttttattttccgttttccacccacaaattaaccatacacatacacatacacattcttgaccagaaagtatgacttgtatttctgtggatccattatttgactttgaaatatatgtgatgcaagtaatgttctactcttttccataccctgagctccacataagccttattagatggtaggaaaagaaaaggcacaatcatatgcctttgtgaggaatcatacactttgagtgatcgagagaatcaatggaggagtaaagcaaagttataattttgtgttatatgaaaaaccccatgttgttcttcatgaaaagttagggtgacttagtgaagattgttccatttctcaattgctcaggattgcatggtagacactacaaacatccacaaatacaagtatgactttgaataatttgtttgcgtgactattagtaaggaagtaaggaagtcataattctgttgtagagtccatagccttcactcgggacgagcaaaggttaagtgtggtggtgttgttgacggtccttaaatcataatatttgaccgtcaatacctgcatataatgaattaaaacatggtttccaacttagtggtagggattattactaatcatttccactagtgttggtgaaatatgtgtatgcagttattttgagaagaaaacacatcgtcatgtgacaaaatgcacctccacgtattcaggacgcgtttacacggattagacgtgcaataagtcaataaaaaccatttagaattaggccaaaacatagcccaggttattgggggcccactaagcaacctcccggccgaaggagaggtcgggaggacactttttgggttcggctgaaccaaccagttcggccgaacctgttctgtggccgttcatcgctatcttccatgtgtacgctcctgatcacgtcccaatggcggttccggggcattttggacatttcgcataggctgtaaccgtcatacctgcctataaaaggaggagctcactctcattccaagacacacaactttgagctgaattacaagaggctctattgtatcttttgtacactagaataaggtagagagtgaggggaagctctggaggagtgcctggaagtttggcgctcatccgacttctacctcgacgagtatagcttcataggaggaattcgagaggagtaccggagctgtcggtatactctgctccaggtacggagaacttcttctattaagtaagcactcgtgttcctttcttttgttatttaattatttagtctgagtaagttatatttccatatttgcgggttcattgtttagtattcatacaaagtgctctattactaggactccggatagagaaggaagttcccgcgcaagtattagagtagtaattaataacttagacatggtgtctaggttagagattacctttgtttgttgtgtatcccacggatttgtcagaggtaagcggcaggtggtgacagccctgaattccgtcccagtaatcctccacgttcggatatatcatagagctatagccggaaccacgctagcagactagcagggatcggtgcccgaagcaacagataggaatttacctttgcttagcgtgcataattaaaacatatagaaagtcctctctagcctagcctacctatcatcagttgttgtccttggatagccttagccttaggtagattacacatgttccctgagttcgatatcctttaggggtcacccgaaggtgaagtgctacagcggtattccgtgcgcttgcggatttatctgtggtcgtaagaaataccaacaatgatctcatctattgcatgcttaaaaccctgtatagttgtcattattgtgcttagaataggttttagtgggcctaggaagaaaattgggggcctgccggactcaccagggaaccagggcagtgcccgatcggccccgaatttgaatgctagtctcccccgctcgtccctagtctgtttagatgcgcgtgtggaggtagaacgttcggatcacaccagaacacttcttcttcctcctttcctccacatttgcacactcccctctccaattcaacccaattcctcgaatttccactcatacccactaatggctggcaaatccctaatcccattcattggctcctcctccaattccacctacaattttgatggagagccgacactggcaaatcaattgatcccggtggagcattacacgatggaaggggtgaacacactatgggcgcagcccctcgcaacagtgccgggttcccctgtgaatctggagcccgtcggcgagctccctggttcgaccgaaccaggggttcggcagaacccttctcggccccaattggccccccgttcggcagtgcgatccctctcccctcgccatgttacaagaataaaaatccagggggattcgcctgcgtgacggccgacaacgggagagctcggtctcttgaaggcacgacgcctttttcaagatgatgggaaggccgcgccgtctcccgccgagtgctatgtgggcaccctgttcaccaaggcaagggatgaggtgctccacaagtacaccacacccaccgctactccatccactccgaaggaggagcgattccgtattcagggagtgcgaactaccggcggtgggtatggtaagggtttactccggcttttgatggcatcggagaaggagggggcagcggagtcccgtagccctccacctatgaaggtgaagcgtcatttgacgccccctccaatcgtaagggttcccagccaattccaagaggatgaggtgaaatcgccggagccctcgatccacaagctcgccgctcaagtgaagaaactccgcaaggagaacatagagcttaggaatcgcaatgcggagctaggggtagaactttctgaaattagaaatgatttcgatacccttagttgcggtttgtgcgctaagatcaagcgtgcattcatagaggtgggaaaggaaaataagtattatgctaattggatgtttcctttcccatgaataaagtagtagtaggtgcttggtttttatctttccaatcatgtaagcacttgctataaataatatggctcattggtgttaaccccaatgtttcccaaagtttttttttgttttatgttcaataaagttcaggttttgaataagtgtgggggagatatcccagcttctggcgtgcatatactctgaaaattgctgaatatttgaacacctgtgttgacggtcgttatcgatcagtttcgaccgtcaatattaccaaaataaaggagaactagtgatgcttgcaatgcgtagatatgttagaataataatatttcactagtattaggtttactaacctttcgcagagaatgacaataaagtgaaggagaatcgacatcaacacagacgataaatcaatcggatggtgtcgagaaccagacttatgtatgaatgggccaagaactcagaattgacatgatgaattgggccaaaattcacaagttctacgaacaggagcaacagaggaggccgccagctcaaatttggctgtattgggccggccccaggttcggccgaacctggtggttcggccgaacatcccttgcctccgttggatccaggttttggctggacggttgagatgaagccccaatgactgttggagggtattaccgaccattccaaccgtcacaaccatcatagttcagctataaaaggagttcactcgcttcacttcaacacacaccttaagcaagagctctctcattcctctcaagtttagtttggtagtatctagctggtggaatagaattagaataggaatcaagagtccagaagccttcgaaagagttcgggtatggctctagtagctttcctttcctcttttgtaagctttgtacttttattagtatactcttatatatacatttatggtattgaaatactttccgagtatatgagtacctactttacattatgttcttgttatactgaatatacggctagcttatctgggagatgctttggtgcgggtatagtgtttgcttatgcaattactctatgtcatgacgatgatattagagtagtatctggtagtttagacgtggtgtctagattacgggatatcattatttggggttatatattgcggatgagaggtgggccgctgatggtgacagctcagtacggatattcctccgcgcctatatataatcctaagttaatttcctggggagggtattcctctgtatttagccccggttggatggtcatgacgagctgtcgtatggaactcggcagtcaggggtggcttctcgaagtaccaggagggcatcggatagagggtattagctagtatatcagttaactagaatgtatgtatactatgtatattagaagtatagggatagatttcttttctcttttctttccacctagcttagattatttattatgaggatgagtagaaatgcttgtgtgtcactctacccttggattatcttaaccccttcttagaatatgattatcacaagtaatatataaattattagttgagttctctctgcattatcttcccatgagataaaataaatacgatacccttggaatactctcgggtgaaatgctaaaatggtatatccgtacgcttgcggatgaactctgtaaccataatataccaaaagtatttctgcaccattgctgagaattatatttctagtaatgttgttaagaaataccaacaacctggaaggcactgaactctgcagaaaattgcagagggatcaggcaccagagtggttcggccaaaccaccaggttcagccgaaccaaagctggccccaatccctctcaattttcacaggtaagcaggtgagcacgttctttatctatatatctccaccatggtatagtactagagctgaaaattcagaaaacaactggttcgagcataagtgtaagataaaatttccaactaatgaaattcttcatgtgaccgatcttgtatattcattattctcagctgaacttctgcttgtgaacaaccatccatgattagggaaccttatacatctaaatgattgctttatgagagatgattaagatgaaaggaatccttgcaactttgttatgactcttgggaatttattttcaaaaataaaattgttttaaaagctccatcctccaattgactttatcttatacctaccaaggccatatgtaagtatatcattgatcaaccttatcatgcatatgactgcttgacattatattgaactttgtcaaatttgtgtgacttgtgttagatatctttcatactctcatgatcaaggggtcattttcatttccactttccatttccacatataaaattaagctaagcttctacactggaagttggctctccacaaaaatacccattcaaataaactcttacattgaactatgctttcttctcctggaaaagttcttggcaaaaagaaaatgagaaaaggagggaaaggcatggctatgaaaaaaaaagagaaaagaaagaagaaggaaataaaatttgctctcaagacattgagcaaagtgcaaagaaaatatagccatgccccttccataatcatgccaagaaaacaaaacggagagaaagtataggaaaaaggagaatcatttctttattccatcattcgacaacatattttactttttcaccatgaataaagacccttgatctaggagtataattgatgatattcttgagtccatatttttggcttggcaatatatatgatgcaggtatgtcccgatttatccctaccaagctccatacgttagccatcataatagggataaattctggcacattttgccttggtgaggatccaaaaagaaaatatacatctttgagagacaagagagaaagtcaatatgaggaaaagagctagtttgcgaaatttcataaaaatcccatgagtctggcagagaagcaagaaggactggaatcaagatcgttccatttatcaattactcaagatggtaagatagccacttataaagttcacaggtgcaggtatgggtgtgaatgatttatatgcttgattcatctcttgaaaaaattcattctacactaacctttactcagggacgagcaaagagctaagtgtggggggttttgttggcggctgttaaatgccgattctataccgccaacatctgcataaagtttagataataaaacattcaacatagtataggtgcttaatctcacatgttccacaagtgttggtgtatagttgtatgcagatgataaaccctgaagttgggaggaaatttagactaaagtgaggaaaattatgtatccatacaaggaggggttgcgaacttcatcgaaacaccagtggatcaacccaaaaatccgcgaaatggatagaagaaggtacagggagttcaccgaccgaaggccaggccaggagggcccagcccaggttcggccgaaccaggggatcatcgttgatcctggggtttagcgtggacgctcctgatgttctcccaatgacggtttgggggcagttcggacatttccccttctcataaccgtcataactgccctataaaaggacctcacttccaagctcgagctgaattataagaggctctattgtactatattgtatactagaataggaagagagtagagtagaaggagtcggaagaattccggagttgtcggtaatcttctcctatttcttttattctgtttattactctgaattcaatatattcttcttgagtaatttagatttatcttgtgagaattatctcttggttagttcctaaatagcatacgggattattgttcactataatcaactaaaatatagtgattgctttggtgagttataaacactaaagtagatattaattgcttagacatggtgtttaggtaattattatccagtaattgttgcgtatcccacattacgtttgaggtgggtgtagaggtggtgacagccctcgagatcacttaagtcctccctgtccgggtacatagtagagcgatatctgggaacagcgggttgccagtgcctgaagtattgcgttaggattaaaattaagctttccctagacactgtttctcactagtgaatcatctctatcctagcctatcaattgcttggtgtccttggatgaaccggaggaagatctgaccacacacgttcccttggattcgatacccttggaatactctgaggggaagtgctacatcggtatatccgtgcgcttgcggattatctgtaaccgtttcaaataccaacaccatgttcaaattgtgaaaaaacaggtataatatctatagctatgtattatacgaaaattgtagttgtaatttatttattattaccttggaagcatcttgtttctttccttaaattaaaaggaaaaaaaatatcccctctagccatctgtcctgaagtgtgaacaacatactaggttgggataacaattccttgaaggtcttgcattatttatactgtgggttatcagtaatgggccacaagcaaaccccatcaaagatcaaccttcatcgatgatgggcttcacagttatttttgtcaggctgttatacctggcccgtcaccgatgaccatgaccctcatcggtgatggattttcgttgtggcctattatcaattatcttggacagaccgcaacaaaaccccatcactgatgagggacgggcctggccccgaggactcacatactgcctctctcggtgcctatgtgatagagttctttgaggtctgataaagatgaatatctctataacaggccgcacgactccatcacagattggtcgatttggatgtccggtgcagttttgtactagtaatatcaacattataattactctagaggtgtggttagtccattgttccatttcttattatacctttctgttccagtttaacctgactgcaatctattttgttttaattgctgctccttcatgatatcaaagctcggttaaccgttacatatgaaagaaatggatgaattatttaatgtggtgcaagaattttgtgatattgaaggtgttccagttccaaacatgtacgaagaaatactggtaagtaggggtgaaaacggtacggaaatttccgagaattccggcaaccgtttccggtttgcaccgaccgtttcaatcggtatcggtaattgtcggtatcggaaatggaaacggtaatctctttcggaaatggtagcggaaatgatatggggttttttccgaccgttttgtcggtaactgttttttatcggtaatttccgtcaaatttccgacaaaattccgaagaaggaagtcggctaggcctggctagcaggaggaggagcccattaggcattaaggagcagcccattccgaataaagaagccaactaggcctgaccgcatcgtcgtcttcatcggcgctggggcaccgccgcgccatgttgggcgccgccaccaggtcgccgacgccggccgcaacctccttcgccccgacggcctccgtcgcagccggccaccttccctcccccatgctccaccgccggcttccgtgccaccgagccaagcgccgagcgccgccgcaccgccccagcctcctcctccccaccgatgccgcccctttctcctctctccttcccccaccgccgccctgcgccaggccgccatctccggcgcctctctcctctcgggcgcgcgtgaaggagccaaaggcagagaagagaacgagagagaaaacagagaagaaatcgagagagcaggaaaaggaaccgagagaagggaaggataagagagagagaaaaaataaaagaaagagaggaaaagaaagactgtgggatccactggcgggccccaccatcttgactcctctctgtgatcgacctggaaataccaaaaagtctagtttagcatgaaacttaattacaacagtagttatacagtgtcaacataaaagttcttatgcaatgtgccactgtaggacgatgatatagctatgtcaattgatgatgaaataatgaatgatgtttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttatcaatcttattgtcaacttattaatcatcatataacggtgttgtgtggcagcgtaatgatgcaagggtgaaattataaggtcatcttcatacatagttaaatgcgggatgataccacagttcgctgtttccgacatgaattttcgacttccgtccgatatcggtatattcccgttccgacggttccgtttccgagataccgatataaccgatatcgttaccgtttccgagtataccgttccgattccattttcgagaaaataaaatgaaaatggaaatggtagagggtttttccgaccgtttccgaccgttttcatccctactggtaaggggtcattcgaggccgttaactagagtgacacattgaaatgccacaattcatctaaaatcacaaagaaccgaataactactttatttgcaatgttcgcattgttttattagtgctctcttgacatcgtggagtaattgcgggtttggtaaaactaaaattttgctgaaagaatatgtagcgagtattaatttaattagttgatttcccacgttttgcttgtgggattactaattagttttgaatatgttttttttttgttaacaatcgagttaggagaaaaaggatattagttattaacaactggtttgtcaaaccatatctcaagaaaaataaatttaatagatcatgtagcagattgtagatgaaatattaaattgttgcgtaagatttgcatcgtaagaagcaagaggtaggaaaattgatgaaaagtttgtgtttaattattagtactaatcacgaaacaaaataaatgatatacctcactttgatgggagatatatggatggaaatatgttaagtattataaaaataatagatatctatgttaaaatattgtggaaatgatacgagggggtgttgattggatttgcttgcatattgattcgtagaatttgatacaatatagatgatgtgcatgcttgcattagctttgatatgtaattattactaatagatgatgaggtggtatgtttgtatgttaagttttaggcttagtgggttgtaactatataaaatgtacagattagaggccgaaagtcagacaacgacaccttgctcatgtagcgcctattttatgataatgatttcattttaaatgcattgtttcacaaattatcatttctatcagacaaaataaacaacagaaatagacattaatatccattccatttatcatttctcgaaaagaaaacaaagattacaacgacacgatgcagttgctgtcttaagcctagttaaaacacccccttgtctccacctagccgatccaccgagtcctaagagagcagtgaagactgtctgctcggcgccatagaacacagtagacgaggacgcgttgcggcacgagaacagaccggcgagcgaccgaccatggcgtttgctgctctggcctcgctcgctatggttgccagctgctctgccacgggtagagctgctgcggcagttgacgtaatgcagggaatcacttctgccaagcgtgctgttcctccttccttgacccttctgtcttgctgctccgtccataatgcagggaatcacttccacaaactgggagggcctgagcccacctaggatcaatctgtattattactttctgttttgacgccatacactgatccttcaattattttcgggtcttcttatgtgtaagcaaagaactcattagcagattcactacgactgtaaaaagtgaaaaatgcgtgttacttcagaaagcatgaaaaaaaatgtaagctgcaatgtgttggtaatgttcgtgggtacaaaatatgcagacatcgatagtcctgcccgttagtatatttcaaactttttcagccatagtaagtagagctaatagcatgcggcccaacaagtgagatggacaagttcctattgaagtatttcgaaatgtggttgtttaaatctttgattatggaaaaaaagttgaagttccccaacactgcaatgtgctcatctcaggttaaaggtacagtaagaaataaaggattgatccacagtcagcatttgatttagcctatttgacatctcgaatcagctcagtagaagaaaaaagaaaaggcatgctgctgattatgtccagacatttaatatttttttttcactcacaataggtggagaaaggctaagtatgtgacacagccgaaataacccccccaaaacctctatgtttctgagggcaagaaatagttaagaaaaaaaaaagaagaaacagagttcatacatgcaagcattacaagaaaaggagtaccaatacaagtaagaacggctagattttggaggaaatacttataacacaagcatgcctttaaaaaatcgcagaaaaaagtgcacgcaagaggaagaaagaaagacccgttcgaatacctttggccttgatcaacgagatgttctatctctgaagatgttgacacaattattggatctttcacccacctactgctggtgacgaaaaggtttcaaatcttcaactgaaggaaatgtaagacaaacaacggtgtagtacagttttgctcacattttgtagtacaatggccaggcaaaactcaatcaccaagcccttggttttatagaacggaaaaggtaagcagatcccattggtgcagtagatagggtccatgcatgcactggttgaaggaagcatgggcctctggctgctgcaaacgtagtgaatgaagttgcactaaactaccagtctgaaccattctgaaacttgtgtgcctctttgattttccaggaacataggaatggcaaatgtcacagagcaattaactgcagcgtgcaggctacagttactgcgacatttcggcaatgcatttcttgttcagttcctactgctcacataccacttcagttttgtttcacaaactggcaagtggctaccaattacaaaatcgatctctctttctattaggtcctaaaattctctagagacccaactatagataaaccaacccagctaatgaaccatagatagtaccatgtaagttgaaactacccagggtgaaaggaaccgaactagccagtccaattgcacaaatcaacacggaactgatctaacctagcacaccatgttggtgtaacggtgttacaaccaatgtaagagatcctaaagtcaaatatgttcattatcacaatagagcatgaaatcagggtagtgatctcaggcttgctgcccgtgcggaccataatgaatctggtgtagttgtgcagaacgatatgacttatgctaggaggcatcattatgtggcaactcgcaagcagccatctgattctttgacttcaccttcccaagcatctcagctactgtcctgcagcgacattgctttccaggacggatgacatccccatagacagccatttcaatcacatcaagttctttatctgacaaagaaaaaacactatcagattaaatttgcatgtcatacgaaactaccatggtaggtttttcatgctaaatagagttggcacaacagttacgttcgattagagattcagttggatctcctgattcaggaatgagaagacaacttaagatataaaaataaataagagcagtccatggccctatttgggggagcttaagattctaagaatctgctggttagtagctagcttccgagaatctggagaagctgggttttccagcttctggattctagttccggattctacaattacagattctcagaatctgggtaacaatctggactgtttgggggctgcagcagctataagctaccccaaataggtcccatgtatgttatttgttgaaactttttatcctctggccaaatcagcatagtttgccaaaacaaacgcatgaaatagatattatctgaaattacttgtttatttttacaaagtcatgattgttttgaagttttatggctagttcaaaaagtacaattttatagcaccttgcttatagacaaatgcatcatgatcctaattattcacagtaacaaagcaatttttcgaagcaattgttaataatggaatgtacaatgaacaattctagagaaaaattgtaatctagctccatagaattgttctcagatggctcaaaggtaacttgttttatattgataacagtacggtgcaacatccccacctctgcaaatttaatttcactatttcaaagaacatcgaaacatacacagccattaatacgtggataacgcataacagaacatctattaccatccatctataccatttataattgctaagggagcagcataccaatggacatataagcatgtacagcagaccaatgacattatgaaaaatcatgcattgcatattgcaagctgtttattctgttaaacataagaaatcagagggactactacacatacattataaagatccatgggagcaaatgaatcgcaatatcgacatactcaccagtgaacttgatatcacaagaaaatccctgcatttctgcctgctctatccatgctttatcagattttgaccgattcacccttgtctgaagaatctggcaattgtcaacagtagactcccctcctaaagcatgacaaaaaattcaattccagttccagaacaatcaacatgagaaaatctgagtataatggaaaacaaattgtacaaataacagagaaatagacaaaggattggaagatgactttgttacaaaccaagtgtccaacctacaaagtaaagtagggccagcactgatcccaaatttagcacaatttggaagaataggcatcaattttcagacctggtaattataaactaagggatgctaacagcagaacagtaaaacatatcagtataaagcagggaatcttaatagcatcaaagacaatattctaagcattgaatcgtaaagggcctttctcatccgcaaaagatagtttccgggatgagggtcttgcccatttttcagttggacccttccgcaacttatgtgaggtccaacaatctcgccttgtttgttctccttaaccatacaactacagactctcggatcaaagaccccatatccacccaccatttatggcgttcacacagtaatgttctcatgccaatttgttgaaacaaaatgacttttcatcccaaaaactagcctatgaagtgggactgttccaacatcaatatcagattttatttcggtaaagccaataaatagtacggagtatgtgtgcggttaccaaaggagtgaagtagaactgttaaaacttgcagttttgtataggcattagtttgaaaaccacaggtgcgctccatatatggtattatgttaacaattcatagttaaattagacaagcaaaggctatataagtaccaagtacgctgatttaaaaccaagttgtgtcagcctttataacaaataactgatctgaaccaagtctgaggagaaggggattggggagattggggagattgggaagatacgcaaaacgaggtaagccattagcacatgattaattgagtattaactattttaaacttcaaaaatggattaatatgattttttaaagcaactttcctatagaaattttttgtaaaaaacacaccgtttaacaatttgggaagcatgcgcgcggaaaacgagatgcttttctctctcaatcccccagattgcccaggaacgaacgatgcctagtttaatattcaataatactgatatgaatactcacaagtgatagaaatccaaagaaaaatacatgtttcttgcttaacatggattgctaaatgttacatgatattgttgcacagccatctttattgattggagaaggcatctccccctaatttaactaaacataaatgatttacttagtaaaaaaacaaaaacatacggcattacagattccaattatcatctactgacccacaggagattaggctaaaatttctccatctgaactcacctgtgtactcatatccgattttaaacatcccaaccttaatctaaatgttcctctgaataaaacaaaattagtgctcatctgcggatgaactcaactcagcgacaactcctccaatacttgatcgagcaaaaatagtccgagtatccaacattgcaactacaccgcggcaagcaaacgcatcagaatcctacagatacgaacttgacggatcgaccaccacctctccaagcaagaaacggaaaacttgaggattctccctaaatcgagtgggcaagaaggaggggacgcacctttggagaaggggacgatgtggtcgtactcgtagcagaggcagccgtggcagctccagaagcggcggcacacgacgttgccggcggcgtcctgccgccaccgctccgggtgccggcccatcaccaccgccgccttccgccagcacgccgaccgggtcttctcgtcgaaggacctcggccgctccttctccctcgccgccgagctcccgccgccggtcccctcgccgtcgagtcgcggcggggagaggagggagccattcaccccagccgccgcagctttactttcggctggtatattcgcgttttcatttttttttaagtccaaataccccctatgatttgaaaacgtcgatgcagcaccctgaactctaatcctatcctatgatatcgtttatataacacttaaaatggttttgcatagtagtttttatttaatttacataatcgttggatgagtatgattatgtgataaaggggtgaaaacgggtcgggttcgatcagatttcacccttacaaatggatgattaatataatactgatatgacatcactatagaatataaattgataaccgatgattgacagtatgtgaacatgccataccagttatccaaaacctgagcgtagctctgttggtatgttccaaaactgcttgtttaagatttgaggaccactcatcgactcacggacctcacaggggtttttcccgtttcctgagtcaacttcggttggtcctagttaggtaatagggtacatatacgtgcgtgttcggtggtactgtatgtttcccgtacagtgaggcataggtcctcgaatctctttcctaacgtgtgttagggacgcgcacgcgtgtgtgcgtgcgttgtggtgtgagtgttgtgtgtgttcgtgtgcgttctgatttgtaccctctcaaaaaaaaaaaaaacaaaaccactatcaaagtaactcagaggtaatttgaacggtttaggaggctaaatctccgattttaaagtttatggtgctggacaaacttctatcaagccggtgcatcggcaatctctggatcctctagccggtgttgcatccttgcatctgcttcaatctagtcattaaggcaaaagattgcctgtcaggtgcaaggcatgacctctattcttcaataatttttccaacctcgctaattgcaagctctgaagagatagaagaagttggaaccaatccaatagaatgtcatgtgcaaagtgagctagcacaggaagagtccattctctcttaatttccaccactcttggagatcgaaattttcacgatccagtgtttgaccatgttctgtgtggattagtgttaaggtaatggttaagctctacgtctgagttccaatttgacctgctacctgatgaggaggcttgttccttgcccctgatcttcttccacaaattcatcgcacttgatttactttgcttttttttttgtggggttttcttaggcacccgacgagcaacacttagctcagtctggtacagacggaaaaccctgaacaactcatctctagcatgttgataagctttagaataatcaagacccattgcatcactattggtatgaaagcagcctccacaacctccaactttttatgaggatcaagtaccaaagcaaaacaataaaggtgtggaatagcagtgaagtatttgagaaatttttcttccatgggttgaacaacataagctaaaactctgtcatgtcggttttcttgaaacacaaaggacaatttccaaatacattcaagcaccttacaaagaagtaggatagtaaattctagatagtaggactgtagttttataaaaaggctttagaaatatatgcagacgtgttgctatgtcccattctcccttagtaagaaacaaaatctcaccatcaccatcctcatcagtatcattacttctaaagtgcaatgaatcgatgaaaacagaaattattttctcataccctttcagttgatgtagcatgaggtatgttgtgttccacctatgtttcacatcaatgccaaacatcctcacaagtttattctttgctcggcaatagtcttggaacatctccttcatcactagctgatccccaacaataaaaacagcttaatggatcttgttgagtaaattagtaacaacagtaatcctgcatagacaataaattccttgtcatagatgcattaaaattgataaattatttacactaaaaaaatcaataaattctcaacgactcctaatacatgcttgcacagtcaggttgatgatgtggcagatgcatctatgatggataacataacctccaatgtagctttacaaatttgtctccaaaatcgtcatggccgttgtatttgctgatgcattgtcaagagtaatagaaaccaccctagattctaaattgaattcttgtagtacatcaagtacaacactaagataagaggttctttggtgcttggatatccaaatgtcatatgtcacagaaaaaggaaagctaacagtactgaatgagcatttcaactcatccaacctagaacgatataacacaacaatattgttcttggtagttttccttgaaacttgggtgtactgtggacaaaaagcatttcggatcatcctctgaaattttttgcttttgcccatcctaatcggtagctcctcagaaactatgtaacaagcaatttcatctcgagctactcgtggctcataggtccatgtacttacagaaccattgggtccggagctcagttatgtctgccaggctcctgccgatgctttatccttgaggtgcgtcaaataatgtcggttttgatgtcctgttcctaaactagaagatggggataaagtttttccacagtgtttacaggtagcacgtgttactagttgaccgtccaccttacccttattttttctatgtgttgccaacaatccgctctccctgcagatggtgtggatggctcggccttgcctcccggcaaagacaagaccgtgtcgtcattggcctcgatgatggactgttccgtaggatcatccccatctccctccagaccatccatatggcggttatccatcccatagtcatccataccaggagatagttggcgggcatcgaccgacctacgggaaggaccaggcgagcattggcggcgcctttgcgagggtctcgacgaggttgacctccgacgagtatcgccccacatttttgctgtggaaaggaaataactatgttgctctgtttatttgtggtgcatttttcttttatgataggaagaagaagaggaggaggaatttataaaacaaattgccctcatgagctagttgtttctcgttgctcttgcacacaacacacaacacatttgctgcctacgggctccacagaggcacatggcgcagccaatcgcctcaccatgcccatgcagcttctctgccactctgcctctggcaactggaggtctggccctctactcgtctacgcctgcactgctacaccaggcgacccggcgtatatgtccttcgcgccggtgtggcatggtctaaactcaagtcgtcccatctccatctcaatccgaggcaggcgccagcctttcttcacacatccgcggcgtcgtgcggtcgtgcggtcgtggcgaggcggcgaatggcgatggcaggatgcagacggacagcagcggggcaggacaggatcaaccaagcaagggaatcacaggtacccagccttcccagtccttcatactacctactacctagtcctagtactagtccgagctcttcgtttttccagcggtaaatcacaagtggtgcccagcgccgcgcgtctgcatccgttcggccgtccctgtcctcggtactcgaccagtcgaccttgcagtgacagcagtggactagtggtagcgcagttgacggacgctttgattcattgcgccaatgcggaagggaatcgcgggacaccgtcgcagctttgcaggagatgctctgagcgtcttgtagagacgtagactcgtatacgcgtgggacgggcagacagagatgctttgatgcgctgcagacttgcagtgccgagcttgttgccggggcacggaaagatatgcaatgtgcgcgggtgcaggatgcaggccgagcgtgcgtggtggtggaggcgcgtttcacacgatgagtatgtagaagcatgcgtcgctccttgatgcgcccggccaggcctgatggctattgcgaagcccattgggccttcgtcgtgcctatgggttgttcatgtgctgtgccggcccatagcccactggtcgtgttgtgccggggagcactaatgggcgatcagtcgcgccctctgcacggcgcgcggtcagttataacccgtctagtctctcctctctactactagggcggtggatggtgcgtcgcttggagcgcctgcgttttgtttctcttttcttgggagtgcccgcttttcccttttttttttgttttttttcggtttctctttttttttttggttttttctgtttttcttccgtaccttccgtttcgttttttttctgttttctttctttccatatctttttctgtttttaatatgtatgtatgcaaactttatatacgtacaaatacaaactttgtatacgtgtattttttagtttttatacgtacatataccaattttttatacatgtatacaaagtttatatacacatttataaaatttatatacgtgtattttttttaggtttttatacgtacgtacaaatacaaactttgtatacgcgtatacaaaccttgcatcccgtacgtacatatatataaactttttatacacgtatgtaaagtttgtatacgcgtataccaagtttgcatatatacaaactttgtatatgtacatattaaaaaccgagagaaaaaacacgaataaaaaaaacaaaacttggtatacatatgaatataaaatttgcatacgtatatcttaaaaaaaccaaaaaaaggaagagaaacaaaaaaaagggaaaaaaaccaaacagaacgagaaccgaacaaaaaggaagagaaaccgaacaaaaccgaagaaaaccaaaacagaaagataaccgaaaaaaggaaagagaaatgaaaaaaaaaaggaatcccgcgcgggcgccgtcagccaccccctccgtgcgcgacacgtgtccagtcgcgcggcggagggcgcgtgcgattgttcgccgattagctttttcgtttgtgctgcccgccatgcccgttgtctaggcccaggcacggcccatatacgggccgtgctttaatttctagcgtgctaggctatcatgtcttgggccggcctgataaagcacggaccaaatcccagctctgagacatgtttagagcttggtgggagaaatcggactacctctaggagtgctgaagataatttattgatctggaccgtgaagctggttctccattagcttcacaaccccatgtggataaggtcagagctcatcctaatttgtacattcatgtgttgaccaacaagttaagagagacatgggatgcaactgatgctttcacggctagcgtctgccttccaaataatttactctgctatctccaaaataataactttgcaagataagattgctacgatcatcaattcttatagagtaaatttcacaaaactacagatactttgagcaaattatcacaaaactacagatttatggtgatgtattataaaactacatatttaacactaaatttcacagagaactacaaataggtggggtatcgtaaaactatatagatttagtaacaaagtaaccacaaaactacagatttagtgtcaacttaatcacgaaacttagacgtttataactcaaacataacactagtgctatgtactccaaaatatatatttttatgataactttattactaaattatagttttgcagtactctaccttaaatctgtagttctgtgataaatttagtgttaaatatgtagtttgtgatacatcaccttaaatctgtagtttaattttgtgataatttggctaaagaatgtgtggttttgtgaaatttactcattcttatttttttttattgaagtatgcaactgcctccatatgatacttatgaaaagtttgtctcatgaaccactgacttatcgattgattctctgtagccattgattgtactacgactgacttgaaagaatcttaccaccttactttttatgtgctatttattgtattttatttattttctcctacaatataatgtagatgaacctttttttttctctcctaagggctctatgtatttgctcttctctttcgactaatgggagaaccttttgtatttcatttatggcacaatcgaaccacatgatgtgagatgacgatcattttggcatggcgagaaagggcaccgacgtaagtgtagggttgattgcaaagctgatcggtaactccatatatatgggagagagaaatatggatttgctcttttttgcaaaaaagaaaaaaaaaacagtgttgctcctaatggtgactgggtcatgtgaataggatagaatagacggaaaattctttttggtggcaggcatataaggaaaaataatatgaattatcttgtaaaagggatgtagatcaaatattggatggtcatgaatggtttggacttttttttttttgtctatgcacttattgtgaagttgtacattaagaattacataatttcgaaatatggaaatggtatgatgttattttatgcttgattgccaaaacatacacattctttttattatttagttaaatactatcgtagcgttagcatggacaagttgctagtcaattgagtgactcatcccatagtgcatttcaccagaaaataaaatattatttacggtacataactatcctctttttctgaaacaaatttctttattccaaggatcagacatataagttatgatccatagttcacaatcaaacagtacatatataacaaagagcaattaaaacatattgttttacaaaaacaaacaaatgtgctatagcacggtaacatcacatgcccttcgttctgatgacgattgccagcaatatacacaatagacattttcttttgacgtgaatgtacacaatagacatcaaaccacaccattatttattttccgagtagttccaccatttcttgtacttggactgctgcatgatgcattattcggcctgctggtctattgtattcgttgtagtcattacatcctgaatcattataatatcacaaattttgttcatgccattattataggcttataaacaatcaaatcatttggtgcatttcaacattgtacgtccgacagttcaagttgtctgagagaaaaacaatactatgcataggtaatgaaaatcagcataaactcagatgtatctgcaactcttatttgttgggatacttaaaacaaattaaaataaacagttaacatgcttgtaacaaggtattgtattttaatatgtatgtgtaactgaaacacaattaatagcacacatagatttaatgtaaacctttagagttttccacttacagcttgtgtttgtggagtactatagaatgcatgaatgtcaagctgtctagttgtctcaatgccaggattgttcttgactatgttgtgctgaatagtgccatatgccatagcaagttgtccagtcccaccgacaatggcccactcaccagtttctggagtagtccccatcacctgaagctttgatccattaaacctgtaccatttcaaaattattatgcgccacaagaatctacaataattgaagcacatgaagcaactaaaattgtgaaataattaatccattagtcatggatgctgcaatcaagttaacaagcatcagactatcatgaactaaaaagaaatcgaagcgcagttaagcacatatattggtcctagttcaatgctgtggacaaaaaagagttattagcatgatgttgttcaataaaaaatataaaaacttgttagtacctggcatccacaaactctatgttcatagatgtgtaccaggtgttgttaacttgatcaacctggacatgcattcctcttgcattgcaacaatagtactgtgttgaagtcaggtccatcatagataggccaatcgttgataacaatcataccaaacgaagcgggatgtgatgagggcaccattgtttcttggttgtggtttggccctgtaacaacttggtgcaagtacaatctcatggtaatctcacactgatcgcggagcacaggccgtactggaataactttgaaaaatggactagccatggctaaaatgtgctttggtaggactggcaaagtggaactaggaattgtttgattctttgcttggtgtcgatgatcagagatggtgtatggctagctgtatttatagcgtagtggtagcactctagttcatgaggccaactcagagcttcatcgattttctcgtttgcattccctggctatagcatttagaagaagtatggaataatgtcacaaccaaacaaggtcagatgtctaattcttttgcccccacttgcattagccatccaacatttttttcccctttattttcactggtacacaacaagagatccctgccagttttcgaaacggcaggctgcatgtggcgcagtgatggagttggagttgacacaaaaatatccctggaggtttgtcattccaggtttagtccaccaaccggcagtgatatggatttgccgcgaaaaaaaaatagtccagtccaaatgtgcacgaagatgacggtttgtatatgggaagtaaacatttttgtttttttggagctaattatccatcatttcttttgaggtgcttatttaaaaggattgataatgcatctagagacagccatgcattatgcatagagctaattctatcagtgtttttttttctctaagttttacgaagttattatcagtgaaaagaagaagcagttcatcattcaagtaagataccctgggaaaatctgattttgcggttcctcaactcttggtccaaaattatacattagcaacatgaacatcagaataacttcaaaagacatctcaaatttttggtttgaaggtgtttttttgcgtgatttgattcttacatggtacatgcctgacatattattaacttctgtcaaaaattaaggtggttattaattgttcctgtaaattcatgggaaatcataaacagccagtcacttgtggcaaacaacaaattaacattcattaatatatattcttaaggaaattgtaataatgcaatattgttttaatacacattatttggttcgtcatttattatatgtgtgatttaaaattaaacaaaacttatatgcgtcatttatattttctcgcattttcatacctgtgtcctttcaatagagaagtatcttgtagttctgataatttttctctagcgtggttaacggaaggtgcattcctttacctgcatatacggtgtgagtggtgctgtgtagcggttaatccacaattgtattttagaaaagcatgtatgtatatatttgtcctttggtgtggtctggtccacctgttagggttgaattttcaagagatgacaaatatggcactttacagaaaacaaatatgatgacaaatatggcactttacagaaacactagagacatgatgaatatgaaacatatattcctttttttttgaggttcaaatcgaaaaaaaaagaagccctgattatcagtgtatgcgtttagtattagagttagattagatttgtatagattgtatccgtatataacttttatttaagagtttgttgtaatctctattgtattggatatataaatacaatcaccctcccacgttgggttgtgaggcgttgtgaggcgtctcataattctctacatggtatcagataccagtttccttctaccctaattcaccgcttcctctggccttcgctttttccgcgttcgcttctcttccgctgcccacgcgacttccacgtccccaccaccgcgccgcgccccagcgatttcccctcacgatctcgccacgccccagccccactgcgccttccatgtccccaccgcgccacgacgcaccgcgccgcatcctcgctcgttccgtgccgcgccctgcctacatcgcgccgcgccgcgctctgcccccatcgcgccacgccgtgccctgcccgcgccgcgccctgccctgctctgctcacgctgcgccgctttctgtcttcgccacgtcgtgattattctgcctctctgccatgtctaccgagtccacctcctcttccacaacctcgggaacaatggcatctacatcatccggctctactccatcttctgctgccagcaccggggattctaccggctcgatcttcgtcaacccgtatgccaccgtcaacgtcaagactcacataccaattaccctggagctcaagcaccccaatttcaacaagtggaagaccttcttcacttctatgtgtggcaagtttgggctccttcctcacattgatggcactgcaccccctcgtcccgacgactcgacttgggcacaagccgattgttgtgttcagggctggctgttcggctccgtttccgatgctatcctcgacgtcgtcatggaaaccgaccagaccgcccgtgacctatggctcgccatcgacgatctctttcaagcaaacaaggaaccccgcaccatctatctcagtcacgagttccactcaatgacgcaaggtgacatgcccattgccgattattgtcagaaggtgaagactgctgccgatgccctccgcgacgtcggccaccccgtcaccgaatctcagcttgtcctcaacttgctgagcggcctcaactctcgtttttcgagcaccgccgacaacatcgctagcgcccctgttctgccctcctttgcctcagcgcacaacaccttgttgctcaaagagctgcgaattgccaatgcacacaaggtccaggctgagacaaccatggtggtggctgcctcctctgccaatgcctgcacttccggcacctgtgcgtcctcttcttcatcacagtctcatggcgatgtctccaacaacagtggtcgccgcaaccagtgacgctacaacggtggccggaacaacagcagtggtggcggcaatggcggacgacagaacaacagcaacggcggcggctatggcaacttcgggaacaatttccagcagcagcagcaccaggctgggccacgaactaccggcccatgggtctgtttcaatccatgggctgtgcagcagcagcagtctccctggcgtcccagcaacagtgccggtctgcttggcccatatcctcaagcacacacgacatttgcaggcccatatgtctctccaccaatgccgggcttgccaccaatgcagcaatctcagcccaattgggatcaggcaggtctgattgctgccctcaatcagttgtccgtgcaaagtccaagtccttgggtgcttgacacaggagccacttcacacatgtcctctaccgacggtattctcgatactcgtcttcccaattcctataccttcattaccgttggcaatggtcatactattcctgttatttgtcatggcacttcttttctacctataggaaccactaaatttgatcttaaaaacatccttgtcgccccctctttggttcgcaatctactttccattcgtcaattcactcgtgacaataactgttccattgagtttgatgagtttggtttttctgttaagggcctccgtacccggcgcgtgattcttcgctgcaatagtcgtggtgacctctacactctacctattgctgcacctgctattgctgcccacagcttcttggcccaatcctctaccctgtggcatcgtcgtcttggtcatcccagttcagctgctattcagactctccacaaattagctattcttccttgtactaagatagatcatagtttgtgtcatgcgtgtaagttagggaaacacacgcgtctacctttttctcggtctcagtctagtacatcttctccttttgagcttgttcactgtgatgtgtggacctctcctgtcttgagtacttctggctttaagtattatttagtggtgctggatgattttagtcacttctgttggacttttcctcttcgccataagtctgatgttcaccagcatattgttgagtttgttgcttatgttacgacccagttcggctcttccattaagtgtttccaggcagataatggtaccgaatttgttaaccaagccactacctcgtttctcgctagccgtggaaccttgcttcgcttatcctgtccttacactctcctcaaaacggcaaagccgaacgcatgcttcgcacaatcaacaattccattcgcaccctactcatacaagcatccatgcctccttcttactgggccgaagctctagccacagccacatacttactcaatcgaagaccctcaacttccgtccacaactccattccgtttcaaatcctgcatcacaaagttcctgattattctaatcttcgggtttttggttgcctctgttatcctaatcttagtgccatgactcctcataaactctctcctcgatccgctggctgtgtttttcttggttacccagcttctcacaagggctatcgttgtttggacatttctacccgtcgtgttttcatctctcgtcatgtggtttttgatgaacagacattcccgtttgcagctattccccaaactgcttcttcttttgattttcttctacagggtgtttctaaagcggtagctccgtcctccttggacgtcgagcgtccgcgttctctaccggtcgctccctctcctgaggtcgagccgccggatgacttggccggccctgatatgtctcagcttcttctccataatagaaggctacaatcatcgcaagctccagaaccagctatattggcgccttccagtgcatcctctagtgccgatgctagtactacgggcgggagcatgtcttcttcatcaccagtgcaaactatatcgagttcttctattgctcagccgcctgccttgcatggtgttgcttctgctcggccgctgatttctccatatcaccatacgtatgtgcgtcgtactcagcctgtggcggttcatggtcctatacgcaccaccagagcttttcgagctgcacaacattcacaggatcaacagcgtcatgctatggtaactcgctctcagaccggcaatcttcatcctgcccagcgcttcaattataccgctatgcagacttctgtttcgccagttccttccaattatcgtagtgctttggctgaccctaactggcatgcagctatggctgatgagtacaaggctcttgttgataacaacacttggcatttggttcctcaacctcctggtgctaatgttgtaaccggaaaatggatctttcgacataagtttcattccgatgggactcttgctcgacacaaggcacgatgtgttgttcgtggctattctcaacagcatgggattgactacaatgagacttttagtccagttgttaaacctgctactattcatgttgttctcagtattgctgcctctcggtcttggcctatccatcagcttgatgtcaagaacgcatttctccatggaaatctagaggagacagtgtattgtcagcaaccatttggttttgttgatccttctgagcctactgctgtatgtttgctccaaaaatcgctctatggtttgaagcaggctcctcgtgcttggtaccaacggtttgcaacatatattcgtcagttgggtttcacatcttcggcatctgacacttctctcttcatttataaagatggagataatgttgcatatttactgttgtatgttgatgacatcctgctgactgcctcgtccacttcacttcttcagcatattactgctcgcctacactcggagtttgctatgactgatcttggtgacttacacttctttttgggaatttctgtcactcgatctgcagacggtttatttctttctcagtggcaatatgctgttgacttattgcggcgagctggtatgtcggagtgtcatcctactgcaacaccggttgatgctcgatgtaaactttctgctacagatggagctcccgtttcagatcctatggagtacaggagtctagctggggctcttcagtaccttactctcacgcggcctgagatagcttatgcaattcagcaggtatgcttgtttatgcatgatccccgtgagcctcatcttgctctagttaaacggattttgcgttacatcaagggtactctacacatttgtcttcacatcggaactgcaccagttgactctttgacagcttattctgatgctgactgggtgggttgtcctgattctcgtcattccacatcagggtattgtgttttcctcggtgaaaacttggtctcatggtcctccaagcgacagaccactgtctctcgatctagtgctgaagctgagtaccgtgcagtagcacatgctgttgccgaatgttgttggctttgacaacttcttcttgaactacatattccacttgcttcgaccactatcgtttattgtgataatgttagggccgtctacatgacagttaatcctgttcatcatcgtcggacgaagcatattgagattgatattcattttgttcgagagaaagttgctttaggacaagttcgtgttttacacgttccgtccttacatcagttcgcagatatcatgaccaaaggcttgccagttcagttattcactgagtttaggtccagtctttgtgtttgtgatgttcctcccgctttgactgcgggcgggtattagagttagattagatttgtatagattgtatccgtatataactcttatttaagagtttgttgtaatctctattgtattggatatataaatacaatcaccctcccacgttgggttgtgaagcgtctcataattctctacatttagccaggctggaaagttgggaattaccataacttcacaagacaagaaacctaattatgatttgattagtgctgaacataaattattggctaatcagacatttcttttgtgaaacttatcaattttttcacgagattttgtatctggtgatgacgactctaccatttaggtttggaatccttgatggcatagattatgcttgataacttggctaatatgctgacattaaaatatgtccaaatgttcataaatgtcacggacttcatagcgtttccataaagaggacaaggccatgtactgatgcacatctgaacaaaattaatgtatgtcataaaaacagataaattgtgagaaaaatttgaactgtgatgggcaattgatcatatcgtaattgtgacaaccatttctaatcacaacacattagtagcgtggagttaattctgaggaattttcatgtagctggaatatttcttttgcaaaacttttttagcagcgttcagtagcgatgaacaagtgtcttcattttttcgttgcagctagttaggtaacattatttttgcaataagaaatcatgcacgtcagcagtaaccagtaactaattcaatagtcctcaaaattattggatgtgtagtgtcatatatttatgaagtttagttgcatggtacctacactaggactttttttttcacgaaatggaaatgcaagaaaacatgatgaattcctatctcagcctcctaaaagttaaggccgcctcaactctacaactgaaatcacatttgccatttccatttaaagaatcctgttcatattttgttcgcttctctatctctacttctgatttatattcatgctcgaaattgaattgatagaagcaatttctattgatgttttcattgagcatcgatctgttatgcagaatctgcttcaaaatccctcgccaaggttaacaatttcagaaagctaaatttttttaagggaccactaaacctgaaataacccagcccctcagcggagctcatgtcagaaactttttgacgtatcaagaatattaatttgcatattcaacgactggacattctttggattaacctgtcctagccgatgaccattagcaagaacaatataagggcacattcaacggtttagcctgctatggactcttaaataggccatgtcagaaaaaaaaaacaattgttctacaaaggctggttttatgatcgtctctccactaatatgcagtaatatataattaaattcttgtagcaatggtgctgtgattttctgcattttggatctaaatacgtgacttttcttgaagatggaatatacaacggccgttgcttatcgtctgctcgtgttttcctcgttgtgagggccgatggcatgcaaaagatggatgcatctcccttctttttttctctctcatccacatcatcaaatctgcttacatggcaacaaatagagcccactaattaatactctctccttcccaaattaatcattagagcaagtttaatagtatagccaactactagctccaaatcatctatagccgatttaatagccaattcatacaatatttacccagaaaacctacaccacggcatcccgtggagacgggatcccctcctcctacctcactcctctccccaaaatcatccgaatcctctcctcctacctcactctcctcccccaaatcacacggcactgcagccctccctctccctctcccctctctctctctttctctctctctctgaagaaggccgagcggagaagaagccggccgggaggaagggatcgtcgtcgtcgtctccggcggccgaggaggacaacgacggcactgcgtcagcgaggtcggccaaccctcggcggggtcaccctcgagctcgcctcccctcgctgcgccgctatggctcgctgccctcgtcggtcgggtgtgtgccggggagtcgtcgcctcggggagggcagaagcgggagctccccttgtcctcgccctcggcctcggcgtcaccgtcgtccccgcttttgcacctccaggatggacgccggcagcctgcgtcgacctgcaacaggtatggccgtcaacctcctcctcggctcctcctcaagacttctcaaactctctggctcgggcctcgaccctcacctcgtcgtgcctcctcgacgtcatcctccgcagttgcggccctccctccctgacgtctcctcctctttttgacagtaccctctgataccccataagtaccaggctttataccttggtaccaaggtttgatacctaggtatcacctggtaccttaggtactgggcatcaggtatcggtcgatacctagtcggtaccaaaggtaccaggtaccaggtacgaaccggtacctaaggtaccaggtactaggggagcacacgtccctcaccttgccgtgcctcctcgacgccatcctccgccgttgcggcgctccctcccccacgtctcctcctcttttttgatggtaccctttgataccccacaagtatcaggcttgataccttggtaccaaggtctgatacctaggtaccacctggtaccttgggtaccgggcatcaggtatcggtcgatacctagtcgataccaaaggtactagttaccagataccgaccggtacctaaggtaccaggtatcaggtaccaggtactaggggagcacacgtggacagaggaaacgaaaagggagagtcagttaaaatatcccgttgcaacggtatcccgttgtgtagctgccctcatatttacctataaacatatactacactagtaatacttgatcccaactgtcatacatacattttgtcttatggtctgtgctgtagctcgctacaaatctgtagaccgctgctcttttctatcatcatttatcttcttgatatgtatttataggtggcttatagcctgctattgtacttgtcttatataagtttaagcaccaaaaccaaagacaatttaaatcacatcaatcaagacaacatgcacacattctcccacaatgcatgcattgattaaaaccccataccaattacaccctagcattgtcgcgcccagggattcgacaacccgaatcaccggctatctgtggatttaacctctgtctaggcatcaaccagagtacatagatgacaatttgacacagatccacgtcttacaaaaataacacaataaaacccatatgcagcggaaaaactagagaactaaacttaatcttcacagcaacgcgaagcttcctccataactccataggcaaactcttgatggctggcacaagcctaatcttcatagaactcaccatctgaaccaacttctgcttctgggagattgggaaaaagaagcaagactgagtacaaccaccataatcaacaagtcataccaaggggaaggtatgatgcaagggtaatcaaaggattggctcaaaggatattttgcagtaaaaacagcatttgtaaattataagttgaaagcaataaaacagtatataattaagtagtattaaccatcatcgcagtacaacgctaaatccacgttgaaataggcccaacccaaaaccacccgaactacaccagttcattaagacaaattattaaggtgagactaatcacgatgagctggttgaccgcccaataaccgtaggcgtggctattcaaatagttttactctgatcagaggtgcacaactttacccacaagacacgattccacacatgaaaccatgccccgaagtactgccacgatactgcaaagggggaaatcgtgacaaaccctccatataaccacccctaaccaagcacacccacctctggtttcggtcccactccaaaatccagcagcccccgctcatgtctggtaaatccggctgcagcatagaccgcctcccggtccatccatactccatcacgcttacccttgccaatggtgtgctagctagaaaagattatatttaagattcagcctggagcccatctggcttgtggttagtacgagtacatcttccagggattcccgagaaccggtccttaattgtcatgggcacgaccaccaaataaaatcatgcatgtgcccacgacccaccaagtaaatcatattttaattaattaaccatatgccaaggtggcataacatcatcataaaattaaggactatattatagtgaatcccaaagtgagctagttgatctaagcatgactaagcaatcctagaccaatcatctagtcaaattattaacctaggctatcaatgaatcaggataaacaaaggctgagtatgggtagaaaccatcccacatgacattataaaagtaatgcaattttgagagaaaagcaggggttttgcaaataggctcaatatgatgaatgatatatgtatgacttgccttgctcttcagctgacgggacctcggcgaccacttcaaaataaactggagcgtcggaactgccggagtctaaacgacaaacaaggcacacaataaatacaagctaaaaagctactgaaacatcaaaagaaaccaattttaatggattcttgacattttaacgaatttactgcaatttgaatgggttaaaacaaagctctgattattaagttatgaattttacaagatgctctgtgttatttactattgacagaaacttaatcaattgataggaattagagcccaaaaggaacataggatcaaaggataggttgactagcaagcaaacctcacgagataccgactcaacgagtcaatttaacgtgacacgggatcaccgaaatgatcgaccgaaactggcgaacggaaccggccgctctaaacgactctaacctaaagaacgaatcgggttggacaaacgaacaaaccatgggggaacacctcgttcgaacgaacgagcggacgactcaacaacggctgtggctaaaccggtgggctagacatgattcacggtaaagccccggtacagcaaacgataggccagtaggaacctagggttgcacctatggctagacaactcgactaccaagctatgggacaaaaacaacggctaggattaagcggcacacggctgcgacacagcggcgcaaagcggcggctcggctcggcagtggcggcggcatggcatagcacggctcggcggcggcgggacgacccgacggtggcggtgcaaggtggcggcacggcaacgacacggcgacgacttgactaaactacgacacatgaaaagaaaaccctaaaaacaggagagatttctcatcggggagcaaaaaccagggagagatgacaacagcagcggcggcggttccggtggcaacacccgggatcaacgacaacgctagaaggagacaaaaaggggaaaaacttaggttgctagattgatgattgtaggagcaaatacatcaaagaaactgggagacgaggtactggcggcactcggtggcgacgttgatggtaacgacgacggcggcggtgcagggcagcggcggcggcggggtgcaggggggggctaaagctaggactcggaaaaatacaaaagactggagaaggaacacttacaaaggggagtactcgattaggaaaggaggagtcctagcgggagtagtactaggagggagggagagggaggcgcggccagctggggaaaggagaagggagagaggaaactaggggagactaggactttcccaaaaaggaaaaacaatgtggtgctgttttaggaaaggaacggaaacagtcccgcgaactgacacgaatatggttcaccatgcaaaacgaaactgcggactgagaggggagtgaattgggcacaattcacgaccaaaggcaaaggaagaagattaacttgacacttttaactttgcagcattgcctctggtgatctgatgtttactctctacgtcctgttagtgattttcagagcaaagagaattcgataaaaatattctccctgacaagtccgagtattaaatgcattgttaactggggttttctcctggttaaccaaagcaaatccttgatgccatttattagtgatttgaaacctaagggaagggaaaactccgggtgtgacaagcatgcacatattctcctatactacattaattatatttcgatgaaatccgtatccatgcagttatatgatgatcaatttgaaaaattctggactctattacatgatgttcaatttgggaaggaggaaatacctttttacatgccctaagtacaataatataagtggtctctggggcgatgaacattacaagttatgacaggacataaatgttggtggagttttcttaatctggtgagagcaactggaaggtatgactgcactacatcacccatatatattggggataactagggatcggtcgccccatccaaatcttcaaaaatcgggcgctgacgttatgctgacgtcaacgcccgatttatatgcaaaacaaattcaaactgatttttctcttaaattatttatccaaatcattatccgattgcaccattaaattcgttgcaattaaatcttcaaaacaagactacacatggatatattccgacaaaaatttttttagcttattattgattttttttcatgttgcacgatgttccaccaagtatatcggaattgtttcactgagtagatcgaaaatgtttcactcgtttaaatcgggtgttgtttcaccttatataaaaacattgtttcagcaaatagcgaaagaatatttcagttcactgcaacatttgatccatgcatagtgaaatattacgagtatactagatgaaacatttttcgatggaataaaaaataaaacgaattcacttaatagagggtttccaaaatatgtgggtttttttttgttgcaatggagtatctcaaaatcactgcaacattagatctataaatagtgaaacattgtacattaggtgaaatattttttgtggaacaaaaaataaacgaattctcttaatagggggtttccaaaatacgtgggtttttttgttgtaatggcgcgttccataatataaaaatccactacagcatttgatccatacatagtgaaacatcacgagtacactagctgaaacatcgtaaaactactggttggaaacattaaaagagaccatatgcaacattcaaaaaaatatcaataaaaaagctaaaaattttttttgtcgaaatataatcatgtgtggtcttgttgtaaagatttaattgtaacgaatttagtggtgcaatcggatcgtgaattagataaatagtttatgattaaaaaatcttttgaagaaatgagagatggaagcatgtagggaaagattctttgtatgcaaatggcagaccatgcagcgtctgatttttcttccctcccatcagacgcccgacaactagcattctccatatatattggcggttcacctagatcagacatttatgacagaaaaccttgatgtccaaaaaaactggtcaggcaccatctagactccgggtgaaacctctccatgggttggcctggtgctgcatcacccctagacggctagacctcggcagtggaacaaaccaatggttaggccattttggtggggagccgagatagctgtagtggactggatggtacgctactcgaaatagttctatgtgatgttacttttgcagttattgataatatattataaaaagaaattaacgatgaaagttttgaagaccgtgtaaaaaatcttagactttggacagagggagtaaaaggtttttttttttattgtgagctttatagacgaagcagaaaaaagattgttactaggatgacggcctcatcagattgttcggcttcatcgacgttattccacgattagcaatagcatcagcttcctttcttcagcaggtctcaagattaccataggcccaccgtatcacagacgaaatgatgtgaaaatcgactgttatatatagggcggggttgagaggagtttatttctgaaaaacatgtcatttctcactacccacagataccaactaataacagttgcaagcaacatgaacttgacattgtttttcctttgaccagatctctcaagttttttgtggaataagatcccaacctgaaccatctctacaaagtcaccagataacttaagaaatcagacagtgtacaaaatatgttgggtatattttgaatttgtacacataattaaaggacaagagccacctggatttatattgatgttggacagcagattgcattttgtctctgcgaacaaaatatagaaagtgttggtaataacagggttgtaagttcttctattatttaatatatccaccctgttccgcaaaagaaaaataaacaaatataagaggtgttctatttttcacagggatggaggcagcccaaatatcagaaatgaaataaaattgaaaggaaatataggagaaaaatggctggcttgagaaaagccaataaaacggaagtataattatattgttcatgtttgtgccacgagagacaatatgccgtaaatgttgtgtacagataacagatagccaggtctaatattaatgaggatgccataatcaagccgatgtgtccagactatacatcatttttgtgcccaagacaaatacgcaacacatattcgtgtccagactatacatcatttttgtccagagtatacaaatacgtaagcagcataattgcttaaagcaacaaacctgattaattattattgattaaagactggacatatttgtgtccaatcatacatttatcatttttttgtttttgcttgtttcacgaggatttggatgtggtgagcattatatgtacgctgatatgtactttcagaacttctgcagatatgtacgcggccatttaaaaagtacatggtgtcagggtatagcacgtatatttcagttggcacaatgcatatatacgattagatcaacagctagcaacggttttgtatcactaccagaaactccattagccctgacgggccaaaatttttctgacgtgtatctattaggctgtcaggagtaaacaatttttttctgacgtgctttcggtaccgtcacgatatcatgaatttcgctggcgtggtttgcctgtcagaaaaaaattttaggttcagatggttctcctacagagaccacatacgttttcatacataaagactgaccggcctggttataagaaactatagcatatattattattattattattattattattattcaacatgcatcctatgatgcaagacctatgatgcacacaaccattacatgattaaatcaccaaatgcaaagcatgcacttactacaaggaaagttctgaaaggccgaaaaaaggcatgataaagaaatgaaatttgccaatgctttggctgatctgcaaaaagaaaagccatagtgccaccaccaagactatcagtacatcagccatatatacaaactcaaataaactctactacgcaatcaactttcgcggacgagcccccgtccaaccttcaagtggaccgcatatcgtccgcctgtgataatagtgatcccaaagaaaaaataagacccatatgaaaaatcaatttttacagatgggcctattaagagacccatattcctccagcccactagtctggccccctcccttcttccttaaaatatctaagtcgtatcctcgcccctctctcctcatcctctccgccgcaccacctctactccactttttttttgagcaaaacctctcctccacttcaactacttctcctctcctctcacttcggaaggtggtggtaggctctcttgcagccaaggtggcacgtgtcgacgacgggcagtggtgatgaccaatgcgacagcggcggcaggaagagtccgctggatccaccggcagcaacgagggaaggtgcagatttggcaggctctttccctcccgcgtggatcacgccgcctcccctcccctctgcatggatccagaggtgcacttgatggcgacgagggggaatgatgactacaacaacgatgagtggagggtagatccgacgggctctcccccttccacgaggatctcgccacctcccctcccccacgcatggttctggtgatgcgctcgacgatcggttggggtaacgacgattccagtggcagcggggagagcccgccggatctgccggaaatagaggatccgtcatgctcttccccctctcgcatggatttttccacctgctatcc

SEQ ID NO: 65964 - DNA, 611 bp, Oryza sativa
atgacaattaatatcaaatggagggagtatatgtcacaggcatcacataaaccgtggtcgtaggagaatcggatgtcgtggttgtgtgcatagaatttttcttcttttccaattgatgaggatcggatcccttaattaggcagaacaatccgcgtgtcaaaagcttttgacgagtattggcatgcaagccacgtccattcgaattcatccgggcccacatgtcatttagggtgcgtttggttggtgaaaagaaaatttttagatgcctcattggacgtttgatcggatgtcggaaaatgttttcagacacgaatgaaaaaactaatttcataacttgtctagaaaccgcgagacaaatttattaagcctaattaatccaccagtagcacacgtgagttactgtaacacttatggctaatcatgactaattaggtttaaaagattcgtctcgtgatttccatgcaaactgtgcaattagttttcgttttatctatagttaatgctacatgtatgtgtccaaagattcaatgtgatattttttgaaaaaaaaggggaactaaacaaggccttacttagcttcccaaggtaaagcagcttgtgcgctactccct

SEQ ID NO: 65965 - DNA, 1278 bp, Oryza sativa
ccgtggaccgcccctttcgcttcccccttccctcatctctctcgggtgccgctccgccgcgccgttggtcgccggcggcgaccatcggggcgcgggtgcgccgcctcctgtcggccgtgccggagaggccgccttcgggcgcgccccgcggctgccaggtgggcccggccgtcagccgcccgcgcccgcgggtgcggctgacgcgtgggacccacggcgccgaccggcgccagccgcgtgcacccggtccaccgtggaccgttcggctgacgcaataaatccgatttttaattaaaatttaaatgaagaaattcgcaaatatccatttaaagagcatataaacttcaaatggccataacttggccatttgaactcggaattggaccgttcaagtctctaatttttccttataaagccaagaacccatttttgtgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccctatgattgttattgttattattaccttgttcaccctagaataaacaaaacctcaactagtggacactctactcatggcatcactagtttaattttaggtagatgcttcgcaatttaattaggtaacattaggtggtttttcaattttagactttgggaaatattcatatcacctggatactctggaatggtctggttattgtggaattggcttcacaccgctccctcttttcaaaacccccaaaatggttttaggctgggctcggggtgcatggttttgatagtagcacctcggccatataaggaccggtcttcgggcctctgttgcaaagcactaccgtacttccacatgtctagtgggtaaggcttagtttatggctcagtctggttataaacaaaagtacacagattggagatggatgaagtcgggggtcgatggacattctccagggcaaatgaaggctacacgagctgcggcccggtagtcgagatgtcatggcacagggccggtgtcctgttgctgggggctcattcctgcctgcctatcccgggggttccggccgtaggtgggat

SEQ ID NO: 65966 - DNA, 1281 bp, Oryza sativa
aacagtggagctatcaaggaacttatgtaaaagaagtggtccagcagaaaggcttgtaataactaccatgaagattctttaacgaaaaaaagtcagcaaagggcaccctagcaaaaatcttacaatgtggatattagatggatggttcaaagactcatttgaagtggtagatgcccgtgaattagaatcttttttactttctccattatctgcacttgagctatccacaggtactgctaatagagaaatatcatccaatttcggtaatgcatccggtgcgtcggtctctagcagaattctgtctaagggcatctaaaataagtacaaatgtagacaattagtaaatccctctgagatggcatctaaaagtacagaataaaattacttactgattttagcattttctttgccttcgtggatttcatgcctgtaaggaagccggacaacgaaaagtaacagcctaaaatttcaaggctggacaccatttctgcagatcctagatacgaatgcagcaacacaccagctgggaaaggtccagttctcctgcaagcaacaaaaatgtaggaatcaatacttattggagaaaaacaatcagaagttacatgctatttgtgctagcagttaggtaatctggaccgtatacttcagattggcatttgttgtctaagacaggcaggattctcaaggttttggttatctagtcaataaatgtatccgaactatgttaggaactggtggataccatactataaataatctactaagaatttcaacttaaacatactttgagaacaaatctccatgtcttactttagtatctccagaagatcaccaaaggcgcgcacacaatgaacagaaacaggcttgttcaactccttagcaagttcaagttgctgctggaaaacttcaacctgcagtgatattttttagcttctgatagtcttattggtggcataaagcttgctcatgatgcaaaaggacttgaggcataggttatatggcctagtgatttacacatgttggaacatttggaaggagcagagtaggtgagcttttcaagatcagtgtcttcagccacaacaaatcatttacaagatcgaagaggatattgagcaacaggagagagattttctagcttagcttgcatgagttttatcgcttttgtgttactcccttcttccttgctccttttaaacttctatcctcctttaatgtaataggcaaagctcttggcctttcttttaagaaaaaaatagtcttatgggcataaaggggcgccca

SEQ ID NO: 65967 - DNA, 1566 bp, Oryza sativa
gagggcatgcacacgtagaggacgacgaggcgaacccaacggtactcaccacaacgacaatcgacgtccgacgacggccggcgacgagaggaggcggcggcggcttggaccttaccgacgacggcgagctacggcggccggcggcgaagaaggacgggcggccgggcttctccaccccttggcgcacctcttggcgacggcggcaagcggcggcgacggcagaagcggcgcggcggcgcggctgcactcggccggcggcggcgacgaactaaacgcgcgcggcgacgaggctacgaggcactagagagctcgggagagggggcaaacgaaagaggaggactagggggtcctatttatagccttggaagctcgggtccgggcccaaaacgacgggaaaaactcgggaaagtttatcttcgccggaaaaaggaaaggatttgatccgcgaaattggaaaggatttccatataaaattttggggatttcttggggaaaaggaagaggagaataagaggaatatttcccctcaactaatttggaaggaggagcaatgaggaggtccggatttggtggaagaaggcggcactgtgcacaggctcggctggctcgggatctgtccagagctgtaagatgaacagtgccagggaggcaaactagacttttttcggttggatgagaacagaacagagcacttgaattggagtaggcttgggctgtacagtatgcgcgcaagggagagagaagaggaaggaatgggctgaaaatggcccaagtggaggaggaggatttttattaatttcccgattaaaataatcagttaaatgatctttgaattattaaaaatacttccaatgctcaaataatttcaagaagaatcatgaaaatacttggacactcaaagtacttaacaaaattacaattagaccatttaatgattaatttaatatgtggttaattactgaaatgctcttgtatgattaaaaattaggaattgagctccgaaaaatccgagaaaactccagagagtataattaaccatggagaatttaataaaaattaaatccatccatgctttatatttaggaaattttatttcccacatttaacttcactagtaaattaatgaacgtttaatataaattctattaataatttattaaataatttataaatcctgaaacgaaaatcaggatgtgacaaatctaccccccttacaaagaatctcatcccgagattcggaacggctagaaagaaaaaggcataggtaaactacagtctatcttttattccacaactccaataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgc

SEQ ID NO: 65968 - DNA, 8465 bp, Oryza sativa
tcacgtgcattttaggccaaaacactaatacatacctttgattaatcctggtattataagctttgctacatcgttggctcatggattcattttagtgtttcaccatgttcataacccgagataatgaatatgttgattagtcatgcacttacttttgataatcatatatttttcggttttaaattgacggattattttattattataactaatcaattgaaagcaatatataatacatgtagatccttttcgagatggtctgagtggcggtttttttatatggcataaaaagtatggtgtggaatatagatcttttaaccaaaatgcacgcactagccaagttgttgcacctatatgctcatttctcaagtttttgcactagattgcaccaacctaccaagtttatgtaccgtagacgcaatttactctatatttcactcaattcagaaacagccttctttacattacacaggggcagcaggacatgattcagttgattaggatgtccagaagaacaacgtatcctagtgatgatgaaacaagatgaacaataaaatacttgtagagaattaatactaatattagagaagtggtacttgcactaggtaggccttagtttgtgctttgaggaaaggaactacagattattaccaaagttctattgctggataattcaatgtacaatttaaaagcgtaaaaaattgccgaataaagtacacctccccaacagccgcctctggtgtttcagcgaagaaccgccggagcgaatccatccaatccggcgatctctccggtacccacctatcaaattcacggaattaagaaccagagagcatagaggtcacggcagcgggagaggcatccagggaatcttgccatgggtggaggccgaagcaggggacgacggacgggtactcctcggccatctgcttcaccaggtgccagtctttctgcgcgcttatccagtagacaagagtcagcgaggagagattccccccgtgttctcgcacgaggtaggcgcgggagcatacctcggaagtgccgttgacggcgaagcgcgcgacgccggcggcggtggcggcgcgtatgagggaaggggcgacggacagcacacgcgggtcctgcaggtggcagtgcgcgtcgaagagccgcacgacggaagcggcgcgcgctggtgcctgggccatatccggcgaccccgcggtggccggaagcggaagtgctcaacggcgcttctagcggtgtgccggtgaccgccgccgcccgagcaagaggggaatcacggccttgtgggccgggatttatcgtgggcccagagaagccgaaatatgtcgttgggctgttcacggaacgcgctagccgcgccatgtgttctgggcttatcggcccagtaacactgggacgcgcgggctgttgcgagcagcccagtcaaattcaccgtggctgtcgaattcacttggctcctgcgcaggtgctcacgacctcgttcgtcgttagtcctagtgggagcgtggccgcgtgagatcatcggaataccacttcgaagaccgagaaaaagccaaagacctactacagaacactgtacaccccagcgaggcagcgatgcagccaacacactacacatggatgcactctgcaattcacggaacgagacagactgatgcatcacctacatagatccgttcttgctgttccgttcctgtacgggcacaatcaagttcaaggaaacggagttagaacatcacatcagcagccgaagataatcatgcaggatcaacagtgctaacccgctatcagtactggcttagctgtctcggaataattgtgcatttgtgcacacgacctcaggctaatgttccctgtgcggtctggccaaatctgataatccctctcatttaccatgacctgctctcagccactcactttgcttatcctcttccggccttaactcttcagccttcactctccgtcagggagcaaacagggagaaatccaggcagcaagtaacgtgaaatatccagagttactcccccacgaaaatatgtcaactgtgtgtgccctgcatcgtagaatagtggtcttacatagtgcagttcccctcaaaagaatgatgccttccaaaagcgacgtgtcccacaagcacatgcgcagtcctatcaggatctggggcgtgtggcctccaaggttagttactaacgcagcagctatgattaactcacgtttactgcataccccgggactggaaaggaaaaggaaaacaagctcccatcacagatacagcatgcttgattttagctttatcatatcatgcatctacagattgccaggtacatgagaagtgcccgggacccgaagatatccagcggaaagcgtggccgacctcactccaaacttccaaagcctccaagttaggacaagctatcgccccaatgtttgcggcgccaccgctcgcccaaaaatctccgtttctcagggctgtagcagtgcaagaacctcatttgagttatctcatataccacataggacaaatgcatattaaatccatttctctcacggtgcaaaatgctttgacaagaactccaacccaacattactttcaccgggacctgtgttgttacttcctttttttaactgctctgcacctgcatgcgtttgttttagctttttgaagtgagttcctcgcatcttagtgaagggacgagggcccacacttagggaagggacgagggtccacaccttttttcctccacgctatcacgcagcttatgtggacgcatgaagcaacgctcaactcctgtgcacggctggtggcggtagtaatggaccatctcaaagctccaccgcgtcggcgtgtatcctgtgattgcacatgcgggcgggcacgccataagtattcgcagggggtggttcccatgtagctgtccaacgatctcgtcgaaggatacagttcgctggccagcttaatgggtacaaatacataatccgtagcttatcggccttaccctgttcaccgcagcatttgctaactaaacggcattcgtcggagttccatcaagaaccagagtacagccaaagaggttagcgacgaatataatacagcaagcacgaatgatccggtttgacgcaagattaatggtgttggggtttttcagatgaagcccgtgattacaaagtcaataatggggtcatacattgtatccttttttcttttcttttcttgtctaatgaagtagagtgcaaacggaaaggaacggtgttgcatgtcacgtcacgaacggatgggtacacggtacatatgctacagttacacgcgctacacaggtgagaccaagcgacgccccgcccgccactagctagctttcgtcgggtccctttatataactcacgagccacatgccaacgggtcgcctcgcctccgtccaagacacttgtgagttgtgagccgcgcgcgcgacacgacacaagtcacaagtggagcgcgtgcgaggatgagccccagcgccgcggccaagatgcggctcggcggcggcggcggcggtggcggtttcatgctcgggtgcggctgcagggatgccaaggctgtggcagtggcggtgtccgccacgtcgccgtgttccgccgccacggagacgtccacggccaccacggcgacctggcgcagggcccggacgcacccgtcggcgtcggcgtcggcgtcgacgggcacgctgaccgtgccgtccgcctcgtcgtccttcctgtgggacgatgccgacgctgaggccgacggcgaagaggtcgacttcaagcgggagagctctgcgaccacgccgagcttctccggccttctgcggcagctgaacgagctcgagcagagcgtcatgacgtgggggtggaagagccctcgccgcggtaatcacttctcgccaccgccgccgcctcctccgccaccgccgttacctttacggccagtcgtcctgcaccgagctgtggacgccggcgggaagcgcagcaacaaagaagacgatgccaagttctcttcgccaccgccgtttttccattgcccgacgacccagctgcaccggaaggtgaagagcgttgaccaacgaaacagagaagatgatgaagcccacttcgcgccaccggcacctccgccattgcccttgccgccgcagcagctgcggaacgtgaagggcgtggacaaaggcggcagcaaagaagacagcaagcactgtccgccaccaccgcaagcgccgaagcaccggaaaacgaagagctgcgacaacaacgacggcttcaccgccggaaagctcgacgggagcttggcggtggtgaaacagtccgaggacccacgcggcgacttccggcggtcgatgctgaacatgatcgtggagaaccgcatcgtgaccggcgacgagctccgggagctgctccaccgcttcctcgagctgaacgcgccgcaccaccacgacgccatcctccgggccttcgccgagatctgggacgaggtgttcgccgggccggacgagccccgtcacggtcccccgaggccgccgccccggcagagaacgccacctcgccgccggcaccctctaccggcttggcgcctgtagtaaccccacacatggatacttaccgcgtagtatgtacaatgtagattactgtactaggttgcgtccaagaaattctcggcctcatctgatcacgtatctaccggaattgtttctgtcaccagattcacctctcgtgcatttagtacagtactacctagtggtcgtacttggtacgtgcaactctcccattttgttaccgtctgtctcctgatttaccaacctattatagtctccgcccatgttctcactcggaaaaagaaactactagtagccgccatggacgcgcgcgacacgggaggtttcacagtaaaaaaccgggtgcgatggtgcaagtggatgcagggcgctttcggccggggttggaattggatggatggatacaatacaaatggaggggagggccccgtgccgtgcatcgagtgggcgcgctcgcggtggacggtggtgcggtggcgatcgagcgaggcggtgggcgcaggtgatggacggacgcacgggagtggaaggggggagacgcgagcctactaatgatggtctagtgcgatgccaaaaactgcggcgacacgctccatcaatgcgcaacctctctctgggggggtcctttcctctttgcttcccttcctggaaggaaagaaacgtccgagcctcaatgcatccaccgcaattcttctgtccaatcctttttggaaattcttcccatgtcctctaattaagttgatctccattgacaagtagccaggactatagtctacagttgcgtttcttgatgcaatgctgtgcagttgcctcggccaaaattgaaggtacgggacatccaggctcatcaggtgcctgctgaagccaaacgcattcaaataagttagctgcagcatgcagtgtttcatgtattgccctctgcggctgtgcctgctctcaatttcgggtaaatagctaggtcgactgttttaatgcgtctcagagcaaccacccatggctgcaaaactgaactgcaacggagtagagagccttgttgttttgtcatgtggaagtggtcggtacggaagaagaaaaatgacaaactcgcccaactggcccaaggctgggccatttcgttttgggccgggagagtaggggacgcctaatttctcgtacaatcaacatcgtcgtgttcggctccgtcccccttggcccgcctagctacgcgccaccgccgatgatacacgtacgagctagtggcctagtacttctctagtactctccaagttgcgctgctccggtggccggtgcaggtaggcgaggacgctgaccagtaggaccaagcaaagcaagcaagcaacgcgatcaattcattcgttgctgccatgatgagttccgtctcagtcgttagtcgtcattaatgtcatgggaaaatgctggccgatgggtcacgcgaaatgcagtctgctgcgctgccgctgctgcgtgaaaacctgccagatgccagtgtgcaacagcgtgaactactgaactcggcccgatgctgaaattgtttaccgcgtaataagcccgagatttaggtagtcttagatcattgatgcatcagaatctacacgctgataactactactcttacatgaggggatggcggtttcaaaatctgtacaatgtgccgactgcctaggcaagtacaggccgagaacttaacatgttcaacgtcagacatatttagtccagtccaggagcaacattttcaatcagcacagtgatggctgaaagcttgctcaagcttatcgttggcaagacatggacaacactaaatgatgttgtgactaaaacagaggaagaaacaccgacgatcggttcaaaattttacatttaataaagacagccttcaatgaaggttcagctagtacaaaattcttcgactgccaaatcgaatttgttcacaccttgtcttgcatataagcagaataaaagacacccaaggcaccaagcgaaagaactagaagaagaccagagggcaccagtttccgggtattgtacagccttatacctgaaagagaaggaatatgttttaacttcccaacatcacaattcaacttcatggaaatggaacacaagagagtgaaatgtaccaaaaacactggcaaacagaaaggcagatccaaatccaacagcgtcacctaacgcctttgtttcaggtgattgcatcagataataagcctgcggtaaggataaaattacgcatatgttacaaataatcttgacaaaacaattcaatgtttaactgtacaaagataaaattactagacaaacagtcagtttcttagcatgagaaatcattatgcttccactagaaaaggagaaacaatgtacttattgatgagattctctaagagattcaaaggggtgccactgacttaagatcagccaaaggaactgaataacagtacctgcaagcatgtatgatgaatatagactttataccaaccagggttccttcgaagataacaaaactaatcaaaccaaaaggtaatgacgatatataatatattgtataccttcttgaatcatcacaaaaataatttattacaccttctcagcttttcataaacgatctcagtaattcataatttgaggactttcaagtctaagttgtgtttagcactatgttatgacaggaacaaattatgaaacttcgttaagaatctgattcaacatcctagttgaatttagtggtgccaagaaaagaatgatgaatagtagttattatgctaaaaagattccagattcaccaccttaattccacaagcatcacaatcctgaattacaattggaattttgaattgaaaacgtatttccacatgattcctgattaatagtcaccagtaataagttcattctgaaattgacaagcaccagcattatcaaagagaaaaaaaatgggaagatcgaataaggactccccattttgcaacaaaatttataactttctgttgttctatttatacataaacccacaaataccagtagtaatatgcatgaagattcacaagcacttcctaaaactctggatacttgtttagttgttttgttactcctgttggtcatgtttcttgtaccagtaagctgattcaaaacaactggttggactaagatttgaaggttgtttcctgcacctagcaaattgtgtccctttccatcttctgttccaactacaagtagtacaccaaaaattccagacatatttgctgtaagttcttccaatgttccgagttctaacttacaagaatcctattctgtccccccaacagcccaataaaactctgcaattttggggaaacatgtgtgtagagttgtgaatgcatgactttagttttccctcaccgacccgaaagttatactttgttaaaaaaaatagcagtttggtctaagcataattgctacagccgtgtaatcaattgtatatcaagaatcataacaaaagaaattcccttaagcatttgatatctaacctgaaagctaggctgctctaaagtgtaaacaaacacaaaagggaaattcagaaaatgtaggaaatatacgccgtccactcacaatgcccataagcgcggatccggacagtcctccaaagatggagcctttactccccgacctcacatctacacaccagaaagagactcatggtcagtacgcagcacatcaggaaaggaatcacgacagctccaaatggcgcacatgcaaaggcgccgccgcccaggaggagggcgccgtaggcggctgatgcggtgggcgcgagctcggacaccgcggaacaccggaggagggcacgacgccggctgcggccgggacgggccacagcactgggacgaggtggcgagggaagggaacggatggcggcggcagggtggtgga

SEQ ID NO: 65969 - DNA, 7419 bp, Oryza sativa
tcggtctgaatcatcgtaggccttgggttaaggtaggtttgtgtgggttcacggccttgataaataatattgtatagttctagaatcgtgtttaccaaatagctttgagcaactaaatatctttaaatgctgtttaccgcaaccctaaccctttatattgtaactcctttgttctcccttgcatttattatgcacttgtgggtgtgtcttgttgagtacggtggttgtactcagtcttgctcaatttttcctaacccagaagaggatccccttgaagatgaaggctttggtgtctagctcgtgcctgccgtcaagcgcctgtggtggtcgccctagtcttccgttgcttctcgtttgtctttgtgtgtgctgggccttcgtcgcccatgtaataaattaactatttacgcttccgcttgttaaactctgaattgtatcaacctttggtgtaccttgcctcctgggacaaggattaatgcacgcacatcaggaacgcccgttgggttatttccggtcgtgacaatggggaccgtatcgatggtattccggccttctctcctccggcaacttgaaggtgacgtgttgtttagggaagccatgagtggtgatggcacacttcgctgcttccctcccctcccctctctggccacaccccgcacaaccctacctcgctgtcacaccctcccctcactaagggaacgggttagggacaagggtagctatgaaggaggttaaaatgcacatttgttgaaacggtgggtcagctagggaggtggccaaagttggtttggatcatgagtgctacattgaaccaagattatgaatctaaatttacgatttacaatatcaccaacataaatgacatcactgtccgtgtttaagaaccgtccatgtttttttttctgttttttagattaaatttcacaaaacttttaaatgtcgtatgaaaactatcaatttgcaagaataagtactggagggaaattctgtgttggttccaacctggatattgcctaatttggaaccggtactacgttagtgctactaaggcctagtttttttcgacttcctcattttccgttagcacacttttgaaactattaaatggtatgtttcttgcaaatagtttctacataaaagttgtttaaaaaataaaataaatttatttttcaagtttataataattaatatttaattaatcatgtgctaatgatctttcttgtttctcgtgcggtaaacgcgagaacattgataaatataaccacaatgaatagatcaagaagtaatgcatcggatcaactgtaattatcatcaaaactcaaggcaatgacattatttcctcacaaaacggatctagaagaaaagaccgacgagagcggatgtagatgtgggtgatgcaagtgagccaccccggcactgctgaagaggagggagccaccactgtatcggtgaaggggaaaaggccatgttgttgaatggggaaacaaaccgtggccatggttgggtcgggggagagaaccgccacagtcaaacagggtacactggctagatccggtcacccccaagctcattgcaaccagatctgactactcacgacctcttggtggctagatctggcagtccctaagctctagattgcttccacaacatgggagtggataggaggtgccaccaaagttgatatcgcgatgaggatgtggggggtggtgaggatgatggccggcggagccacaatggtaggagggggactagtggttgttgactgtcgttaagtaccaaattcgaacgtcaattaccttaataaatagaagagaactagcatttcttatgcgcatattagttacaaataatgtagttccacttatccttggagaatacattgaatgcagggattatacaataaagtgtaggagaatatgtgccagcatgcaacacctccggtgaatcacgtgaaagcacatggactgaagggcccaaaagcgagaccaaaccaacatattttgggtgaacccaacgtgcaccatcataaggacccatgatgaggacacaactagctcggatataaccatgactaccctatgtattaatcaaccaaagatgcatatgttctacattagatttacttgttatatatttgaacaaacgttactacataatgagttttgtgtgtttgtttgcagaggtacttgcttggacgaaggaaaagaggccgagcataacgaatgcttggatgatcaaagaagttgattgaggaccaaaccaagaccttctccatgtcttttgtatctcaccacgtcacttttggtccatagaagacaagagataaagttctacacgttttggattcggattcgggcctcctgatagcatcaacttcaaacggacctagccgctgatctagaaagaatttcgaggcccatgagtacttgttggaaagcttatgtagctgactttcagatggttttattactacatcaaaattcctactgagtttccaggaatctgaaaaacaagccacgtatctcatccagtccgaatctgatttgggtttgggccttgtaattgtgtcgtgggcttagcccatcagggtgtgcaccctagggcaaccataggatgtccctaataatacttaaccaatagccgtcatcgcttagagtcgggttttgcttagattactctgtcaagaacagtttcgctgctagatcggtttgtggaacccaaattcgagtgcttaatcattcataagcaatttggttgcaatctatcttgttcttgcatgtgttcttcgattcgcatgcagggattagccttctcggcgaggtcaaccgggtttcagcacggttgataaccagaggagacgtggtgctgcaattgcggggcttagtagcgtgttcgtttataagccggatcgagttgtgtcgcgactctgcccaaatcgtctgtttatcaatacctatcggaagatcggaacctagcatccctcatcagttggtatcaaagcgtggttgcccgttaggtaagttatcttcccataaccagaaaattgccacacaaaaatatttattctttacctagacaatttgagccgttgcgttgttctattagattttgctttgttgaattctggattgcatcatcgtgtcgagtgctggtttagttttagatttcatttttagttttgagtattgcatctgttcatcacttaggtctaggactcatcactcaagtctgtgagttgtacgtcagttttgaatttagtttttcatcccgtcggttgttgccgggaccttgaagaattgaatcgtctcgatggttggtttccgttttcgtagtttggagaagttaatatccaacggttttggagttgctcgatttttagagttactgtgttggggagttagtgcgcatgtgaggggagaggacgagccccaactcttccgtaagtagtttctctccatcgagtattgaaagtgttaaagttccagatttgagagatatttttgtaaaaacggaacctacatgatacattccatttttgaggagatctaatttagttttacactttgcatttgagtccctgtaattttcatatttacatttgagtccctattcgaggccagcgatcagtttttgttaaaaaatagtaaaaaataaaaaagaaagaaaaggcagaaaggtgcaaagaaaaagaaagaaaaagttgcacctaaaaaaagaaaaaaaaaagggcagaaaaggtgcttaaaaaacccgcaccaagaaagaaaaaaaaatcattcattctttgagtatgttttcataatgcagagttgtgcattgattcatatctagtccttagtgttgtcaggtgcttgcttgagctagagttgagtctaggctaggccagcacattgactagtacttttaactattattcaactttgcattttctgattagcacaattgcgttcctttgctaatatatatcatgcctcccaagctgcacgtatatacttctggtcagcatcgctttgatccttgcaatcgccacatcacgtccttcaaggtgacatgaactagccaccggttgtaccgtccttagcattgctgataagacacttgtaagagcttgataaggtgctccatttgcctaagttgttgagaggcaccactacaccgtgtagcagagtttttatgtttgcaatgataggtatgagtggcgctcaaaatcagcgataccaacaaggtgacataatcgtgtgcccgaagatccttatgctaaggttaagtttaaaataccatctttttcaggttattatgatgctgagaaatattttgattgggagatgatagtagagaaaaaaattagtacccaccttgtgcccgagcaacatagagttcgacaagctactagtgagtttaaagagtttgcttatatttggtggactaggttagatgtatggagacctttacctactactaggaaagaacttaatgtagctatgcgtgatacatttgttcctccatcttatcttagagatttaaacaagaaactgaagcgtttagaacaaggggataaatctgtacatgattactatggtgagctacaaaagggattgaagcgatgtagcgatggagcgattgcaatctatcttgttcttgcttgtgttcttcgattcgcatgcagggattagccttctcggcgaggtcaaccgggtttctgcacggttgataactagaggagacgtggtgcttcgattgcggggctcagtagcgtgttcgttcagaagccggatcgagttgtgtcacgactccgcccaaattgactgtttatcaatacctatcggaagatcgagacctaacatccctcatcaacccacatgtcagcctataggggaaagccagtggagaagggtggtgcccctggttgggccggaacaaggtttggcaaaacagactgaccatacgtcatctccaccttccacgtggtgactcatcaaccctccctgccgatggtcacagataaaccgaccttcgcaaccgccattggatgatttaaaatggagggtgcattctccctttacaacacacactcaagaagcaatctctctattttatacttatatactctctagattagttagtttaggctttgaatagttctttgtttcctagtcgtgttggagatgcgggtatgtcttcattaatttgctctctttgtaagactatgagcttagtaatgaaattatcttctttatttaattgtgttcgttgttcatactttgtcaattgtatgacctatcattagtttatagttctttcatgaaatataaatgtttaggctagtcgatctatgccaaggcatcggtccaacaaacttaacggattgtactagttctaacttgtccatctgaagggtaggagtcagggggaattattgatattattaagcaatataaacatggtgcttagattcattaaatgccattagataccggtatgccccacggaatgtgaattagatgacaggtggtgattgccatgtccgtcttttgtattccaccacgttcggatatgacgtaagagttcgtaaaatgccttaaccacactggcaaactaacaggaagtagtatctcggtagtacttgggtgtctacaattaagttctagccatgtatatgtatatgattattgtaacgattaagcatgataaatatataagtacatattaaatcgtagctttcctttgtctttctccacttgctagtttatttatagattttaattttctgggtgccacactacccaagtatcattatttttatcacttttctctgttagactatggcatattaattatagcgtaattagaatatatcggtctatattttacactgtcgccttccatgtagaaaaacaaataaagacacccatggaatactcttaaatgaaatgctacagtgctatccacgtgcttgcagatttatctattaccgtatcaaatagcaatatgggtggaggttccgctggtgaggaggatgacaggcagtggtgtagcagggagggagagagagggagacgtaggaaggatcaagagagatgaaagagagccatggaaggacactccgtaaaaaggaaagagatgagagacaaccgagagggaccatgagagcgagccagcccgattaggtattcttaatgggcatcagtgctctttttaagaaaaagtagcattgaaatttgaccagcgtgggcctaagaaggcaagaaatggctcatagatgaacaacacatatgaggtttcacatatttggggttttgttgtagtcaacgtggtgatgaaaaatcggcgctcggccgatagtgccggaactgtgttggtacaaactaagttgacaatagcaatagcctgggatatctgcttagctccaatgtaggtcctagaattgatgagatgggggcgtgcctgtcagtttgatcctgcaactgacaagatatgtaaacaacagatcaaataaccaattggctgacaagcttatggagcaattccagctgatgccgatagggttataagcaatcaactatatttccaatgtatattatgatacttgagtaaataatgatatatagacaatcggctgataataatgtaattaagcaacaatataatctagtagaaatcaatcggctaataacgatatgatagaataagcaacgatccgaatgttaaagcatacatcggctgaaggtccgatgtcattaaatccaaacgattagataagtaatgaaacctttgttgcaatcggctaaacccaacttgtatataatctctataagccgatacaacgtccatataactcatcggctaaaaccccgatgaaacccttattggcaatcaatggcatgttagtttttatggttataagcacgactaaggtcaatgcaactaggagtttgcaaacaaacataaagtctaaacaatcaagcctttgactgatttttaagagtggtagataccttagctaatctaatctagtaaagtgatttagtcgataccgacaaaaaccctaaagtagatcccagccaatacaagtaaatcgagcaatcaaactagattaactaagatacatgataggcaggtcggcaaatatatcaatcaaaccagagcgatccaagaggtcgaagcgatgcagccttaaacagcaccaatatagttgacataattgccaggcccggtggaatgtaggacttaccccttcgccggagatccactacaggaattctgggcttctgtgacgattacattatgacgataacagcctgtttctcgtcactgcctggctgcaataacgaaatggctgtcatcacagaaggtgggtcactatccagcttctgtgaccaccagaggacatcgtcattgatactgtgacgatagttctcc

SEQ ID NO: 65970 - DNA, 6730 bp, Oryza sativa
ggcagcgatgggaggggcagatccagcgagctctccccctgcctcgcgcatggctctggtgggccgggatctccccctctacgtggatcccgctgcctcccctcccttgtgcatggatctgtcggtggcagcgatgggtggtggggacaccggggagggcgtcggccatggtgacaatgaacctagagcacgggaatgacagtagctgtgacggccgacatgcatgggagctaattagctgccgctttagccatcgtctccattcaccgttgccgccgtcaggatcgcaaggaggagcaaagcatgtcagccccatcgccaccgccgctcaccaccagaatgttgccgccgcccccgacccgaactgagccgccactccaaccttgccagcatctactattgcaccacccaccggtgagtcccctgcgccaatccgaacccaccatgccctagatcgccggccaccatctggtcccgtgccactcgcaaccagccatgaacccaacaccgccacatccgcgctgcttcagcctctgtctgccacgtcagccgcacatgtggtgaacccgatttagttcagccgttagatctaggatagatcggtcccttttaatctgagccgtcagatccatagactggctctgcgcacccggtctactgtggagccgatccatgtggatgcagtaatccgttttccaattcataaataattcattattgcgtcataaatgataaatattatctgacagtggtttaaatcctattgaacttaggaaatccataactaattaaccgtaactcggatttaggtggttcaagtctcgaaattcatctaaaatcgagatatatccaacaaaagtatccacatgtcatgtttatgctcgtttttgtactgttttgttgattgtattcatttgctttggctttcgacgttcccaaagaggctgtttatgctgaaggttcgaaagtcttcgcaggcctgcaaggtaagtcacacagatcctaaagctcccctttgggagggttgacctatatcctttgttatgaccctgttgacattccttacctttcctttgcaaatgggttaacaaattgattagctagaactctatgtggtttagctaaagctattaggatgcagtcctgcttagaaacattagcacactaatgggataacttatgttacactatcacttattcatgttcatttgacggtagctcacgatggtcagttgtgattggttaaaaactgaattttccaactaaaacctaataatggtgggttgtgagcacttggttttgatagtcatgctcatgacaattaaggaccggttcacaaggtactattgtgaatgtttaatcatactaaccacaagccagcgtgggaaacggctggacatgttgtatagcatggttcatcgtggagtgccagttagagaagtggccgagataagcccacgagggtcactggggaatccatacctgactaagggggtggctatgatccgggtatacggtgcaccactttgaattgtgttatgctagttttgttgtcaaagctcctttcaaggtactgtggtggtattgaggtgcatggcaacatgttgtgtggttctgtcttgtgtgtgcattggtacacctctgggcagagtaaaactattcgaatagccattcccgcggttatgggtgaacctaataataagatgataattggtttaactcctggattggaatgtttaattcttggtttggagataaggtctgtgcaatagggcatggttgttcagatacgattgggcctatgcaaacggtatgttgtatatcgttggattgaaattgctaaattaaatacattatagtttattaaatgctatttatacaaatgatcctgtattatgctatcctttgtattttgtgcatttgtatatttgttgtgtggtttgttgagtattccatgtacttatcttaaagtaatcatcatcaaaggaggagtattacagtgaaggtgatgctctcgaggattaggccatgttcaggtcaagctgcttaggattttattgcttgagaagagctatcaatgtttatattcgttcaataattagttaaagacttgtacttttttttatcaatttgttattgtgtgcctcagctgattcctggatgagggtttacacacatgtaagtgtttggaattttggatagaaatttcaggcttgatacgccggcagagaggaggagggggagcggcaccaacttggacctctccagcgctcggaagagaggatggggcggtagtgctagcgtcagggttgggcatgcatggacagaggaggggtgagtgggagagaggaggagagaagtgaataaggtagcatgaggaggacaagggcatgcgggaaaagaggaggttttgctcggcgcaactcttagctcaaatcagctaagctttttttgtaggtatcggtttttttaaatggacacctatatgtataagtgccggttgtttaaatgttggcgccaataaatattgtaggtatcagttcttttaataaaactgacacctatactattggtgctagtttttattagaataatagttgctgagaggttccggttctatactgttccatcccacctgttttaaatgaatcagtacctatcaggggttttgtagtactccctccatctacttttgatggtcatatttcatcttggcacacagaacaaggataagtaattctacttatcatctatttaaacatgctactagtcattcctcgtaaacaagcgattcattaatatttacatttctcaatgtccatgtagccaatcatgtgtggaagaatgaagagtcacatgttaaatccgagaaaatcattaagatgataggttgttggattgaaatatgcctatcataaataaatttttcagatttggaaatataactatcaaaagtagatggagggagtagtccgtttagattggaacatcagcagattgagcctcatgatcgcttctccaatgttgttagattagttatgggctgtttggttgggcagattcatgtagtataacaaatattttctatttttaatcaatataattaacgtttgcatgcttgaaaacatctttttacgacaatatgcaaactattttgcatgttagtgggtagaaaagatttgatgcatggaacttccagagagttaaattgttttatataagaaatattctgcatcaccaaatcttttgccatggaactgtgcttggaacctttcactactaaaaatcgatttttcatagcggcaccatttttttttcattggcggccctgtgcacgcttcacctgccagattgtaatgatgggtgggggctaagaactgccagtgaaaatgactcttcgctagcggttgagttacgtagaccgccaacgaaaatatagctattttcactagcggtccacttaagcaactatcagcaaaaatctattttccctggtggccaccaaagagcaccgatgtattaaacaattcggctcgatctcaaccgtaccgaactctttatgtctccttctccctgccccaccggcgcacccctcctcctcctctcctccatctttcttccccaccggcgcaaccctcctcctcctccttgctgcttcaccactgatgtgcacaccctctcctcctccttcccaccggtggccgcatccatgggtggcggatccggcggcagcgagtgttaaatatatgatccgaattttgggcccacaatatatttagattagttttctaataggctttgtattataggattagtttccgattaggactttgagtctttgtctattaggactcctagatttctcctatatatatcccttgtaagccgcacggggagggtgcgacagcccaatgtatcccctgcgtttgtatccaactcctctatagtgattattgtcggttggcgcccatggttttttcccgcaagggttttccatgtaaaattcgtgtctccgttgtgcatctattttcataacggtgagtcaagtgagaggtcgatccagaggcagcgaaccaaatgggagtggatctggcggcaacgactttcacgtgtggcggtggcgggatggcagcagatggagcactggcgtcagcgccctactcccctcccctcccggatctggccggaggggaggaactaggcagtggtggctaccctactccctccccttgcctccctctttctgatttgcccggaggggaggtggccggtggcggcgcgacaacaatagatgggagagcggcggcggtccctccacttctctaccagatctggccaaaggggaggaggcgaacaatggtggcagcagtagagggagcagtggcagtggtggcgactggcaggtggctccgacggtagcaacagagaggtagctctggcggcagctcattctccaagatccccggcaagcttgtccatggctgctagggttgctagatgtgaaattttttatgtgtttgtttttcgggttctcttacagatgatttgatccatttgatgcacatttcgtgtttgatatgtggaaatggatagctgcatgcgtgttaatatttaccattttttttccccaaaatccatcttaacgtggtgaaccatcccttaaggtaaagccttttttttaaaacccttaatccttgccgctgggcttaggttcccgcttagaaaaatgaattggccgtggtagttggcatccgctagtgaaaatagtgcatattcactggccattagtcactgaacgcacgcccggccgtttgagaaaacttaaaatgaccgtcagaaaattttattttatagttatgttttacaccactactagaaaaaccggctttagcgacgttggccatttatttttccaggcgggtagacacctaaaacaagcaacaccgcttacgaagccagctaccggggccatggttgctttccgcctgggaagatagttctttgcaggcggacccccttagcaagccgcctgcaaagcttaaacttcgcatgcggaccacataagggaccacctgcgattattccaggcggtctatttatgtggtccgcctgcgaagctccatcttcctaggcgcccattttttgccgcctacaaaactcaatcgtggccacacaatttaccgcctgtaaaaatctggccgactatatagtcttgttcctccctgagctcctgttcatacccgacgattttctctctcttaaaggcaccaaaatataggggggaggttttgaacttcaaatcttcgagggatttttctaaagtggttagatctatgcctttgcactctatatacataatttttttgtaatttatacccccttttgactatggatctatgcatgcaaaatagtgaggggaaaagctagctcccatgattgttttttttttggtaatttgcttttgatatgtgtgctagatttatgtgtgtttcttgatgctatggggttctctcatcctctagtgattttataatgtaatataatggactaaattatatactttgctcttatgtatttgcctagatctagataggagagagaaaacttcatgacatgaagaaactaattattatgtttaatttcgtatattatgatcttgttggatttatgtgtaatctttgatatcatgtggtcgtcccatcctctagttggttaaatataatatgttaacttcaaaagtgttacatgtttgttaaatttttttattaatataaattttgcagagatatttgttacaaatatatttgttaatttttttgattaaataaattttgcagagacatggacaggctcgaatggatgtatcattggccgatgtttttatcgccatatatggaacaagtgtctaaatttattgatattgccaaggagtacgttgagaaggagaataggaggggtatttattgtccatgtgctaaatgtaagaatgaaaaagtgtgggaaaatctgacgaaggtaaatgagcacttagtcactcgtggatttatggagaattacgttatatggacacatcatggcgaaaatgatgaagttagactcgttgaagaagaatatgaaccggttgttgaagacatggattgcacggatggttgtgctgaagacaatattgatctggaggaattgttatgccatgtagaacctgagttgcttgttgggtcggctagaggtttagataatttcgaagctttgaagaagacaacaaaggatattctatatgatgagtcaaagggctgtcacagtgacttctcaattttacggtcagttcttgaacttatgaggttgaaggcgagatttggatggtctgatagtagcttcgacagtcttctacaacttttgtagatcatgcttccgaggcctaacttgttgccatcgaacacatatcaagcgaagaaatcatatgtcccttatcccttggtgtggagaagattcatgcatgtgtaaaccactgcatactgtacagaaaagagtacgcctcgttggttaaatgcccaacttgcggtgctagccggtacaaatcaaacagcaatacctgcctagaagaggatgacacaatcggagagactaagagaaaaatcccgcagcttgtgatgtggtaccttcctgtgaaagaccgcatcaagcggttgtactcaaaccctcgagatgcggaactaatgcgatggcatcaaga

SEQ ID NO: 65971 - DNA, 1485 bp, Oryza sativa
tggctgcaataacgaaatggctgtcatcacagaaggtgggtcactatccagcttctgtgaccaccagaggacatcgtcattgatactgtgacgatagttctcctgtcattgatgaatgacgagacaaattcgtcataacaaattgaaccgaataacgccacgtgtatgatgacatctaatgttactgatgacaaggcggatgatgtggcaaatgacatggcaattcacattcagcccatatagcgtgggcttttttattttcaattacaatcagcccaattggcccaaatatgtttttgacccagctacaaatttgcttttacgtttttttcactatagcccaacaatacaattctagcccatattatgggccagcccaattaaaaagcaatcacaaaatataaaccacaaccatttgcataattatattataatcacattccagccataattaattttctagcccatacaaaagcaagttccaaaatacagtttccaacatatttccatacaaaagcacaaaacatgaatacaaaatgatccatccaccatccaactacacaagtcccagctgactacaaagttcctacaggtagtgccaagttcctgcaccaaaaaattccacctagcagccactaagtttcggcggcgtgcatcttgccagtagccagcaaaaaaattccaccaagcagccgctgcacttccggcctgcatcctgccagcagtcagcaactagtgccaaaaaatcctgcgttccagcaaccaacgcaaaaaaaaatactctggccactaaaagtgccaacctgcaagcaaccaacagatatcacatttggtttttggcacatttgtcctgcacatgacgcagttacatagcataagtaatagaaccactatgcatctgtcatttccttgcaacgccattttcatttgttttcagtggtcactattacattaaaaatgcaaatagagctgatccaaacagagctataaactggattatggaataattattttaccacctgagaatatcaaatttatgttgatgtatcttaggaagctatgtggttaaataactcaggaagattacatgaattatcttatagtcaatctgaaaactgctataataaatctagaattatcagatgtagctggcatgttccaattcctcctgacagaatcaaaagatctcaaatgtacctcatatccaatatgtatatacctagccaaacatgaatttgtgctcgaatcaaagtaataagctcacacaaaatgaaatctgctaaacatcacctgcctcacctactaaacttttttaagataatggatcaagttagtggcacaaggttttgtgaacattttgattacatcactgtaggtttaaaggtaatcaagcccaatatatcattaaccaacaattcccaattacccaacaaggcagctgaaactgtgaaatacaaccataaaaaacaatatagaaacattgtg

SEQ ID NO: 65972 - DNA, 11110 bp, Oryza sativa
tgtgtgtggttccgtggagtgatcctatcgctttcggagtttcgcattttgcgagttctttttttttcctttttcacaactgcacgtttaggtgatgggttttgctcggtcgaggctgaacatgaacttttgacttagaccaaacggataggaataaaactttttaagtatctatcatatcacatgtttatatactaattataaatatttaatatagactattaataaaatctattcataatcttgaactaattcgtgagacgaatctattgagcctaattaatccatgattagtctatgtgatgctacagtaaatattctctaattataaattaattaggcttaaaaaggttatcttacaaattagctttcatttatgtaattagttttataagtagtctatatttaatactctaaattagtatctaaatacagagactaaagttaagtctctggatccaaacaccaccttacattttggttgtttacttgtttcttttggtaaacatttcaaacatacttcctccatctttaaaaaaaccaacctgaccctcttagtacaacaaatctgatcaggttatttttttaagacggagggtgtatatgtctaatgtttcgatgtatctcccttaataatttagctcatacttcctccgtttcacaatgtaaaactttctagcattgtccatatttatatagatgctaatgaatatatatatataataatgtctaaattcattagcatctatatgaatatggacaatactagaaagtcttacattttgaaacggagggagtagctgttaaacgcatgcttattttatgacataaaaaagtactagaatgaaacaatactttattatccatgatgcaaaataaactataataaaaccccctagttcaactataatctaaaattaagttttaaaattaaactttagttctgactgatctaaccagcagacgatgaggtggtgctcataccttttcaacaatcaagaaatgatttctatgtaagatagttattttgagttagttacttattccttacatcctaaataaattgatttcatatgagatgtaacatatcctatgttcaagtattgcaaacttagaggctgtttagattaatgccattttttaagtaaacttaccaaaaataatatatatgtttaatttgttgctaaatttgataaatatgtaagaaattctgtcaaaattttgacaataccaaaacttgataaggtttattttggctacaatttaaacatacccttattttgaaataaagggacagtttgcacacatggtcatacaagcaaaaggttgtgaagtcaaaagtcaatgtgtttgcctaccatcactatcactcgtccgcagcttttaaagttagaaagttgaccctgcaaataaaaccctagctgactaaacaccgacaagatataattattatattgtttttttttgtcatataatagtactatctctgtcccataaaaaaccaatctaaaataagataagatgtttttttttctagaacaataaatctgtacatacttttgtccaaattcattttccaagaaaacattccatcatatcgtaggttggttttttttggcacggaaggattacttggcaattggcattgttattgtacaacgagcctatcttcttcccatgcattaaaattagctataatacataggcgatatgtgctacagtaccctacggtttccgccgggggaggggggggggcaaggtttacaatgcgagctcatacacaagtatacctcctattgtcatatttgttatgagattcatgcatatggcacatatttttataaagggtcaattacttatttgaccttgttttggacgctaactattaatttgaccctactttttggagtttgcttatttgaccatccttttaaaaaaatgaagctcccatttgaccctgtttccactcatctgttaaagtttgattttttttcaaaaaagaaagaaatgtgattattagtcataatgcccaaagtaccctcggaccctatccatccgatccccatctctgtctctctcgggcttcaggcggcagcatcgggcggtgaggcagcggcgtctagaagctgacccctgccggcgcccgctcgggcttgcggcggcgtgaagccgacccccgccggcgcccgctcgtggaggtagagggcggcggcggcggcgggatccgcgccggcgcccagccgtgaagggaaggagcggtggcggcgggaagtggaggaagggagcacaagattagaacaagattagattagtagaacaagtattgatccgaaggttaaagcacccatcggctggaggtccgatgtcatgaaatccacaagattagattaaacaatgaaacctttgttgccatcggctaaattcaacttatatgtatatgcaatccttatgagccgatgcaacgtccagataactcaccggctgaaaccccgatgaaacccttattggcaatcaataagcagactagagattatggttctaagcacgacttagtagatcaaacttaactgatgcagcactaagtatgaaaagaaacacaatatctagacaatcaagccgttgactgattttcagggtggtagatgcctaggctaatctaatctagcaacgcgatttagccgataccggcaaaaaccctaaagcgagagacagccaatacagctaaattgatatgctaagactagattaacagagacatgataaataggtaggcaaatatatcatccaaaccagagcaatccaagaggtcgaatgtactgatgcagccttgaacgacgccgatgtagatgagacaattgcctggactgacggaacattggacttatcccttcgccggagatcgaagacgatgcagccccacgtcgggtgccaagttccgccggaacgtaaaaaaacaaaagtagaagtaaaaaggatagcgatgcgccgaattgtattgatcgtagcgatagattacatagaccccgggtgtacatatttatacccatggattgatacaagtcattgtcggacaagaaagaaactaacctaaagataaaaggaaaatataaagtccttatcggacactaaacacactttcctaaagataaaaggaaactaacaaactattcctaattaatagataaactgccatgccgcatcctctttaaactcggtcacttagggataagcttcctttagtagattgatttccttaaccgaatatagcaggaatccgactattggcgactttataactcctatcggctgattccgagatgctgcagccgataatgattctaagtcgatgacgtctttgttgattaccaaatttcactattaacacagcggcagcggcgtgaagcggaggaagggagcggcgacggcggcggcggcgtctgcgggcgctctgagggacggcaacgacgtgaagccgacccccgccagcgcccggccgtgaagggaaagagcggctgcggcgagaaacggaggggagggagcggcggcggatccccagcggctggagcttcacgcgcggtcgggggcagcggcggtggctacctccacccatatgtccttgggttcgagcttggccttcatcagcgccgcgtcgtacgtcctcgggctcgacctcgccgttcatctgcacgctccctgtcctgaaggcgtcttcttcttcatccgccaaaagacagagacgccatggccagcttgaggttcaccgttttttttttttgcttttatctatgtgcttcgattgattgatattattggacacatgtggttcaaactagattccaaggtgtggttgtttatttttaaaaaatcctgtcaaatttaagtcgaatttgtcaaaataattcaaatttgttcaatttatgctaaatctgtcataactgtgtcaaattttgtttaatttttttttgtcaaaattctgtcaatttaagtcaaatttgacaaaatgattcaaatttgttaaatttataacaaatctatcaaacttgtcttcaatgtgaaacttattacaaatatgtcaaagtatttgaatatatacacggtatgacataatagggtcaaacaatcaagatataatggggtcaaataatcaagggcaaaatggactatttacccctaagttaacaccgtgaactcaactaaacggaatagggtcagagaggagcttcgtttttgaaagggagggctaaataagcaaactccaaaaagtagggtcaaattggtagttagagttcaaaatagggtcaaataaacaattgcccctttaatagaacataatattgtattcctcttttcatatattatctgctggattaaatctaaaagtcacaaattattaatggggagtaactatacaccattcaatattttttaaaagcgaacttttaaacataactataatataattgggatgcatataacttataactataatataattgggatgcatataacttatataacttatatgtaacatgtataattttattcgaaacatgggctcaattagatggctaacaccacaagatgatatttctcaggctatgggtttgattcccactctttcgttggtcttgtgatccgacgattataaatttaaaagtcttgggaatttatatttttctgctctgcacaattcttgaagtgatccaacggttataaatttggaagttgcgagagagaaaaaaaactgttgtatatttacaagaaattctgttattaaaaatctgcaaggggaaattaaagcactcaaattcgtatgaacaagtccacatgcaagatgcacgttgaagacctgctatacagattcaatatatccggatcgattcaatcctaagccttattgtaagtgtaacgtgtttacactttacagtttacaagagccgatcggggggcttaacgccttaatccgatcattattccttgccatctgaattaaccaaaccatacacaaaagaatcgaggactccgaatctccgatacccctgttacacacgctactaaaattacctatgtacacccgacgcggcgacgcctgtacgcactaacgcacgtctctacaaaaaagccaagctacatgtacggtgccgtgcacgtgtagcctagtttccacaaacgatcacacgtacctgcatcggaaagaacaccatacggccccgtgccgccgtgcgacgatgcgatcgagaaaaaaatggttatgaaaatgtagtcgacgtagtaaggcgcagcattagcagagcaagtgcactgctggcttaatcagctggtggcgcgaaccatcggggactgcggcgacaggagcgccaatggactggagagatgggctgggctgaggtggtggtggtgcggcaggctgaggcggagctgcctattggcggcccagcgctcggccttgaccctgcgctgctggtgctggcgcacgaagtcgtggatccggccgagcgcgacctccatggtctcgtcgtccatgttggcgtggcagacgcggaaccacccgggctcgcggcagtggaacgacgtgccgggcgacacgttcagcttcacctggtgtacgatcacccgccacagctccagctccgcctcggccgtcttctcccggagcatgcggcgcaggtccatccacgagaacagcccggcgttgccgcgcaggcagccgatcccgacctcgcggaggccagaggtgaaccgctcgtgccgcgccaccagccgacacttgctctcctggaggaagcggccgatgaactcctcgtccgagagcatcctggcgaggaagtactgcgtctgcgacgagacgagcccgaagctggacatcctgcgcgcggccgccacgacggcgtcgttgtacgagtagatgatgccgacgcggaagccggggaggccgaagtccttggagaggctgtacacgacgtggatcaggtccctgttgcaccacggcacgtcgcgctcgatgacctcggcgatgctcacgtactccggcgtggcgaacaccgaccccgcgtagatctcgtcgcagacgaggtggacgcggtgctcggtggcgaaggtggcgagcatggccagcgtgtcgcggtcggtgatggtgccgagcgggttggacgggttggtgatgaggatccccttgacggagatgccctgcctccgtgcgccgtcgtacgccgacacgagggcctccttggtgagcctgaagtcgttgaagctgtggcactcgatcggcagcagctttattcctgacctccagcaacagtcgcggtcgaaactgtcaacggaagcacatgtcgtcaggccttaggcttagctacctcagctatgttacattgtaaacatgcatcagagttaaaattgcattgactacgaccgtgtgcgaacatcgtgcatgcgtttgcttgcatgactagatttagtcatttgacttcaacggcatccataattaggtcgcagtttgattcaatcacgggaaaattaatccatcttttctctccaagccaattttaaaacgtaactcaaatctcggagagaatgttatctgattttcttagttgacactcggatatcttttcctcgtttgacgaactactagatattcagaggaaacagaagacttctacgagcggaagagaacaaattcagtttcagttgtgatagttaaggttgacgggacatacgctgggtagtatggcgtgggcacgaggaaggcctcgccggggttggcgaggcagaaggcgagcgtctcctgggcgccggtggcgccgccgctcatgacgacacggtcggggtcaaacgttgccttgcctcccctcacctgccccataaactgggccatcgcctgcaacatcacaatcacattcagttgttaacaatatgacctcccgaacgctagttgctgcgttgctttcacggtcgcaagcagcagctttgtcatctatctggttctcaatatttttatcgaattttctatgatgttatatagcttgtctaatatgctgatgtgatgtcagcgattgattggccttacctttctgaactccgggaggccgtggtaatcctggaaattggcgatcctcttgaactgcgagacgccctccggtgtgcaaatggatgcctcggggtggttcttgctccattcctcgatcaggtccagagaaagctgtgacatttacagggcaacaaagacggattagcactttgtcgagaacgatccttaattcagaaatgagtatacacaggtctgtgcgcgtacctggttctcggcgagacccatctggatgacacccccgcgattgtgccgcaggtcgaacgggttcgtgtcgtaggccttccacccgtcgaagtacgatgaattctcgccgtggtcatcgcctgcggctttcgtcgagagaaggtcgatgccctggtacgccattgatttggtgtcggactccgaggatatccgaagcccggaccctggctggaacgcgagcagccgagcaggtagctactctacctgcctagccacgcaaggatgatcggacagacccccacaagaaaaaaaaaaggatgatcggacagacaacgagtacgtgcaatatggcacttagctagctcagctagctcgatgattgattgagctggcttgtttgggagataatagaacgaggtggccatcggtatttataaaccatggtaaagttggaggtcagaacaaccagcttgagtttttggcgcatgcatggccgagagaagcttccatgaaagggagactggaggctaggcacgagcgcgacgtggtttggatttttggaacatggaagaacggggcgacctcgtggccgtgatgttggccgcttttaatttccgtttaccaagttacctcgccgcagccgatggctatcctatcctattctctctgtccgtttcaggttacaagttttgactttcaaagtcaaattactttaaatttaactaattttatagaaaaaaatagaaatatttttaacctaagacaaatatattataaaaatttatttaattatagatttaataaaattatattggtgttgtaaatattactgtttttttctacataattagtcaaacttagaatagtttgactttgactaaaatcaaaacgtcttataacttgaaacggagggaatacggtaaagttaacccacttattctaaaactcaacatacagatatgatacatcatcatccactagcaataattacatacaaaacttatgtaagcatgcaacatcatctataatttattgaattatacaaatcaacgtccaataatcttccttcacattatttttcacgatattttaaacatatatatatatatatatccatcatttttataatacttgttaacatatattcatccatataatcaaagtgggatatcatatttcatctacaatctcatagagtctactaaatttatttctctcttaacatagtttgacaaatcagttttatttgttattgataactaatattttttttacttttaactcgattgttaaaaaattattaaaagttagtaattttcgcaataaagcgcggagaatcacctaatattccggaaagagaagaacagagcatcgtatgtggtctgtggttcggtttgggttggaatgcatactactaacgtttaactttcttgttctaaaatgttaaacggtttggctataaagctcgttttcgattagtatgttttcctaatcgttaaacggtgtattttttttaaaaataaatatataagtttctttaaaaattcgaatgaacctatttttaaagtttataataactaatacttaattaaatatttgatcatgagtcatcccgttttgggcggctgagcctgaaagatggaaaatttatcttttttctcaagtgcacgcttcttgaattttaaattttgtgttttttgaaaaaaaatgtatagaagagttgtttaaaaatatattaatctatttttaaatttaaattaattaatacccagataatcatgtgctaatgtgtaagttctcaatctattctatttttctccttccaggacaccctaactctgtttttactgaagccgggcgatggcttaactgagctcggcttggacgcggcagtggacttagagcaagttcaatagtgacttagagcaagttcaatagtatagtccactatagcttcaatttatctatagccgatttaatagccaattcatacaatagttgcttactatactattaacatatggtcccacctgtcatacacacattgcatcttggagtctgtgttacagttggctacagatctgtagcccgttgcttttctctctcatattttatcttactaaaatatgtttatagctggctaatagcccgctattgtacctgctcttaccgggctgcccgagatcgatcccggaagactagttctgccgccggcgcagctacctcaagaaaacgggaggtgggttctactttgcatgagagggaagtagtatgggcgtacaaccacaagtcccaagataccacataggactaaatactaaataatgatgtggaggagagaagaaagatgagagaaatagtcacctctcatgaaggggtaacccctacacaaactttaataaacatgtgagagtgttagaatattgggaattgtgtggtagaggtaatatattatacatgtcaccttttaatttaattatatgtatatgatgcatgaaattagatgtggtggtcacctctattataaaacttgcccttatactaaaagcaagtttaacaatacagccaactatgggctccaaatcagctatagtcaatttaatagtcaattcacacaatagttaccaataaacatgtactacataattaatgtctagtcccacctattatacactcatatcttggagtccgtgctacaactggctagaaatctgtagccgcttatctatcctcttttatcttgttaaaagagtaaaaagcacgggcggtccttaaacttgtagggttgtgccatcggtcccaaatcaatacaatcccttcaggatcctacgcggcgttaatgtggcgtgccacgcggacatgacatggcatcattttgactaataaatgggacccatttaaaaaaaatccttttttatattttttttcttctccttcatctcttttttttcctttcttctcctttatctacccgagcggaagaaaggaaaaaaagaagaatgagaagaaaacgaaaaagaaaaagaaaaaaaagaaaaggacacgtcacatccatgtagcatgacacatcagcgccacgtaggatccttggggcatgtgttgatttgggatctagataatacactttgataagttctgggatctggatctgcattttaaaagtttagggacccagatgacacaaccttataagtttaaggaccaactatacactttactctcgttaaaatatatttatagccaatttatagtctgttattttacctgctctagttgtcatggaattaattaacaccgctagtgcgcggaccgcggataccggatcgatcaaaggatctggctctcgttggcgattgcgtcatgcttaattatggcttaactgaagttagtaactgactctgtgaaacagtactacagcacaccaggtgaaatgcacgccgtagaatcattgatgagcgtcgagcaccccagaatcccggagttcgttatcaactctcaggttgccagtcaacttggcaacccagtttaaagtactagtctttcctaagtctttgggctaccacaataaattcgcatccaatttggccactacagtgcccaacttgcttttccaacgaggggaaataatgatgtgatagaccatcgtgatggtgatctgaccgtgtaaattgatggaaaaaaattgtgataaaaaacccatcaaaatcaacttttaaattgagttttcaaaaatttaggttgcagttgataaagtgaagagcaaacaattgagttacttgaatataagccgctttaggtttaattttttcgtaacaattaataaaagagcgtgaacaactt

SEQ ID NO: 65973 - DNA, 24945 bp, Oryza sativa
cattgatgtatttctcgaaccactgttggaagatatggcagatttatggcatgaggggttgaaagtgtgggatgagtacttacgacaacacttcacagtgaaggccatcattttcgttaccatttatgattaccccgccatgttttcagtttcaaggcagatcaaaggtaaaactggatgtgtgaatatgcttgaatggaacgtactataggtacctcccaggttccaacaagcttgtttacttgaggcaccggcagtttctacccaagggtcataagtttcgcaagatgaaagcagagtttgatggtactgaagagaatgattctgcaccgaaagttacacccggggataaagtatgtgaggcaacagagaaaatagaatgcgtgtttggaaaagggactaagaaaaaatcaaaggggacaaagcgtaagaaaacatcaaagggggcaaagcagaagaaagaagatcgcaagcccccttccccattcaagaagcattctatattctttaagtacctgccgtactggaaagatctggagattcgtcatgccaaagatgttatgcatcaagagaagaatatattcgacaacgtaattggtacattgttggacataccacacaaaactaaactaaggatggtttgcaatcacggtccgacctagtcgaaatgggaattagggaggagctacacccgcaagaaggagaaaagactggcaaagtttatcttcctccagcctatttcacactaactccagatgagaagaaggcatttttcaaatctctctgtgatgtgaaagtgcccataggtttctcatcaaacatcagacgactagtgtcaatgaaagatttgtcggtatctggttataattcacacgactgtcatgtcttgctcaccgtgtttctcgcagttgctattcgggccattcaacgggaacatttaaagattgctatcacaaagatgtgctactttttcaatgctatctcccagaaagtcatcgatcctgaagagttagcacttcttcgtacattcccacatgagatccaatgccaacttgaaatgtatttccctccatcattctttaatatgatggagcacctcatggttcacatcgtgccccaaattgttgccctcggcccgttgtatctacatcaaatgtggtcctatgagcgttacatggctgattgaagggctatgtatggaatcgcgcccatccggagggatcaatggttgaggggtacaatacagaagaggtggtcgagtgttgtattgattacctaaaagatggaaagacaatcggaatacctgtacctcgacacgagggaaggttgactggtagggggacggtagggaagaaaagattcgtcgaccttgaatacaaatttgtttcagaagctcacttcagtgttcttcatcagcttgctatcgttgagccttacatcgatcaacacctcgaacttctcagatctgaaaataagggacgcacggatgattggatgataaaagaacacaagcgccgcttcgtagattggttgcaagaactaaatttacctgatggagataccaccgaggaaattacaatgaagcggttctcatgtggtcaatcaagtactgtaaattcctagcagggatatgatattaatggatacacctttagtacaagagcccgagatactaagacagttacacagaacagcggagtccgagttgaagcaatagattcactaggggaaaaacagacatactttaggtttattgaagaaatatgggaaatcgactatggactcacaattcaattccccatttttaagtgccagtgggtaaaacatcttaacggtgtcatcattgataagtttggtcttactgttgttgaccttgggaatgtgcgtcacaaggatgactcctgggtactcgccgatcgcgtggcacaagtgttctatgtgacagaccctgcaaatttgaagaaagaaatagttttatccggaaagcaaaagatattatgagtggatgggattcaagatgttgatgaatacaaccagtatgatagtatgcccctttatactcaatttcttcaaaaaattaagcttgtggaggaatctatcgacagtaccatcaagccatacatgctagaggatggagttgggaaaaaggtgaaagggtagcgtatgcatgcaatgatataatgtatttctgaatttttttatgtaatggtgacatgtaacggctatttgtactcactttgcttactactatgcatttaacatttttaagtgcaatagcctgcttgcaacattaattaataccaacatttattaagtgcaaaaacccaccaatatgcagaagaaattacactttataggtggaaaaaattctcctcaattttctgtaacaaactattagtataaaaaattacactttcaaataatttttaatggtttataattggaagttacaaactattagttttgaaataatttatatattcgaattcacaacactgttaaaaaattctccaagtgttgaaattatcttttcaagcggccggtccgcctgggaaatttatataaagatcacataggaattatcttcgcaggcggaccggccgcctgcgaagatttgcaaaacacatcttcgcaggcggataggccgcctgcgaagatatttggggattaacttcacaggcggtcggcccgcctgcgaagataggaggcctataaaagcgcgaccaccccggcgccaaattctcaaagtccaggcgggaaccctagaaaatttggcgccgttaggctaccgaaatttttggtgcttccgaccgccggctctcatccgaccgccgcctctcctccgaccgccgcctcccttgccggcgccgaccgcctgctaggccaccaccgctgggcgccgcctcgtaaccgtttggccgccggcgccgcccatctcctcgagccgggccgcacgccgcgacctctccatccggccgggccggcgcggcctcctccccggccagcgccgcctcgtcctccagcgccgccacccgcggctagcgccgcctctcctccggccggcgcggcctcctagctacgcccgggccggccgccgccgtgtccactcgaagctcgcggccgccgtccactccaacctcatgccgcctctcctccggccgccgcctccatcaatctccggccggcgcgcctcctctcctccggccggccgccaccatctctccgcgcaactcggccgatcgtcgtcatccccgactcctcatccacgactctgtgcatgtgtgtgtggcatatatatgtgtgtgtgatgatagtggctgacatgtggggccgggtttgttttttttttggatgagatgtggctatgtgctatgtgctcatacatgtgaatggggaaatgtgggttttgtttgtgatatataagggtgaattttgtatgcaggatgaatgtgttgaatgtaggaaatgtcggtttcgtttcgttcaattttaattaaataacatgttgggaagatattttcaatttttttatatgactttcagtaaatgcttgtatatgacattttcgttatatgctttcatatgacattgtccgagtagatagtgcttttatatgacattttcgggccatttcggttgatatgacatttagatagtgcttttatatgacattttcgttaatgctaaacgatggtgctttgatatgacatttagatagtgcttttatatgacatttctgttaatgctaaatgatggtgctttgatatgagatttcggttatatgacattgtccgagtggtagatatttttaatttttttatatgactttgagttagtaataaattcaaattcttttatatgtacgcacattaaataatttttattgtcattcctataatatagaacgatggcagatagtgcgaaacgagatgaggataaggcctctcctccggcatcacaggctattgtggttgcttcgcaaccgaacgtggaggcgtcaacggctattgtggttgcttcgcaaccgaccaggccaccggccgatgggtctagcagtgacgactctgacgagcccggcaaatattcctcgccaagtgacccacatccaagccctaaacggcggagaaaagttgatggccaacaagacgacgccgattatgtcccccttaagaaagcggtgggtcttccgtcatattcgtttgagttgctaattcattgtttgacttgaaagtactaattcatgatttttgtaggaaaaggccccatgcagatctagacgccgagccgaaaaatccacccaaatcgaagacgtcccagctacgacctctgacaccaagaataaaccaaagtctcctaaaaggagaaagggcgagaggagcatcaacaagataaacaacggggtgtacgtcatcacccacataagtcccaaaggggagcctctcgctcccgccactgcacgcgcaaagttcagctcacagtgtggggtaattgtaagggacaagatcctaatcacttacaaggactgggataaagtgccagcaggggacaagaaacttctgtaggatgagataaagaaaaggttccagttccctgacggatctgaagcaatggcaaggaattgcgcattgcaaacaatggacaaggcatggcgtgggtggaaaaacactttaaacagaaactacgtgaagaagggcaagacaccatacaagaaatatgggaaaataacgctgtcgcaatgggacgaattcgttaagttcaagacctccaaggaagaaatggagaagagtaaagtgatgtccgacttggcgaagcgtaacaaatggcaccatcgactaggttccggtggttacgcacccaagatagaacaatggaataaagaggaggaggaaatgaagaggatgggggttccggtgcccatggaaaactggaacgtacgatcgaagcaatggatgaaagctagaacaccgaagatcactgcggaaggcaaagtgcaatttgaagaccctgagctgcaggtagttgccgacaagatagatgatctatcaaccaaggaaaagaaaggagaattcactccacagagggagaaggatgtgctaagccaggcactggggaaccgtgagcacggaggctgggttagaggcgtatcctctaagctgagttggaaagaaggcttcaaacaggacgcctcctcgtaaaagaaacatgacgcctacaaggaaaagttgagggacgaggggggtaagcggtttgaacaagaaatgatagatttctgcatgaaatattctattccactacaggatcccaaagaaccggagccagaatatccgttcgaggatttacaagagactaaaccttgccggttgcacatcccaattggacgcgctaggaggacacttgaggcggcgaagggaattgctattcctggcagaaactaccatggcggatttattgaatctgcatatgcgaaagtgcagccgcaagaggtgaatccagggttcgagtcgtacgacctagacatcccaacacatgatggaatcacagtacttggggatgtggtcgaccttgtcattctatggcacaaaaagaatatcatatttagcaatgtcgccgctggtcctggaaaaccaccgagacctcctaagcatcgatcgttgaaggacaaggcggaagaggctaagatacctctgccaactaaagggcctgacacacctgacttgccacataaagaacatgaggtgcaaagtgtaccggatgtcgaagaaccagatgtggctctaccagatgtgcaagttctttcatccatcggtgtatagctagaagacgtaccaacattgcaatgggatgaatcagaaccgaccatccatgaggacccaaatcctacaagggaccctgttgaggagaccactgttgaagccacggacaaagataagtccgaagtgcctagggtgctcagaagccacgaccccaagaaaaaggatgaacacaaggagaaatacatggtaagcgtcttcagagggggcaaggaaagagcactactaagaggggatgatgcgaaaaaggccgctgcactatctggaccgaaatacatctggactgaagattgtctagaaaaatttgaacttgacaaagcttttctgccggattgggcacttgatgaggctccatgggagatgaaaaggctccatacatggtacatggatgccagcaagaaaggcctaactaacataactattcagtcaccggcaaatgtcttcgccggcgaaggattcttctggcttgatttcagtgacctacacgccatctatcgtcgggataagatggacgtaaactacgttgctgcttggtgcttgtgagtacgagtgttgtatttattgcacgaataagtatgtgatcaattattaacgaaatgcttttataggatgcaatccatgcctggagaacctatcggatttctgtatccaacaaggatctgtcaaacttagcatactgtcacattatcaccaaattccgaacagctcaagggcaagactcctgcagagatagcggaatacaagaagagcttgcacaagcaaaagatgactacggtcacacagtacatcggacgagccttcttgcacttccaaaataagagagtcatcaaggccgcgtacaactttaagtaagtcaagtagaattcattgcacatacctatgttaattcatatgtgactaactgcatcgccattaatatgtagggatcaatacatatgtttccttatcgacccaaaggcaggcgtggtgacggtcctggacccccttgattattctcacacgatgtatagacattttctacaaatcttacaatagtaagtgattctcatacttgcatgcctactaatctagcaatagtaagtgattctcatacttgcatgcctactattaattctatacagtgcgtacaattactacaagttcaagggtggagaacagactaaaacaagggagaagctactagtacatacgtattggccggtacgtaatactaatatctcacttaatccggtacgtaatactaatatctcacttaatgtatttcaattgttttacaaatttcaaaatttaactatttccttcaatcacatgaagtgtcacaagcaacctaggggcactatcctctgcaggtattatgcatgcgaatacctccgggttaatgggaggtacagggttaatgcagaggatgtaagtctctcgactcaatgtacaagcctattgaaccactacccttatagatcgtactaatgttttctcgttctttcatgtttacagttgcctagaattgaacgtcgagaaggattcgatgatacaagcattaaaaatgtacaacaggacctctgccacttcatccaccgcgagtgttatcatgtcataggcaagtacttcgaccaagacagcatcctggctacaagcgatgaattcaaggcccttcgggagtggagtaacgcgatgccatgacgtgttcattagttacatacgacagtgtacaaatttttgtataatactttgaatgatactttgaatgcaatacatgtcagtattcaatgctcattagttactatcattaattatgaattaattaattaattgcaacattattgaaaaaaattattaatacaaaatttgcggctattttcaattcttggtgcttttttccctggcggccctatcctatcattgcgggcggcctatactaatcttcccacgcggctcgaactagctcccagccgcctgggaagaacatgttcccaagcggaccggccgcccgcctgggaagataatctatcttcacaggcgattgcctacaggcggaacgccggtccgcctgggaaggccattttggcccgcctgcaaataccatttttctagtagtgcactatagtatactcatagtacatactgccagtgtaacaaaggctgtgtttggaatcagttattcccaacatgaacggtgagcgcggaaaacgaaacgagccattagcgcgcgattaattaagtattagcgatttttttaaaaatatagatcaatatgattttttaagcaactttcgtatataatctttttataaaaaacacaccgtttagcagtttgaaaaacgtgcgcgtggaatacgatggagaggggctgattccaaacacagcctggcattttagtagtttcacaaaattaaaagggcattctcagcattccatcaagtcattatggccccgtacacagtgagccaatcgttctgatcccttcggtgtaaaggacgatggggaacagtcatagcaccctataaacattcacgggtctacattataacaattatagcaccctataaatacaccattgtctattcctaatctccatcacagagcagagaaactagctccagttggcattcaagctctctctccctctccttgctagctgctcatcaacaatttgctatacttcccatggctacttacagtagctctgcacttttcatcctcttcttgcttccaacattcctgagcatggctgccagcacctactatgatatatgtcctgtggagtgtggttgccctgaccaaaatgaggttaccatgcacttgtacctgcaccagtttgttgctggagcaaatcacccaaaccgcaatgaagaatttgtgatagcctcgagctatcctaatggattcggtacaacactcgttgatgactggtatttaacagctacaaccaatcccaatgataatatcgttgcacgtgtacaaggcatgcatgtccaggctggccaaagcaatgctaacatgtggtacacttcccacaacattgtgttccaggatgacaggttgaaatttatgctagcataactagatgtataatttaaatttccctgctatagtgttgagtaccttattgacttaattaattgttcaattgtatgcattgtcacttctataatcttctctgatatatatgaagctttatattttttatcaaaacaggtttaagggatccacacttcaggtgatggggattattgctgcaagcagtggtgagtggtctgttattggtggaactggagaattttcaatggcccatggcagtataaagttcacaacggacccaagctctaccagcgaggatgctgttcgagaacttaatattcgtgcaatctatactgcagataatccacaagctgtaagtagctttttattctgtccaatgttttcaaccatgtgtcaataaatataaatgaaatttttcatcaagctcttaatgcagaggttaggaatacctacccccgacacggtattaatgaaggggttacgatcttaatgatagcaggaattttaatattttattttttttcattgttcctatatagggtctacctatttatatagcctagctagtttttgttaatctaaacaaattttcgttgtagtcaccatgatattttagtggactacagcttgaataactgttattcatcttattatgtcataataagcatcttactttacttgttatatgaagaaaatgaaactgtgcatgtaatggcatgtataacagtaattcattttatgtcattatgttcaggctcgtggtacagcatcggtcgcaaatgctactcgtctgccatgaaaagaattgatggaaataatattgtggcgtctcaccactactgcagcgtcaagatatggtgttatcaatgttctttcctaccgcctttctctgtctgatcagttcaaggataatgtgtggccttctctggtggtattatatatcatcagtcctgaatagatgatcaattattttccagtttgctgttgtgtgtatgtggttttttattccttccatatgttatgtgaagtgtttgtccgcggaataatgaatgaaccaacgaattttatcttgtagagaattgaaatgactcgcctcaataatgttttacttgtatacggtcaaaaaaattccacatgatttgctcgtacagacactagtacacaaacatcacatagaggcctgccggaaccatatgtgccgatttgcttaacatcggagcctattaggtgtttcctgcttaccgaatcttttttttttctcgaacactctccttaccaaatccatttgggcgggatgcaattaaggccctgtttgggacagcttaagattctgattctgagaatctgctggttggtagccaatttctagagaagcttggtttttcaacttttgggttataattcatttccagattaagtaactacagattcctagaatctaggtgataatctggactgtttggtggagctagagattctgagagaagctgcagtagctagaaactcccccaaacaaacccttcaatacaaaagtagtatttgggcgggataaaaattaagaacctgcctgtaagatcccctccccaacagtcctcaattctcaataagtttcggataatatgtaagaatcggcacctagaacaaaactcctaataggtaccggctcataggtgccagctcatttaaagccggcacctattgatcatttcccacctccgcgggatggaaaaaaatatagaactagctccatggagcagatacagatgcttattctaaataaaaaccagtacctatagtatgagcgactacccgacgcctaccttatctacttgatcattcttgtgtccattcgtctctcctttacctccctctccctctccacctctcccttcctctccatctctcccatcacaggagacacctacccctgacacggcggccatcgacgtggtgactcgctccctctgtaagccgcttattcaccttcaccgtcgtccgttgcccccaccttacatcggcgggcgacaacaacccccccccccccgtctccccctctcgagaccaaccttcaccacattatccctctcctccctcacaatccctggccatgtggctgaccatggcgacctcgattcctcctcctcggccagtcggtgaaagcagggaggcccgaagctgtgcctcgctaacacattccctccacagtcttacatattcctccgggcaacctgccagtgtttggctaccgggtccggtggtggcctccgacggcaacgacctagatgagtattggattttccagtgagcagttgatttggggatttcttctagtcgatgtccttattggatttttgtgtttcaaaattatggtaaatagcataatcaaatgatatcggtatttgatttggatgattttgttcttgtcaaatgattttttgtgcaccggggagcaacttgaagcatcggctcgatttgagccgatgcatcgaccctatatttttgggtttattggatccatgccattgcaactaccatttattttgagtttgtcaattttgattgttcttgacctcgatatttcacaattttatattttatagttactaaaaataattaaattaagaacatatagtgccatggaaaattaataccatgttatttttttcactccaattttactaatgtgtaaagctttactataacttttagcttgaatatttgtaaatctttatatttgtgtaatgctttaccataatgtgcaatgctttactacaacgttgaaaccaagatcggcccctcgtcactcatgcaccatgaccacaccctcactttacattctcatcaaagataaagaaaatagtaacaagttcttttaacttgataaaccttagaacaaaatataaccttttttgtcaattatttattaacataccacgaatgttttaacatgcctcgatctatgggttgataggcagatagggtaataatccgggtgtcatcagactggagaaatgtatcacgccacacaattgctcagggagcaagttctctttattacctggttaattgagagctggacaaaatctttttacgcacttgagcctacattttcctctcacgtcgccctcccccaggggtggctcgcgaggcgacgacccgaccgctccctctcccccaccttcatcctccacatcgccaccaccccgagtggccgccggcaaagccgtgcggccgcaaggacagcggcggcggggcttctcgcttctcgctgacctcgtgctcagacagctggggagccgctcagggcggtggcgacggtgattgctagatccgcgctgctcctgcctgatctggcgaggagtcagctggcgacggggacggcgatggtggtggggatggcgacggcgacggtaagggcgagctgcgccgggctgcggaggccgatgacggcggggatggcgaccgcagagaggcggcggtggtggagaccgtggatcgggcgacggcggccggtgggaggagccgtggcgcatgggcgacgccagcagtgggaggccggtgtcacgcccagaaatttagcccaagtttccagactatttcgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggtttcagctccactccacaggcaaaactcaactggggtctgagccttggtcttctaacttcgtcttcagctcagaagcactacacttctgaaaaggggtaataatagcaagactgagtacaaccaccgtacccaacaagccacaccaacgatgcagacgtgcaaggggatacaaggaggggtttgtggctatttgcataaaggcggttgtaaaacattttattgagcaaaacagtaaaacggttgagtaattaaagtaatattaaatctccactgatcaacgctacaccacgttgaacaggcccaaccaacccacctgaactacagtgcattgggtcgatttattaagatgggactaatcacggtgaatctggtcgaccgcccataaccgcgggcacggctattcgaatagttttactctgatcagaggtgtacaactgtacccacaagacacagcctcccgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccttctcgtgcctaggtgaatccggaagccgcataggccgtcgcagggcccatccaaactccatcacgcccacccttgcctggatgcgttggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccagatgtctcgagcacgcagctcattctgatattaaaaggtctaatactgtaattgtcctatcaactgagctagtggtaattaagcatggctaagcatatagttctagctaggtcatcaaagtaacacaagctaggcgatttattacccatggttgacaaaggacagatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgatcttccgaactcttatccttgcgaccgcgatcttccgaaacgacggattctacacgctggcacgcaaaacgaggaaaaactctaataaaaaccaaggaaatagtatataaaaagtaaacaaacatgtagagctcaattttagatgaattttgcaagttgaatggcccaatttggagttcgtatgaattagatatgaattttagaagttttgagccatttaaatgaattcttagaattaaactcgatttattgcgcaattattatttatttttccaaaggaaaagagggttgttgacgtcatcaaaggggaggggcggcgccggcaagcgggccccaccggtcagcggcacaagggcgtcggtccaccgtggaccgggaccaccgaggcggcccaccgccggtccacgggaaccgacggcccggatcggcccaaagccgatcgaacggccacgaggcggcgcggctggggcacggtgtcacaccctaaaaatcctaaatatataaattgttgtttaattggaattattagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattacatttaagaaataatttaaattgaaaaaggttttaaaagtcttcttttggctttgggccgaaagtcggcccaaaaccgctctctctctcctcggcccaagtcggcccagtccgccgcgcgcgcgcgcgtccgcccgctgacaggtggggcccacctgtcagggtcgtcgtctacctccagccgccgccgcccgaaaccctagtttcgcgccgccgccgttcctttccaaattcggtcgatcctttccttctccggccgaattgatagagggaaacaatctccgggatctcctctaccttttctcttttggaatcatcggctaattctttttggaaattgttggattcgagttcgaatcggattcgtctctttcctccgaaccctaaaccttccttctcgtcgccagccgccgtgggccttcgccgtcgcctccgagcccctttaaaaggttccccggtgtctcctctatccgccgccactctcgccttcgcctctcgtcgccggaagagttctagcgccgggcaacctagcgccgccgtcgccgccgtcgctccagccgtgcgccgccgccgtctcggtcgtcgtcatcgctcgggaaggccaccgtcgtgatcgccaagtcgccgccattctcgtccgctccttcgccgccgccgaagaccgccggagcaccgtcgccgccgtcaacccgaagtttgccgccgcttcctcctcgtcgccgtcgccgtccgttcctcttccgccgtcgctttggtcgccggtgagttcgccgtgccgtccgctacccgttggtgccctccgttcgtgccaaagcgccgccgttcgccggtgagcttgcgccgtccgagccgtccgagccgccgagccgccgccaccggtggtgatgtcatcgccgacgtcatcgtcgccctctcccgtgagccggtcgtggaccgatcgatctcggccgtccgttttggatcaagtcgatctcggccgtccgttcgcgtgaaccgccgccgtgcgcccggtccaccgaaaccctagcccgctgacgcaataaatccctttttccttttcaaaaataattcattattgcgtcataattcaattaaaatcaatataagtgttttaatccgattaaatcttcaaaaattcataactaattcatcttagctcggatttagttggttcaagtctgtaaatttttctaaaattgagatctacatattaaaaatatccacatgtaccgttcatgcttgtttatgtgctgttttggtgattttgctcttttctgcttagatttcgtcgtttccggagagtccgttttcgccggagaagagtttgaagagttccaaggccagcaaggcaagtcacacagatcccaaacaaccctttgagaatgttgatcccgtttaaagctattgtttctattcaactattgcatttattttcgaatgtcattgggtggaattaacctattcattgttatagcccttttgttcttgattactttattccttgataccttgggttattataacttgactagttgggctttatatattggttcagctagatattaggtataattgcttagccctgcttagaaacattagcacatcatcgggataacttatgactcactattatttaatgatggcttaatgatagttcacgatggtcaatcgtgattgattaattaattaatgtgccaactaaaaccagataatggtgggttgtgagcacatggttttgatggtcgtgcgcgtgacaattaagaaccggttcacgagtttcggttgtgaaacattaaccgtgccaaccacaagccagcgtgggcaacggctttatcctttgtatagcatggttcattgcggggcaccagactgagaagtgacggagataagcccacaggggtcgctggggagtccatgccttgtttataagggggtgattatgatccaggaaggtgcgctgcagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgctataactggtaataatttgattagctcctggtttggaatggtatattcctggtttggagatagaactgtgcagccgggatggttgttcagaatggttgggcctatacaacagggtatgttgtgtagcgttggattaatattgtttaatacttaactgttttattaaattctgaaatgtttgctaaatgctgcttttgcaaatgaaaccctattatgccatcctttattatcctgtgcacttgcatatttgctgcgtggcttgctgagtatgtcatatactcaccttgcaatcattcatcagaggaagagttctacaatgatgctgatggtgtggaggattaggtgtagccttggtcaagctgcctgtggagtggagccgtctacgccgtttatttttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacacacgggcacggcacaaagccggcctagctgagccatggcgcggcggtggcgcggtctccggcgacggcgaccgacgggcggcgcgggagaggcggcacgcacgggagatcgacgcgacgcgacaagggggggtccgggcggcccaggcgagcggggcggcagcgcacggccaggtggacgccggcggcggccaccggcgcggcagcgcgcatgggagacagaggagggatgcaaggagggagaggaggggctcaccaaggacgcggcgacggagggagcggccgcggagggaggcggtggcgctccacggggcgaagacgacggcggcgattcagcggtctccaacgaaggtggaggagcggccggggtacgggggagcgcggcgaacgcagtagaggcggtggcgtggcttggtggtggctagggcggcggtggcgcgctgccggagtcggcaaagtggcggtggagctcgggttcacggtggaatcggtgcccgggtggtttattgcggaagcggagcggtggacgggatgcggcaaagcgcggcgaggccggcgatgcaagcggcgcggcacggggacggcggtagcggcggcagcggccggctggagtcggcggcttcggtggaaggaggtggtgcgcgtggcgacggtgcttcggaggcggggaggggaaatggagcggacgccggggtgtggcacgacgcggcgaagccgctggtggcggtcacgcggaacgacggtggtgggagcggctgtggtgaccggctggagggtcgtcggcgagcggcggcgggaggtgcgacggtggcggggtggttttcgtgcacgggagggctcgggagagaggggaaaatggagagggaggtgtggggaatgtttttataggggaggggaggcgggatcgagcccgagagaggtagaaaccggccggcaacgtgggaggagagagagatgcgggaggcggcgacgtggccggattttgcgggggaagagtggggggaaacggcgcggacgtgggcgacgaccgcgtccacgcacgcgcgggagagggagtcgcgcgggagaggcggcgacgtgggaggatttggcggccatggcggcggttggggatggagctggaggtaggagaagaagatgacaggtggggcctcgggtcccacctgtcggggagagagaggggaaaacgggcgagggaggtaaagcagacttgagagagagagagagccgtgcgggccgagggaggaggccggcccgagagggagagataaggggcacgcgggccgcgggagagaaaggagggattgggccgaaaaggggcccaaagagaggaaggaggatttttttttctttttattttaattgatgcaatgatttttgtgctattaaaactatttctcgagctccgaaaattcacggaaaattccggagagtacattagggcacaaagaatattacaaaatattcccggccaaagattttttttaaaggaaattttaatttcctctataatttcacttgattaaattgatttaacttttaatataatttctagaaatgcattattaattgatttttaatcccgaacgaaaatcggggtgttacagccggcgaggtgcacggtgaggtaactcagctatccagcatcgtgtggtgcggcagagtcagcgtcggcggggaggccaccggtggtttgacggtgctgcgggcatggtggtatctgtaacgatggcgagagcacggtgatggagggggcatcggcgtggcgtggagggtggcaaggcgatgacgggacggtttgatggcgaggatgtgggcaattagacaatgacggtttcggcggttgcactgctaaggggagtgctgtggttcttcgatgggccctattctggacattgtcctcttgcgatagcgcctttgccgacaaaagatggccacgtcgagcaggctagtgtggggagagaggagatccattgtcctctctcatcctctccccatccaacccaactgcatggatggagctggagcgcatcgggggggggggggaggtcatgccccttcttgacggccgaccaacagagaggcgtcgcccgtggtggccacgcgttgaaggttttcgaaaggtggttgcagcaggagtgtgacaggaaactttcttgggaggggtgaaataattatgggcgaaagctttgccttcggggcagcaacgatgatgcctatgggtgccgttttcctctagcgttgctgcataatctcgtttctcccagttactttcttctcgtttctcccggttactttcttcaagtgaaaatcatgtcctgactccctagagcaaaaggcagcggcgctttcggtgtccttcccttattggatgcatcacttcaaagatctttcgttcttgttttcgctctcatggcaggtgttgtcgtagacgcgtgacgtggttgttttttttcttgactatagtcttccaggactagacttgtatttttatcctactttatcaatacataaaactcgcactatcttgtgcgattagttttaaaaaaataagagctggacatttctatcttgccaaaaagacatttatttctggattgtttgatttactattttttggatggtttggatcttatgcaagcccaccatgttgctctggatccttgagggaaatattatgctaatttggctgattgtgccgccactaaaatgtccatatatgcataaaagaaatgcatggatcggcttcttatcaagcctgtagagaggaaaacaccttgtgcgtgtaagcaaggcgatatatacttagtattctgccagagaaaaacagttttaatggttgtccatgacttcacggacaaaagaagaatgttttcaactggaagatatatgtttctagactatcgaaaattgtaaaaaaataatttctataataattcttttgttcgtttggtcgggcaaggtgtgcacattggaatggacaacttgtaatgaactacgtacaaatgtagaatactcatgtgtactaggaaaaaagacaaatatattgtttcttcagtaaaggctagctgggcactggtggccattgtctttgctttctaaaattattttcttcatttcacgaggatttggaattgatgaacacatcggcctctttgtgtccgtaggcagagtattcttattaatctttcgctaatatatatgctagcacaaaaatgtccgtatgcattaaaaaaacccagcgttaattgcaagcccttagtgagttagttgatagctcactgaaattatactgtgagctagttcaacattctgcaattaatgtaatacaggacaattttaattgattagttatgacttatggggaattgatttttttattcggtcacgatatggagaattatactactactacaaccggccatcatgatacgaactggccatgtcgtgctggccgtaattcggtcacgtatcatgaaccagacatggccttctcatcagaccagccagcacgacatggtttacatgtaacaggaacgctatttagcgatcagccgccgcgcgagcgcggcgcggcacgtggcacgcgagacgggggcgggacgcgctgggataggggacacgtgtccccgtttcggtttttcttttttttttactttagttttcaccttttttggtttttcttttttttctttttttatacgtacgatataaagtttgtatatgtgtatgtaaagtttgtatgcatacgtatgcaaacttcgtatacgtgtatatatacgtatatacacaaagtttgtatacgtgatgtattttctagttttgtcaaatttttaatatgtagtacatgtgtataaagtttgtatacatcgtatgcaaatgttaatataccacacatataaactatgtatacatcgtatatgaactttgtatacgtgtatatatttttttatacatataaaaatatatttttatagtagcagtagcagtgtagcagtaagtactagtgtgtgctgtgcagacgactaaacgcacgcccatctgcgcattagcaggcccatatttgtaacttcagctggcacggaaaacgtgaaaaccgaactgaactggtacttagatatatccacacttaaataggacatcttattactcacatatagccactcttaaatgggacatctcataagaaaggatagagcttatatatggaacgaagatttagagcttgattcaacccgaacaataattaatgtacgcacgctgtcatgatgaaacaaattaagaataacttgacaaattttctcggggaggcacaaattttcaacaggcttttctattcttctaattagccatatcacctaataattacttgacccagtattaccttatatacattgctagcaaaccaattcaacctaggactcaactaaggtacctagatatcaagcatatggcatacacgtacacatgtcatatggggattctaagttaatctgacttccctaaagataaaagtttctctcacccatatacatgtgcatgtcatacatatgtatgcaccataaatatgcatctaaaataattaaacaataacattaactctaacatatataagatataattttgtagctggtgacttttttcattcgcatatatagtttacatgcctatatgtatgccttataaatctattaccagaaaataaacttttagatttttcatatatgacttcaaataaagataaactttatatcaaagtttgttctagatattcatagatcttacgactttttatttaacaaccatttgaaataaagttattcagagatccaaattattacaaaaagagtatactttagcataatgatttgccccaaaaagattgtagctttagatatggggtccactagacttctttattgtttcttcttttttatcattttctccttcagttggaccggagtttctactctctccttattttctcgacgacacttcctcaattttctatcgccactcctgtagccaatctagggtgcagcttgggggcagctagcccaaaagaccatgcaagcctccgatggagccgagcatgcaaaccacattaataaagagcatactatagtcttttctcgaccatgctaatatagctcaaccaagcaaaatctacactctttaaaatggttttacatttttagaggaggattgttaggagaaccgcctgccgcctgaaatattaacatagcacatgcaattttgtagtcagttcgcttgtgaaattcttttttagatgaccaaacaattatagaaaattcattttaagtttagttgatttgaaccaaagttctttcagtgatcctacaatattttcatatgtttgttcagttatgtcaagttgccttatataacttagcatcagagaaactaaaaactataacaaagaaaatattgtaagaatatttggttcatgtcaattggacttaaaactaattttatatgaattttcaaagtttggacttcctaacaaaccacatgcgagaattaccctatttacaaaaacatagatgtaaaagcttgtaacaaatacttgggcacacaaacaatctcaactgaaagaatattcaacaggtctcatcaagctctagaattgagactgaaaaactgaaagttatttctataaatagatttaacagcttataacggatattttagccactaaattatctaaaaaaagactttcaactataaaattgtagattttgttgagagctataacattcatatgaaagagttattacatttttctcttaaaaatatattgattgctccaaatttagtctagttccttaagacaaccacttgtgaaaatcaatttctacaaacagtttcatacacatacaaatcaatagaacataagccgaatcaatagaactacacatacaaatctcaccctattttcacaattccggtttttcatgtggttttacactatatatggccatctcaccactatcacaagagagttttcttatagtttgacaataaaacataagccgaagcatctgctcaaacagttatttatagtgctaaatttttctaaaacgttcatgttgccaccacacaaaatcaatttgtagcagaatatatgtatcattccaattgaaattaaacatgcatcattcgcactacggccttatagtacataacatgttttaataaggaaataaaaatatctatggggaatattgatctgtttagaacgaaacttcacttatttattctcatgagtcatgagatccgcagagaacatatatatcaaacaatacacataacaacgatgataaactgaaatatttttatacaaatacaaacaaacgtgctttattttcatgcttgcaccaatagcatgagacatgacatcccatttctgaagaattctcgctgttgtcccgtgtcatggctgataaagagcatttagaagcacacacaacatgcatcaatccacacattattttcatccccggtggtttgcattttcttgtccgcatcgtttgctggttgcattattcagcctggcctgttgtacactttggagtgatcaatgtatcatgaacctgaacaaacagtcaaaatttgttaacgttaatactgttatcagatgaaaatgtcgcatttaatacccatacagcatcgatgtagctagtattgaccctagttgcctatcgttctgtgagttctaaagtgcatacaactcgattgttgctatcactcaattcaaactgccaaatagtatactctttgtatatatataaaatagagtaaagtccatcaccggtccctaaacttggaccgctgtgtcatcccggtccctaaactcgcaaatcgaccgttcatgtcctcaaacttgttcgactgtatcatcccggtccctaaacatgcagttcactcgtttaggtcctccaacttgttcagttgtgccaccccggtccctaaacaggacggtctaaaaactttatatcaaaaaataattcataactttttcatgttaactctaatgaagacaaactttatattaaaattgtagcccttcgcgacctacaactttgtagttgaaaagttttttaactaaaactgtttagggtcccaaaatattgttgcatgtttatagattttgtaattttaattttaaaattacattttgggacaaaaaatgacttaaaataaaaaaaaattcaactataaagttgtagatcgcgtcgcggctacaagtttgatataaagtttatcttcattagagttcacatgaaaaagttatgaactatttttaaatataaagtatttagaccgtcctatttgacccagatgatattcaaatccaattttagagaccggggtgacatagctgaacaagttgcaggacctaaacgagtgatctgcaagtttagggaccgggatgacacagtcaaacaagtttgaggacctgaacggtcgatttacgagtgtagggaccggaatgacacaacgatataagtttagggacctgtgatagactttactcaatagattattcaagtttgtaatagttaatactcaattaaacatgtgctaatattttttcttgttttgtgtgtcacagaacattctggttggttatgcttttcaaaatggaacat

SEQ ID NO: 65974 - DNA, 2425 bp, Oryza sativa
  unsure (1)..(2425): unsure at all n locations
tcactaagtaagaaaaacgttaggtgattagcatttattctagatttttactttaacagcattatcatgcaggaatataatggcccttttgaacaaatttagcatcctttgtactactggttgtagtttgaagaataaagagaaaattccttatgtgcctgtgatttttcttaaccccttctgtacatctttgaattttgcctcatccccaaatacctatgggtttttagtttgatctatttgtacccatccagttagttgaccgttggattttttaaaaatttactatattttcctacacaattatatgctacttacttcaaaaacactaatttaaatgtggaaaacttaatttgtaaaaaaaaattatttgaatatgtcattaaaagggacaaatttatttgatgccaaatttgaaaaaagaaaaaaattcaaacaaattttgaaaaaacaaatgattgaatccatacaagaatttcaccgataaattaattcaggcaaaatattctttttatttgggtttaaatgttggtgaaaatgttgtctgcatttaatcaaatttgacacaaaattatttaaaacttttaaatttcagttctaactttatgttcaaatagttctatctccttgtttttttaagtaaagtgcataggtagtccttaaatttgtagggttgtgtcatctagatcttcaaacactcaaaatgtagatttaggtcccataatttgttaaagtgtatcatctaagtcccaaatcgacacaacccctctaggattttacgtggcgttgatgtggcatgccacatggacgtgacatgtctttttctttttttcttcatttcttttgcttttttttcttttcttttttgttttcttctcattcttcttttttttttcctttcttcttctcgggtcacagagaaaggaggagaaagaaaaaaaagaaggaaagaaggaaaaaagaaaaattttaaatgggtcccatttgtcagtcaaaatgatgccatgtcatgttcgtgtggcatgccacatcagcgccacgtaggatcctaaaggggctgtggtgatttgggatctagatgatacactatgacaagttctcggatttggatatgcattttgagagtttaggcaggggcgaagccaggatttatgattagggaggtgtgggcagggcgaacaaatcataagtcagagtaagcaatgccgatgataaaataacatatcatgtgttctgccattaaaaaagcttgaatttagctcttaagttgtatcattggatgtttgacagtttgagacttgagacatagtgagacacaatgggagaacggagagacgtgtgaagccgaagcaatgaagacgaggagttgatttgcgttgtctctccatctctttattattaattaattttctatatcatgtttattgataatgtactaactaacatgctaatgcgctagttagtacagcagggagggggtcggatagggggttgttggccccctccggcgagatctanatgacacatccctacaagttaaaggatagctcatgcaatttactctttttttttctaacaaatgaatcttattttcatgttggtatctgtgttttttcctcaataagcttgcccataagtattagagggacaatttagtcattctgaaaaaagaataaggtcaacttgcagaatggtacagtgaggattaaaacgaaaactcaaaagcatacagggacgagaaaaaaatcagtgacataggattgataaaaactcaagagcacgtaaagttttttctaaacatgacatgacatggcttgttttttttattcttatttggtttgtagataaacgggagtttgttcgtttcgttgataagagtctgtttggtacagctcccagctccatccctcctggagctggagctcagccaaacaatttcagctccatcaaaactaggagtggagttgggtggagctctctcacaaaataaactagagttgtgcagctgggtttaggcagctccataattccactctagacccaactcctgaagctaaatttaaaagttgaaactgtaccaaacatgctatttaggttgtttagcatcgattaagtttgtaggttattcctgatctctctaccttaattatctacaccacgtacgtctcgatcggtacgtggccataagtttccgttcataacgccacgacatacgtacgtacgtacgtactcattactgcagcgctggtagtactgtactgtgtgtttttttgttgtaacttgcaaagtcaaacaagacgaactttgacactacgtacgtactcctgtacaaatacacgagagaagtagagaacaatgtgccgcgcctccctcacgctgtcacgccccaggtcaagcggtagagtacgtagtacacgtacagcta

SEQ ID NO: 65975 - DNA, 591 bp, Oryza sativa
tttcatttcttcatgttttactgcttagtttacatgtatagatttaatgatgcgttaatgctagtatacatctgcaatgtcatgatttatttatggaatatattaaatcattatatgtctataatctcaacaatccaaaaaccttattataggcactgtgattttacaatggctggtttgccaatgcactgaggccggataaattcaccggtgtgcattttaagagatggcagatcaggatcactctgtggctgacagctatgaaatgcttctgggtgagtactggcaagcctatggaagttcttaatgctgaccagcagaaagaattcgacgaggccactactctcttcgtgggatgcattcttagcgttcttggcgatcgtctggtcgaggtgtatatacatatgaccgacgctaaggagttgtgggatgcactgattgctaaattcggtgctactgatgctagcaataatctgtacatcatggagctgtttcatgactacaagatggctgataaccgttctgtagttgagcaggcccatgtaatacagaccatggctaagaaactcgagcaggcccatgtaatttgtg

SEQ ID NO: 65976 - DNA, 11735 bp, Oryza sativa
gttgagttcaaatgtatttaatatcggtagaaccataaatagacgtcctattaattactccttggtaaatgtcattacgttcaaaacgacaaaaaatatagaactggagggagtatatgttcgaattcatagttaaaaattggttttttctggaacggaatggctttggaagtgctaactagcggctcaccctgttccttgcaagtagtagcatcctgcgggtgtaaatatgtctcacaagtcacaaaagatttcccggcgacggtaaacggtggggcgcttataagttataacgtcctgggaactatagacaatagatatagatcatgctagttatatatactaggtgaaataaaccgagtacatgacatggttagaaaccacagtaacctattagcttctttttagagcacatggaatagccagtatattttcatagggctagcttttctaataaggtggcttgttgtcttgttgagtgattttacctggttcctttttctttatcacaccctgtgcttgatatgcacaatgttcagagccccacaggacacaaagtgtctgaaaccatttgctcctgagatgtcctacaagtgtatggaagccagtagcgacacgtttctaatgttgaatcggtgatagataaagggttccattatattattactttgacccaatagtttatttaataattttagctcaactggggaatacaagtcacgtaaccttggatatttaaggaacccatatatatatatatatatatatatatatatatatatatatatatatatatatatatacacatacatttgccctatgctccctatcatattccggtcgcttctaatcaattggtctgccttgccaggaaccttcggataagtcccaactggcagcattgcaaacgaacaaacttgtcaattagcaactgaacagttgaacagtatttaaattgatggaggatagcacatctccttgagagtaaagaacggcagccagggaatactaggccaccagacagagaatactagggacctaatcaagaggaattttaattctttccctatttgggataattttctagaacatagtttctgcaggaagaaaaaagggttctgagacacatgatacctttgactttgtcttgtcacatatccttctattattgttacctgtgaggcagttgagtccttagctcataaactaagttttgcttgtctaagaccagcctctgaacatagtgatagcctgacagtgatttccatgaaaccgactctgaaccaaccactgcacttgtaaaaagtttgcctttttaccagagactggaggattcatagtagcaaacaaagtagaagcaaggtgaaggtcaccttacctatactttcctcctgattttcagcaggaaaaaaagggcaagaaagactgagagcagcagaagaggaagatgatgatgaccgaggtcgccaatcacagcaaaaggaaccacaatgaaagctacttcaccgggaaagcagcagtcaccagcagctcggaggagtttgggagcatgacatccaagaagccgaggaacacaagcccgagagacgctcccgtctccccgaaggtatgttgctcaagtctaattttcacacgtctttcctgttctttcatttttcttgtgtgttgttctgactgaggtttctttgtttgcaaattgcaattgatcaggagaagaaggataagattggtgagagagtggctgcactgcaacaactagtgtcaccatttgggaaggtatttactatacatttctgcacttgcttcctgtcttctctcatctttgtgaatcaaactcatgttataaaacttagaagcctgagctcatctggttatgcaaactctctcgctttgtgcagacggacactgcttctgttcttcaggaggcctcagggtacatcaagtttcttcaccagcagctcgaggtacttgttctcgatcaccgcacactcatttctgtgatctttaagcctgcttacctttcgttttctgtgactcaactgaaacattttgcaggttcttagctccccttacatgcgtgctcctccggtgcctggcgctgcgcctgaggtcagctacagctacctacatccttctacctaagtcatcatatatactctgaaagtttaacgaaaattcgaaatgttaaattttggctagaaaaaggaaaactttgtagtaatctttgtatgtaacaagcatgtcaattgctgtgatccaggatcccgaccactacagcctgaggaaccgtggcctctgcctggttccagtggaccagacgctgcagctgacgcagagcaacggcgccgacctgtgggcgccggcgaacacgaccaggcgcaggtgaacggaggaaccggcctggaggctcgggggtctaagaggcctagaggaggaggggagcacttttgtctgggggcggtgtagagttccaacttccaagtgtctgacccgattcatcaaatctcctaacaaagcaaaaactaataagcaaaccgtgtttcactctcgtcggatctcttgcctgtaatatagtagtagctgcaaccctgcctgcaggtcggtgtgagaccgtgagagtgtgctactgatgagtctgtgttagcgccggacatatgtgtgtaatcatcatacatagcgaggtgatagtactagactacctgatgtgcccatatgtgatatgtaactatgtgtctcttcagtaacatgatagtagcagcatgttgctgctagcaaccaagttcaatgtgattgagtacatcagccctgctgtagtttttgtaagaagtgctcagtttctgctagaagcaagaaaaactcctgcatcctggagctaagcagtagcacagatgaagcaaaaaacggcatgagctttataggtgggccaaatctaagcccacaataggcgagcccatcttggttgggcttaccatgagaaggtgtgggcagtttgggctttgccttgggctactagcagttctcaacttttttaatgggagcagcagtatatatccagtaggtgagctgttcaattaggctgttcaactggggggaggctaatgggcgggcgatcgtccagcgatcggtttgtccccctccccctatactcctcccttttctcccccttcctcctcccctttttctttttctactacagtacaccatacaattttttttaaaacaaaagttagaaaaatttatgtatagaaatactatttataaaaaatttgaattcaaattcaaatttgaatcgggtatgtaaacttttgacttataaactttggatctataaactttaggtgtatagaaatactatatatagaaaatatttgaattcaaattcaaatttgaatcagataataattcaaattcaaatttgaatcgggtatgtaaactttgacttataaactttggatctattaactttagatgtataaacttttgtataaaaatactatatatagaaaatatttgaattcaaatttaaatttgaatcggatatataaacttttggtctctaaattttaaatgtgtaaacttgaggtgtataaactttaggtgtataaatttactaaaatagaaaaataatgcggtgtcaaaaaagaaaaccagtggaggggggaggggatggatcgctgccccatccccagagtgatcgatcgccgaacagcattttcgtgttcaactggctcttagcacgtttgtgtttggggcaattttggtacgggtgcactgtgttgtgcccaatttaatggaggcgggccatgcgttatgtttatggcctctgtactgttgttgtaggggcgtgaagcaagcaacggaggccacaattttgatcagctgggccccgggtaacagcgactgttcacaattttgagtcatggaagctcctggcagaaacgcactgattatgcatttatgattgttttttcgttatatttttcggctctatcatggttcctgatggccgtccatcatgaatctatatagattttgagctgagaggctcaaaacttgaagttctaaggtggggcaaggtgaattatttgagaacaatctcgacagaatttggtgtgttatcattgtgtttttcaactccacttaatcgaataatggttgcagagctgtcattcttccttccataaaaaatgtttgaaagtagaaacagtactctcatttttccatggctctcgacttgttgggtccaaaatccaaattacgttacagcctgttccgactggggcactggacgtttgcgagtcatgcgagacgtacagcgtctgaaccgtcagcttctgttcatcaatgcggcaagaatggtaggctggtggccatgccaacttgcccaccacagagaaagttccccccgtaatatcggtccggtcccacaaaaccaacccccgtgttggtgtttagattgacgggcataaagttttaacttgtcacatcagatattatataaggtgtcacgtaggtatttgtcactaataaaaaactattatagaatccattagtaaaaccgcgagataaatttattaaacctaattaatttgtcattagtaaatatttattatagcactacattgtcaaatcatggagcaattaggcttaaaaattcgtctcgcaaattagtcataatttgtgcaattaattattttttagcctaatttaatatttcatacaaatgttctagcattcgatgtggcagggtataaaatttttttttgcgcgggaccaagacaggacctaagataattcaaccccagtgtgagtcaacagtacacacgagaacggagggttatgactcacgaggcgatgaacctggcctccctccttcgctgtacacctgccattctggagggggcagcattgccagcatccattcgccttgcctgtccacgttctgttgtgatgctagtatgctactacccctctgcacaagcgtagtacatctacatgtggcagcgacgtctcaggtcggcctcctctctggctggctctccttggcgtcgtaaaatatcgcggtgccgaagtgtggctggcgtgcgatctttgctgcaaaggagacgcgtgtgcatgcgagctcagggcgacagtgcgagttcgtcgtgaaatatcggtgttcgatacttccagtactccatcacccgcgcaccgcgcgcgccaccggagaagtgcgctccacgacaagatacatgcgcgctaatcccgtactgtatgtggactatggtgctttcgtacaggcatatgacgagatgcaaattaggcagcgccattaatgatcagtagtcttttctgacgcaagttctgtggaggtgagaggtgatcaatagtcgtgctatctattagtgctcgtacctgctaaccagataatattccgtgcaattcgacgtggagctagaattttaaactaaaccaaaattaacacatacgacaaaattttttttttgttagaataaataggctagacccaatttttctattaaaatctcaagggccataaaaaatgttaaatataataataccactctgggaattaaaagtggagtatctcaacttaaatagggagttattggaggctcttgttgacaggttgaggtggggatcggaaagccacacgcgcgcgctctgtgtctctctctcgagatccttttgcaacggttaagaattcgtaacgggcaagatctctcacgcattcttcccatcgctggtagagacctccgattagatctctcacacattcttcccactcgagatccttttacaacggttaagaattcgtaacgggcaagatctctcacgcattcttcccactcgagatccttttgcaacggttaagaattcgtaacgggcaagatctctcacgcattcttcccatcgctggtagagacctccgatcagatctctcttccattgtgtgcctgtgttgtttctgttctccccggttctgatcacttgagcgcacgagtgattgggacgagcagggcctccgaaaccacaccttcgcgcacgagtgattgggatgagcagggcctccgaaaccacaccttcgcctgagatctgcaccaggtaggcaagtgatcaggtttttggggagtgctaccgtatgactgctcctctttcttcctcattgtcgttctgttcgatctgcatcgcgatgtctactggtggcggcgtcaacggaggagcaccaggagcaagagacgcaccgatcgacaacaccaacggaggcaattttgccttacaatccagcggagggacttttacagggtataatatccttctgctacctttgattttgttacatctgtcagtcgcaatgttattgcgttgtctcaatgatgttgatgcttattttatcttaagcatgctcctagttatgtttagttttatcactagatcaccacacattgttcatgtcatgtttattgtcttaatattttggattaaaatatgccgatatatgaccatatttccaacaattttgactacttatacaccgccgctgccaccacccctacctccttccctcctccgcctcgccgctgtccgagcaggctgccgggaatcacaaggacagcggtggcagggtcttcctttttttttcctaaggccacgggggtcggagcccatgatctcgactgggtccagggcagcgacggccatagtagagtggcactgggctggagctgactgcgggcgggggagagtagagtggccacgtcgatagcgagatggtgttgaccggggcaacgacggcgcgacgccaccagatctggcatcccttgctagatccagccccttctcgtccgaatccggcctcatcggtgcgagaggccggctcccgagttggtggcggtgatcaagtaacggggtgcgtgtaggtaacagggtgaggtaggaagggcgcggcagcgggcacgcccatgtgatgccggaggcgggaggaaggtggatgcggcggcggggatgggaggaagaagggcgccaactgggagcagagcatcttctctgctgatggagtggctactcccagctgagggctggcgccgcacaaaggcatttggccaacgggggtaggcccgcgcaacgcgagaggagacacgcccgacgacgacgagaatgtgggaggccgacgtgatgagcgagcggcggcggcgggaatgtgggagaacggcagggaggttacccctgttgatggtgtgggaggtcgatgctgtggcggcaggaaggctagggacatcatgcgtgccacgtttcacgtgaaggcacgcgaaggctggtcgctgggggagggctagtacaatggtatccatgtgttgacggaggttgtccggtggtagagcatggagcgttagctgtggatcgacagggggtgagtagcaggtgtaaaacctagctcggccttgttgtgcaaacaacgacgacattttgggcttcgttttccctattgggggcactgtcgagccatccctctctctctagtggggctgtcgggtgaaagccctatcttgatcctccgagacctcgacggacagcaacgtcggtgcctatcatcgctgttttccctgaagatatcgtctacgaggcccctttgccaaagcccaactccacccccgtagtacaattttgggtagcaactttgctaattccactccagaaaatagagaatacgtatcgtttggcacgactcaagctctagaagtttaaagttagagctagctgtgccaaacggacccttaaactggtttaccacgtatcgtaaagatgctaatagtaattttatcccaaagaacatatcaaattcttcatatgggctagacagcaagagggttgagatactggcggtacaagcttaggaaatgggcggactctaaggtagacattgggacaactcccatctcacactatttgaggccgttttcattttcgctacttttcattttcaaagaaaatcttttgaacctgtttcagattccaatctaacattgtctatttcccatcatcgagatcgattgcaaactatccaaaccgttttcactgcagagtgagttttcaacgcaccctctttacaaaagcggctgtgttactgtttatagtcttgcaactgtacgcactacgcacacgactttcctccgcacgggcgattgcacagccagtacgtacaaccccatccaaagtgaagcgaaaaatcgcctcgtatcacatgcagtgcgcgttctcgttctcacgctacttgcaggttgcaagtggccagagtttcctcgtcgtccaataccccggagatttttccatcttccgcgggccccgccgagctcccgtccaccactcgctcgctcgaaagaccaaatcaatttccgctcgcctcgcgctgcatcgccagagaatccgtaggagatacagatactcccccggtgctaccacggcccgatcgctgtagccgccaagaaaaaccggaaggcctccgtctcgtctccatcacacaaaccggcgcgcggccccacacccccccaaccgtgcgcccgtgcagcctagccatccggtgtccggtcgggcgtgacgcacgttgcgccttttatacgcgccagtcacgccgccgctcgttccgtttcactcatccgccgctgagctctatctatctactagttagtttagtcgtctcgagggtaaattgagctttgtgtgcggttttgaggggagtacatcggcatgaggatccagtgcaacgcgtgcgaggccgcggcggccacggtggtgtgctgcgcggacgaggcggcgctgtgcgcgcgctgcgacgtcgagatccacgccgccaacaagctcgccagcaagcaccagcgcctcccgctcgacgccgcgctccccgccgccctcccgcgctgcgacgtctgccaggtaacgtactcctacgcgcgcgtgtagtagcaatagcagagtagagaagctgcagcagcatgtggctgggagagtggagacgtgtcgctgaggcactggtcgtacgtgttgtcgtcgttgttgctgcaggagaaggcggcgttcatcttctgcgtggaggacagggcgctcttctgccgggactgcgacgagcccatccacgtcccggggacgctctccggcaaccaccagcgctacctcaccaccggcatccgcgtcgggttcagctccgtctgtagcgccaacgccgaccacctcccgccgccagcgcccaaggggaactccaagccgccggcaagcggcatcgctgctgctgctgctcccaagccggccgtgtccgcggcggcgcaggaggtgccgtcgtcaccgttcttgccgccgtcgggctgggccgtcgaggatctcctgcagctctccgactacgagtccagcgacaaggcaaggacctaactaacaaaaccattcttgataacaagattagcttagaaatcaagaattgccttacttgaccgtgtgtgtgcttgctgttgcagaagggctctcctattgggttcaaggatctggagtggctcgatgacatcgacctgttccatgtccagtcgccggccaagggaggcagcacggcggcggaggtgcctgagctcttcgcctcgccgcagccagcgagcaacatggggctctacaaggcgagcggtgcacgccaaagcaagaagccacgggtggagatacccgatgacgacgaggacttcttcatcgttcctgatcttggatgagatgttgttatgtaacagtaatgctatgcaagtgatgtaattttgtatgtatgcaaagaacactgccatctcggttgtactaagtgtgctaagtacatcttactgtgggcgtatgtaattgtaagacaatttgggcccaatacttatcagcatggtgttgggcatgaactatgatgtactatgacatgacgaaagtttgcttgcagcgtgtgttctgttcgtagattattgttgcatatgttctgttcatagaatttttctgtcagatgcttaccagtgatgtggagaatatcattcataatacttaataactacctgggcgtcctaagatagatgaaaacactgagcagtaccgacttaaaattggaacatgacccctaattgaatatgaatagtagaacacaatattcgttcaggagacctgaaaatttcatccttacattccttggctccgggaacaggttacagcgaacatatctgtgatctatgactatgaactgaaacctttggtaaatatgaggctcaaaatagagttagaagatcaacacaacagacctgaacattccttggctcggtgcaattattttatccaggaacaggttacagcgagcatatctgcgatccatgactatgaactgaaacctctggtaaacatgaggctagactagatcaacaaaacagacatgcacggttgaacttgatgaagtgaaaaaacaaaggatcatcactggcccacaatgcagattacctcgccgtataccatttactgaaaaccaccacactttcttataaatcataacatggctaccctaaacaactgagaaacggaatggtgtttcagggaacatgagagcaaacgccagaacctcccaaaccggttgcagtacttcaggttaaatagctcactaaatcccagcaagattatgaaataccaaatcctctccgctctcagcagcatctgtgaattaatacatgactttccactttgttaccgatatatctcagatcttctttcaagatgcttgtgctgcatataaatgctttttggcagtgcacattagatgtcgtgaacactgtgtacaaattcccaactgtcaccttttcttcagcaatgaactagctctcaagaagattttatcaatctcatcaagctcggatactttgagttctttagcagatgaatcggtcctatcagaaagggaagcaatctttcgtagatgctcttcgaaatcatctggttcattgtcattattttctgagggaaacttatccagcttatctagatacaacggttgctccttgctttcctgtacctgctcctcctctgagtccgtctcaaaaatgtcagagagatcctcggattcagagtatgtgatagactctgaagccgaatcagcactaacctcataattttcatcctctagccttccagacccttctatactttctgacaggagatcagatacacttctcttgcgaactgagcaagaagaatattctttcgcagatgtactgtttacactatctgaaatacaagtaatatcttccgctgcattctgtcctttataatctctagctaacttcatctgtgcatgaagatctacaagctcctgctcaagcctgggaatgtaccgcctaagagctcggaggcgttctctgtattttgatttatccagtgcctgattggaaattttaaaattataaatgatgagaagacacaacatgacaactgtttctactcgttttgcatagattatctgccctacactccacctgaataaagttgttgcatgtgtctttcaatcctaagtttagatcccaaatgagaacactatatggaaaacttactgaagcaccttccactaattaaaaggatttactggggctagtagttcttggaacatctgttactaatttggttttagccatttttccaccttgcttcatagttcatatcatatgctaaagatttcatatattaattattgc

SEQ ID NO: 65977 - DNA, 1782 bp, Oryza sativa
aaaagggagggagagagacagcgagagagagagagagagagagcgttgggagagagccgcgagaggtcgagaggggaggggctcggctgaggtggtgggaatggaggtgcagttcccggccgttcccggagaaggacgacgacggcgtggtaggcggcggcgtgagtgtggggaaagagaaggtgaaggagatggtgatgagcagcggcggccgcggcggcgggtgggaggaggaggaggaggaggaggaaggggacggtggtggcggcggagtggatactgtggatggagtttaggctagggtttggagaacaaggtatatatggataagaagcattccgacgcgaatttaccaaactgtccctggtgtgttctcagtagttacaaaattgtatggtcaaaatgggcatttcaccttaaattaatgagaactttaaatttaattttaggctgatttttatgtttcaaatgcaaaaatcataaacaataaaattgtaggactcatcgagatctacaactattgtattgctcctttttacaaataagttcatttgaacaattcaaattttgaattttcaaaatttgacaacttcaaacaaaaattgggttaataaatgatttcaaatggaaaagttgtcagaaccaaagttgtagaactcatcgagatgcaaaatttttattttggtcatttctccgtctgactctatttgaatagtttgaaatttaaaattcaaagtttgagaacttcaaatagaattttttattagtgaacgacttcaacttaaaaagtcatcaacaacaaatttgtataatccatctagatctataatttttattttggtcatttgttcatccgacaaagtgatagtaacattgttcataaaatttacatatctcttatagtttataaccaaaataaatgttttagatattgatgagttatacaactttgttgttgatgacattttcagttgaaatcatttattatttgaaaatgttggttgaagttgtcataatttgaaattcaaattttatataggtcagtcaaactcagatggagaaataaccaaaataaatttggtacatctcaataagttatacaattttgtttttgacaactttttcacgtaagttcgtttagtatgataaaattcgattcgaagtttaatattttgaaattaattgaaaggagggatgtaatatgaacttttcggtgaggaattagcaaaagggctggcccataataggcctagtttcagtccacctctgtttaaccttttttttatttttattttattgtagcattgtgaagtaacacacaaaaaatcatataaatgaacttatttgaaaaggttgtcaaaaacaaagttgtataacttattgagatctaccaatgttattttggttatttctccatttgagttttattgacctatataaaatttgaatttcaaattataacaacttcaaacaacattttcaaatactaaataatttcaaatgaaaaagtcaccaataacaaagttgtataactcatcaatatctataacttttatttaggtcattttacaatatgactttgtttcaataatttgaatttgaatttcaaattatgacaacttcaaacaatatttttaaatatcaaatgatttcaactgaaaaagtcatcaacaagaaagttgtataactcatcaatatctataacttttattttgatcatttcttcatccgaaaaagtgatagtaacattgttcacaaaatttacatatctctcttatagtt

SEQ ID NO: 65978 - DNA, 8893 bp, Oryza sativa
ccaaaccaacgccactgctccacccttcgtgcaaatacgcagccgcacaaaacagcaagcgagagcacggcaaatttctgctcgcctgcatgtatgtgatcatcagcccggccagaagcttgtcgactatagcaaattaatctccacttgcaaccagctgcatgagtcttcacctctctgatctctatctgcatgctaatgcaaatagtacttattaacgcaaaaaccttccttgactatggttaagatcagctaatccataatatttccattccatgataaatgctaaccctccctagccagccgcgcgcacacatttaatcggctctcaaaccaaccactccaaatcatgacagctaaactaaataatctggcttacccaaataaaacaaactattagccaaattatgctacaaacacatgcccccctgttttcggtataagtagaacgtgtaacttttgctttaccgaaaacaccataaaactaaccaacctaaaccacaaccgtcatctcagaacgatactccacacacggtatcggtcctgagcccatccacagttgtcctctcaaaacgatactccacacatggtatcagttctaagcccatccacagtcgtcctcttaaaacgatactcaaataagtactcgttttgagacaatcaagtttcctgtagtacataatgataataacctttcaaatatttctcatgtagtacaaatttcaccactaattcggttgtccctaatgtccacctaaccgaattagcttgattcttaacatttcttagattcaaaatatcttaaaaataacacatctaaacttcgatactgttaaaaataactcatcttatagctcggcaatataattcatcatccaataaagcatatcttaaaacttgtcgccgaacttttctatctctcatttaactcgggtttttacataatcaacgaatggatccctccaatcacttggcttaaactttcctattgactcggttgtccctgatgacctccgtaccgaatcttctaaaccctgctcggccttttctgtgctcaaccgaccagccagcagtttgtatatgaacactactaccatcaactgcagcatgcgtgaccccagccaaataaaaatatagaccatcaggaacgccgccgtgaaacataacattaacacattgctaccaccacacacatgatgcaccacagtaccttcaccattaaacaaaccggcttgcatagatttattatccgaacaaacactgctaattatagccggtttatccactataaaacacacctcaagtcagccatatgatggacaattaagacatctagcaatttaattaaatctaaacattggtcgaaataactatttaacagtccaccgaaacactaaaacttcctattactctatcggactattaaaagtaaatcatcaaaagctacatccctcacaccaacatcgactaaactttccaaaccgaataatagagcatctactcggtctaaagtgcaagcatgctctaaatggactgatagggaccgatgtgtcataagcaatattacttagtaaaattaaaacagcaccagctccttgccaactcacacaaactatatacgaccgaaataatttctaaagagttataaaaaatcacggttatttctagcacctaaatatttcggtctctaaaagtgataacaacacctacaactaatagtcaatgtgtaaaactatacggtaaaatccctccataatataaagacccatatgatatccaaggataagaataaaaccatgagggataaacatgcatacctgagaattgattccatgacataggtatcggtggcataggtgaagaatatgtataatatggtggcgaaagaacctgatgattagatgcaaaccgttgatttggcgcacacctcttaactcccttctcattttttgcccccactccaactttaacatctgtttcattctgtacctgaacacttgctttaagaacccatgccatacctctctccctcagcttttctgcacttagcttgtggagctgcttctttcgccaatttgacaagccatgtgagtgtctcagttggctgccattgccccccgagctcttcggcggattctgacttgttactaactctgccgaagatgcctctcgcttcatattcatatggtgtacatttcctaactgttgtatacgcgcatgccccccaggttcaatagcctttttctgaactgaagcattttgtacactcacatgtgcaccagcagctaagctcttttcttgacctctagacttcggcacccagatttgcttccttgttgaactaccttccgcctgtgccgaagacttcctactagaccacctagaccgatttcttttatcaaaacggtcatccttggcatatgactttcttggagttgcaaaacgcaatcagccttcattaatagccgattgtattttctgacgaaaaatattacaatcactagtacaatgatcggatgaattgtgccacttacaataaattcattcttttaaatctggaagcggttgcatgacatagtgatcaagcaatttaatataaccattttttagcaaatcatcaaaaatatgatcgcacatagtccaatcaaaagtatacttcttttcctttaaccgacacatctgcggagatggttttaaagctaagcaaacaaatggttcagattttccatcaacccattcggctacataattgcttatatttcccttatccattgatttagaactatccactatattagcatcaacctcattaatattttccaattttagttttgtgcttctagctctagatttattataagcaaaccatgtagacataaactttggcaaagatgatatggaaaatctaagcactttactattgccaataagaacattaacctccccaatcgatcccttggagttattcatgatgatattactgatgcaggtatgattttcagataaatgatcaaattgggaaataactacattacctgcagactttacctgatctgatttgttggagaagcattctaattttttcacctgagcgatgtctaggttcgttctttgatggctctccaatattttcaccttgtcgtcatgatttcgtgctccatcgtcaagatgttcatcatcttccttagcacgaaattcagctggcaaaacaaaaggtcctatgtttccagagaaatcaagcatagctacctccttttcattagccgataaatctaaatttatcagcttccattgttgattaaaaattggttttgatcccttgcttaagatatatgcattcattttctcctccacatctctatatatttcttcaataaggttatctatcttggaactaaaatcatccacaaattgccccccaaccgaacttgctaatttggtatcatttgttctatgcgtgtcttcggctttatgcgttgtcgactgcacaaatgacccattttgttgaaaattattaacacttggtttcggcaatggaatatgctcgatgccgaaactctgtggctgtgcaggggacaaactatatgttgtggaattatatggaggtaaatgcttgcttgctgaattttcactaattcggccataatcattaacatcacatgaagccgaattataactactagacactgtataaggtgaaccataagcatgaacatgagcatgagaagtaatctctgatttagcagtatttgacatggcatgtaatgtattaatagaattagtaggataattgccataactatacatgtcattcatcggcatagttagtggtgtagtgacaggtggtgaaataattgccgatgaattaaaaggtgtgtgtacatattgtatattgctagcattactaaaatttaaagtatgtgaagtactttgcataggcagtgacatattattttcgtaattcaaagagctcgaataattatttgaataatcactaccaaatgcaatatgtccattaaaaataggtctagcaatatttatatgagaattcactgtactagcaaaataatttgaaggaacaggcaaagtatttgcagattgtacctcgcaattgacgtaatgaggcagcggtgtagcactcctgtatgactccatgtattttccagcaagtcttttttttttgtgcaattgatctgtacatcaaccaaattttatcaaaataaaacgcagacaagcactgacctgatggcttctttcttcccttctgttaatgcaagtgtgctgctgttgtgtttctagattagcgtacactttatctcaagcggtgactgggcggctagcagaattccagatcggcgtggctccaccgctccagcacggcaatgaccaaccgcgtcagattgatcagataaccgtcagcgcgcgcatgagaagaatagcagatagattatggccgaaagattctacgacaaaaaccaaatagtagatcaaaatattcggccgaactacagccaaatagatcgatggtacaggattgatttccgtcaaattaatatgcccgaaattctcgtccccagtggagtcgccaaaatatgtcgacgctttttcgtggccaacacaagatcacctaacgatttgcggtgtaaacaatagagtcgccaaaatcgatatatcaaaatcggctagtgaaaccgatttcgagattaattcactttcgcggaatcacacgactaatttacaagcaaattagtaaagaagataaatatcgtacttacgtgacgacgaacgactagtttccgagcaaactagcaaaggataacctcctcgctttcgtggagaagcacgaccgtttttcaacgcaaaacggcaaagataaaccaaattctagggttgctagaactcagccataaaagcaaaatagaaaaaacaggaaaagtaaagaacgagaaaaatagtagattgataaattgtgatcggggtttcttcaatcgaccgtagacctgtatatatacagataccatggtccaaccgaaaaggaaactaactgataaaatagaaaatctatctatctcttatcttcctaacagccgtacgcgctaatcacgcctcatcatctccaaaccaacgccactgctccaaccttcgtgcaaatacgcagccgcacaaaacagccaagcgagagcacggcaaatttctgctcgcctgcatgtatgtgatcatcagcccggccagaagcttgtcgactatagcaaattaatctccacttgcaaccagctgcacgagtcttcacctctctgatctctatctgcatgctaatgcaaatagtacttattaacgcaaaaaccttccttgactatggttaagctcagctaatccataatatttccattccatgataaatgctaaccctccctagccagccgcgcacacaattaattggctctcaaaccaaccactccaaatcatgacagctaaactaaataatctggcttacccaaataaaacaaactattagccaaattatgctacaaacaggtcgttagttaaattaatcaatggtaccatcgatatctgcaaaacgccaacacacctactccaaagtatggtacagaatagggatttgggattcgctttgaaatgtctgaactctggatactactggcaaaactattgccgacgaggtgttacagttttcccaggtgaagaaaatgtggggtgagatggccgtccgtctgcgaagattaatcttcctagacagacgatataaggtgccacctggaaagatacatctttatagacggagctttaagaggtccagcaggggaaagattgaggatatttccaggtgaaccacttaagagttctgcctccgaagataattctttctaggtgacacctaacggtatgtgaccattacagttattcaccccctcgattatgatcatatgacgtacagaacaattcctaagaatgtaagtgattctgatctatgcatgtgtactaatgcaatgttcataattattacattctgttcattaatatgaatcataaatcctatacgtacagtgcgtacaactactacaaagtaaagtgcagggaacaaccgcaaacgagtgagaagttgcaagtgcatacatatatattggccggtactactctgcacacttctctatttaaattctttttcctgcaatgtataactaattccttctatatgtgtgttataatgaagtattacaagcaacctaaaggcagtgtcctttacggatagtacatatgcgaatttcatagggttaatgggaggtataggaccaataaagaggatgtaagtctcttgactgaacgtataactctaatagtggaatgcgcatatcaaattgatattgtattatattctcgtgctttcatgtatgcagttgtctacaatcgaacgtcgaactagctttcactacgaaggcattagaaacatacagtgggacctctaccacttcatctaccgtgagtgttgtcataaagatggatttttcttcgaccccgaaggtagcttagcgatgaacggagaatacaaatccatttggaagtggaactacgtgcttgtgtaattaacaatatagttagaaatgatagtattgtaaatattattgtatggccaacacatgatggccaatagtactgtaattagtgcatcaaacatatgtgtattatatccttgttagctgttggatgtatttatgtattgatgaattaattaattgcatcattattgattaaaaattaatattaataaatttgacatgaaaaattatattttggctcgaatattttctccggcggccatcctactcaaatgaaacccgaactacgtatttttgcaagcagcgtaatcatattttcgtaggtgatatgttctgactctgtcagcatggcaagaaatattttcgtaggcggacagcttaggttgtccgcctgcgaagattcatcttcctagatggaccggccggccgcctgcaaaaatgaaagatttcacaggtctttgtgtaaaggcagaccggccgttcgcctgcgaagaccatttatgtcactaaaaatagtattcctaatagtggaaattcagagaatttcatcaactacggtgagctccgagacaacatttaactcccatttcgtctggatttggttcatatggttactatttgatcaactttgtccaaatttttcgaaattcgttcatctcggtggagctcaaaatttttatgcaatcgggttgcaaaaccctgggactttttctattatgagtaaaatacatgagcaggacataaatttagattagggtgtcatctaggtttttgaatttgtgaactacacatatagataattaatcttggtttatcacccaagatttcaaatgtagatgatgtagctctgacggtgatgtggccatctacgttgatgagaattttgtatttaagcccctccactacattatgcctccagatcgactcccatcacgctcgtgaaagagggggcaaagggggtacccggaggacaacaaaagaaggtacttggagccgatattttttttagattataagaaatcaacggctctcctatatcccaagcaccttagaaaatctctttttttagatgggtatttcttttaccggctctatatccaaccggatatatgcagccttattaaactaggaactagcaaatagggaatttagcccataaataacccaatctaaaatttgcttctatggagatttgaacacaggaccttagagtgctactcaaatcactgcaacctgtgagctacttggagctgagatgggcgatacaacgtgtggtatcaccctcgtgctatcaggtcatccatccttgctccgaggacatcatatcaccgacgagatccaccgctgtaaacgcggtttctttgtctcctcttgaacaagcacactagcggactgagctgatcttggtcatgctatagcagagggcgccgctgaatgcgattttattccattgtggatggccaaattagcattgagctgtcaattgcattttggaccttacgtgatacattaaatcaagattagtcccatatatgtacactactacagaaacactaatataagtcggaactataggtactgaaagtggtaaaaaccagcccctacagtgccattcccgcccaccagcccgcccacacgccaaaacgagcaagaactggcacctttgtcacctaaaaggtaccagcaccttttactcctgtcagatatagaggccggttgtaaaaaaaaaactggcatcttttagaacccatcccatcggactagttggcacggggcccaccctagaacctgcatctctaccaagccgagccgatcgagcgccggccttacaatacaacgcgcgcatcagatccgtccttatcctctccgtctctctctctcgttctttccgtctctctctcgcctctctatctcgctcgttctctctcaccggtctaggcggcggccggcagagtggcggtggcagtggcccggtggaggcggcagcagcggtgatagcgccctcccgtctgcctgatgtagccagaggggaggcggcggacctcggcggctgccgggcaacggcccggcggaggcggcagaggcgtgggaaggccaccggcaccgtccctcctcctcttcgtcccaccaccttcctatcgatgctcgggcaaccagatccggcatgccccatcgccaccggcgctcagggacggccaaatccggcatcgcccctccccactggcgcttgggggaggccagatccgggggtggtggtcgaggaggctgggcacaggggacgttggctgtggtggaggccgggcgtggccggaggcttc

SEQ ID NO: 65979 - DNA, 6754 bp, Oryza sativa
tccgacggagggaaggccgccgccgccgcttggccgcctcccctcccggatctgacggaggggaggccgccgccgccgcccggccgcctcccgccgccggaggggagccggagggtaggggaggggggagagaatgagggggggagagggttgagaggagaggaggaggagaaggagaagtgagaaagaggaggagaagtgggaaggagaagggataagatagggcggggaggacgaggtgctgctggccggtggcgcatggggatctttactcccggttggtgttaccaaccgggactaaaaatacatcttatgttggtgtaactccaaccgggagtaaagcttatgttgatcttttttcccggttggtaacaccaaccggtactacaaatagatctttagtatcggttggtaacaccaaccggtactaaagatgaaaaagtacccttgatcttttaaactgggactaaagatgtttttagtcccggtttttaatacaaccggaactattatgaaatctggtcgaccgatcaaagatgatttctccaccagtgtctgtaagattgatataacatatatcactctataaatattttggtataacttgttgcagtcgaatttgaacgtgtatatttgttaaagtaacaaattacatattgataaaatctcttttattttagaacggaatgagtaatctatcttgtcttttttttaaaaaaaaatgatcatttaattgacatgcaataaacaggtgaatgtgtataattaaaagtattttgctgacccgtcgcgcataggtgaaaatggttgtgcggtacgtagtcgatggactgatacaaagcacgggtagctcgcgtggcacatgcaaatttgcgcaatggcaagtagacattagactccaaagaagttcgcgctaattggcattattgtacgcatgcgtacggttgtctggtcgatgttttggattggtcggtgggacggtggctgcctcggtgcacggtaggcggtagcacgggtggtgtgcaaacgtggcgtccgaattcgcacttaaacaagttaacgttgaaacaaaaaactctgaaaggctaagctgaaaggcagagagtgggagagacatagcaagttatacggttgtaccgtatacataatgcaggcgcgatatcttttgaggctcgagagacgagtaatacactccggtttaataataattattattgtagataaacaaatgatcttaaaaaataacttggactactattttctattacaatatatataaaaatattagcaaatatataattttattgaagtaccttttaaaactgatttatacatatagtcttcatatccttgataaatattttaaaaattatttatagtataaaagattttaaagtttgatctcaccattcttcaaaactacaatattatcaaccggaagaaaatccaccggccacatatttgttgaagttttagtagtacgtacactgttttgatttgacaagttaaatagtcaatcgtgccttgatcatcaagtttgacacttttcgcactgagctagtgtcccgtgcggccgtgcgttagtggctcactgtacttgcaaggaaaccgtgtacgtgtggctctacattcaccgtggcgcaattgttttcgaggacgtgcgacagcgcgaaaaggtgaaaaaaaaaatgtgtcaaagggaagggctagatggaatattagtttgaaaaggcagtaaggcactgcctatagttcttaaaagaaaataagacaaggcactgccgttcacggatcggacctgtccgggcaaaccctgcagatgtacatcacggcgtttctgccacgtactcattgacaatttacggttaaacacagaatttctcccattattaattagagcactactgtatagtttaactacggatgcggaaacgtgccgccgtgcatatatgtacattgacacattgtctttccgcgtctttttcatgttcaaggaaagaacattgcatgctctcgtgcacagaatcagtccaagttcaataatctagcttattaccatgacgtcccttgtctaaaaaaagtgttcggctgttgcgtgtgtctcactatagctcgacattgcatgttcttctggtaaagctagaagcgatggatcgaggtgaagcgagagatcgactggcgatgacgactgacattacgttattacgtacctacgtggtcagcgattccaatttctgtgtgcaaaaaacgtttttggccggtcagtcatcgcacatgcatggcagcatgtgtgaccgatcgaccagctgtcgcttcatgtttggaacaacgactgtgaccgattgacgacagtcgccatcttctgttcgcaaatggcgatcaacgtttctatgcagaacaacgtgcatgcatgagtttcaatcgatcaacatgtcgtcaaaggctcaagctgttgctacaatgggaacgagacagtattaagtgtaatatagacaacttatatcgggcaactttagtttgctaccacaatttaccttactggtaggataacaaaccaaatgcttcaataatattttgacactatcaaatattaggattgttggtacattatctcgcattgacacaatttaacatcgaaatgtaccaaagcaagatcatcatcagatcttttcgattattgttcaggtctagcgtggaggcgggagagggttgacaaaggggaagttcctttatttagagggaggctaacgcaacaacggtccagtaacggatggtggatattctggggacggcgagacaagaagggcaatgaatagtggtagcagtagggcatttggatcaagtggttagctagcagcgagtaagagcatctccaacagccttccaaattagactctccaaacacacatatagctaactctccatctaatttagctagttagactagtttcttactctaacagactctccatctatactcttcattatgagtacagtgggacctgtatgtcagctaaatatccccttttcttcctcctcttttctcccttttccccgagtcatgcgaggcaatggctaccgcctaccgcggacggcggcagtcgatttgtgcgtgagcgagacgacgacggagccctacttttctcactttctccgccgccgctcgtctctctctctctctctccggcgctccgcgctcgagagcaagcggcgagcgggaggccgcggcgaccggaggtagtgctcgaagctcttcttgcgtgtgcgaaacaatggcgatgggcatgcgaagcgacggcggagccctccctcgccggcccctctaccaccccgtctcccatctcactggcgccgccgctcccttcatgctgtcgccgctcatccattcttctctcctcagctctcgagaacaggcggcgagcggaaggccttcgcggcggcggaaatcggcgctggaggccggtggcaacgagcgggagaccgcggcgacgctcgctgtcatgccgccctgccgccgcgccctcttccctgatttttccccgcgcgtgcgaggcgggcgacgacggtggtgacgaggcgggaagcggcggcggctccccgtgcgcgtgagcggcgacgaggcgggcggtgacggctgcagcggctccacgcgtgcacgaggcgggcgacgacggcggcgacgaggcgggcggcgatggcggcggcggctccccccgcgcgcgagcggcaacgaggcgggcggtgacggcggcggcggctcccgcgcgcgcgagtgggcgacgacggcggcgacgggtcccaagcggcaagcgcgcgaggcgggagccgacggcggcgaatgacgaggaagccccaccgctgccatggtcctctgctatttgggcaaagagagatgggaggagtggtgggacccacggttggccagccaaaatgactctctaagtttggccggtgggtgctgtggtttagctagccatatggcttagccaaccggatagagaggctgttgaagggtattttttttcttcgtatttgccaaaatttagtttggatagccatttggccgttctcttggagatgctctaacaacaacatatgtagtatagtagcaggagtttccagtcgccgagtatattgctagttgggacgcaaaggatgaagcggttgcattggtcactggcacaggaggaagctgtggtggtagttgtagttgcagtgagaagtggacatcatcatcgatatcaagggtgacggcatacagggacgaggcacataaggatgcatcggccggcggtgacaccgaaccaaaatggatgaaaattcagataatcagctaggtagggatctttttagaggaatcgatcaagtagggattagatacagtttagcgttttagcgttctcatcatgtgtgccttttttccacattcagatgcaatgtcatgctgcatatgaaaatggtacggtattcagtagtacaagattatcaactatttctccaaacgaatttattttcacatgtgtgccacactgtgtgctaacttgtgtggggcttgtaggtagcattagaccatcaacctgtcacattagtaaaaaccatttctcaaaccaccaaaagaggattgtattattgtttgcactgatttttcaagacaaggaaggtgttattgttagttgcgatctccggggatcaggaaaccgatccctactccgcctacgcgccctgatcaggggagccagccgttcgtggctgtgggcccctctcacgcaacgcaatactaaatagggggagctgccgggcacgcgaaccaacgttcgccctgtacttggactccccacacaaaccctagtacccaccgatccgggataggcgctgaagtgaggggaagcccgctacagccatcgcccacaccaacaccgtcgtcgtcaccgatgccctcacactgccacaccgtcgccatggctgcatcaagctctaagaccaatgaaggtatgggttcctctctctctttctctaccattcattctctaaggcaaccaccattattccaatgagcaaattacccctagatctgcaccttagggaaacctagaatctaacagttctaccccgttttacggttgagggagacgattcaatcaggagcaagagataagagtgataaagtagactcattcccaaaatgttggctctgcaagggtgttgaggtttgtgatggcccaatactaagttattaacatagtacgctccatttgtttcggcctagcgagaagaaagcctttgcaaaaggctggtaagcggtaaccggtaagcctataaacaggcccaccctagtctgaagtacccattaaaaatgaactgatttatctattcttgatatctttaaccaaccattcttttttttttctcaacactgtacaaactcaaattgcttatataaccatgtacacacttatccttataaatatacacacatatattctttccgtatgagtagcttcaaagaatattatagatatcttaaaatttatgaaataaatacaaacctaccgttcaaataataattaaattgaaaaatcgtgttttataaatactttaattttgcgtaacgttgtatcacactcctcttcttttctttttcttttttccatttccatatttcgatctcaaataataggcgtggtgtagtacatggtgtcattggtcaccacatatatatttctgaaagtgaaaaaggcaaacatatttcggcctcaaaaataaaaactactagaaaaaagtccatttcttcttggtcgctttgttggcgaggccggatcagctccggtcctccggcggccgcaggaaaaggaatggccatgcttgtccgctctccaacttctaccctccccgcagcgaatcaccggcagaaatccggcgtgctcctccggcgtccaacgcgccgctccgctcgccgtttccaactgcacgcggagaagcccgcttcccctggcgcgggcaacgagacgtcctccagctcggagaacgccgtcctcagggccgcctggtacggctccgagctcctcggcatcgccgcctcgttcttccggccgtcgcagccgcctacggagggggacagcgccggagccgtagaagaagcagcgtcggagcctcagggccgcgctcaggtcgccgaggctgtcaaggatgacttcgcgcggtcatatttcgtcacaggtcagcgacggactgtgaaatgcttaaataactcgagtcgtttctgatgaacaatcgatcggtgatgcagcgcgcgattgtttatgtaattttcagagttttgtttatcatttaggcttcaccgtgcacatttctgtgtttgcttcctacttgttgcagggaatctcacgctgaaggcttatgaagaggactgcgagttcgccgaccctgcaggttcgttcaatggcctgcagcgcttcaagagaaactgcacaaacttcggttctctcttggaaaaatctaacatgaagctcaccaaatgggaggatctggaggtaccacgatttaacacatgctatatatctcgttgctgatgcttagggcaaatccactaacccatcttgctgcggctgctgctgaagatgattcatgattctggacttgtggttgcaggacaaatcaattggacactggcgtttcagctgcgtcatgtcgttcccctggaggcctattctgtccggtaagtgcgtgccatttaacatgtccttccttgctttct

SEQ ID NO: 65980 - DNA, 4164 bp, Oryza sativa
gacggcctttatttaaagggccgtcagagatgagttacctgtgacgggtcctaactcgccctaggctagcggagaccaacacctctgacggccttctagtaacttgctcgtcagaggtgggtgtcacctgtgacggccggccacccgtcaaaggtgactggactcaccagtgaccactgatcactcaccatgcgcgaagccgtcaaagatgagggtttgggctcgtcacaggtgaccttggccagtgtagtgaacgtagtgcatgttctgtcaggaagagttcagtatttttaagaaatacaattgtgtaccacttgggaggaatcaccatggtgatgttatataaggaaaaaatgatggcgtatatattaattgatttttcattatttaaatgtaccgaagcacaaactagatcaaatttgtaaaacttcaaaagtaattattaataaatcaaaatgttgaaatggacactcgctaggtgttaatatgcaatttatttgattttggactttttccccctcttttccgcacagtccatgcactcatttatactgaaattttcaaaacataaaaatatgctctagcaagtcacgatgacatttaaaaaccaaggatgtttttcttataaatatatatagtggctgtcgacgggttgtacccatctatgggatttgtatagggtgggaaacactcgtactaatatatatgagagacaacgattaagtaggtggaagacaagtgatttatatatatatatatatatatatatatatatatatatatatatatatagccctaggaaatctagttgatgaaactattgtctagtttggtgccaaaattcaatcagcgaaaatgataaaatttgagtttaatttctagaactttttgcagccaaataatctgcagcaaaaataattgcagtgtttttagtataccaaggtcatgacgtcctctaggcacaacaaaattaacgccacaattggaacaccgtacgtagaacatcaaataaattgatcctcgctctgtgtgatgctctatctgcactgttccgatgccttgtcaacgtaacgctgcatccgtgcacgcacctatacttggctgcgttcgattctgtccgtcgggaactcattccctccgcatagaaaaaggatcggtttattaacacatgattaattaagtataagctatttttttaaaaaatagataaatatgtttttaagcaaattcatatataaatttttcgcaaaacacgcatcatttagtagtttgaaaaatgtacatgcgatatcaagttgggaaccaggagtgctgaagacagcctatatatagacagtatgagtacaccaccttagcgagcctttttaagttaacgctcacgttcacacacattctactgtttgcccgtgttattgcatcagagcaagtttaatagtatagccaactactaactccaattcatttatagccaatctaatagctcgtccatacaatagttatatactacactattaatacctagtctcacatgtcatacacacactgcgtcttgaagtccgtgctacaactggctacaaatctgtagcctactgctcttctctcttcttatttatccccttaaaatatatttgcagctggcttatagcctgctattgtacctgctctcatacccttccacaacctgtcatctgttgtggctttggttgattcgaacattactagctttcgtctatttctctagttttgtttaccaatatgtactagacacattttactggttgtttttgttactcacatgttcgggaatgttaactaagggacgggcataccactctggcaatgctatggtggctgccattgctggccggtggtgagatcaaccacacccctgacttccctggatcctttctccatcaactgcgatggcccatgccgggagtgcatggagatatgaaagacaatgaacaccaccgtgacgttaccgagctatatttgtttactcaactccaccattccttaaattttaggctggatccgccattggtccaaatgctctgttttttccgaacatagtgtcagtgcattcatgaagaggccggagatatattcttcatcctccacgatcttacaaaaatattagctgaacacaatcatgaatcatcaccattaggtgtccaccaaaacaaccacttcattttatctaaccggtgttttaatccaggtttatattcttttttctggccacaaattataatttagtttacttagaaataaatacaggtccataaatcaccaattctgtataaatattccagttttgtaaaattaataatgattttttttaaaaaacccatttatatttcaagaagctgagaaacattaccatcactactaaaatacctctaataaggggctggtcatacatgcttgctggttcatttaaaactagcacctattgaccgtttctcacttctcttgggtgaaaatatgacaacggttcttttgagcaactataggtgttgttctaaataaaagtcagccactatggtatttgtgttggttctttaaaaaaatggtacctataatatattaacaaaagaaacggcacctataatatattataagtcccgtttttaagaaccggcacctatatttatattataggtaacggtttttttaaaaatggcactaaaaaaccagccgaagccatccaagacgaccgaccttatttactcccttattcagtccttatccccatctcttattccgccccctccttctgatcccccctcctcctcctcgtccacatttgctcctgcctccccactcccacctgccccccctcccaaccgccgccacatgcacacctcctcaccaccacccctacctagcatctctgtctccccacctgtctctgttgcgtcccctcagcctcatcattgctgccttcctccttcctccctctcagcatctcctccacacagtggcgggccgacggctccttcgcgcagtggtgggtcagtggcttgccgacggcgcagtggctcgagatctagaccccgagcttaggacctatgtgatagagaagcggcgaggaggaggtctagccaggagcagtggcggcctcccgctcgcccctccctctcctctcatctcctgtgcgatttactttgtgatttccgcttcttgtataatctcccgcatgatttattttgtgatttttgattggattgtctcttgtcttgtgttttattttgggatgattttttgatgattctgattggattgggatataatttttgggtgagatttatgatgatttgggattcagtttttaactcaaaacatcggctcaaattgagccgatgcgttgagctaatctatttttttgccacacatgcacctcagaggtgctgattgtggtatcggcgtcaatggcctagagtcatatgggccacctgacggatgctgattggaaaaactggcacctatggaggattctcaactggcaccaaagtccttacctgtagtagtccatactgaaattttgattttttttttttacacttcatgacttaatactgtctgcttttgattttgcaattgttttcagattttttttatcaatgttatagtatgtgaaatggatttttctcctagtgagatttttataaattttaatgtctggatatttacagtgatactacaacagaaaaatatatggttggaagacttgtactatataattcgtggagtagttgcagttgcagctaggaaggtgcaacgcattcatgttatataccacctccggtttttacaccattgacttattgacaatcatttctcttcttaaaataacatataattacgatttatttcttgtcatttgtttgatcattaaatactttaatcatgatttgtactttcttatacattacttgactgcgtgaggtacagagtttgtgaggatacgtgaataagatctacgtgttgtcaccctcaaggtatatcaagtacgaacaattttttttttagaaaatgggataaacccggcctctacatccgatcggatgtacacatccaacaataaaacaagagttcttagactccaccttacaaaggttcacaaaccaacatcatgacacatcaacaccaacacaagag

SEQ ID NO: 65981 - DNA, 10664 bp, Oryza sativa
  unsure (1)..(10664): unsure at all n locations
aggtgtgcaggtcggtaagtagggggacgaagaaatgcagtcatttttaggagcagagagagagatagagagagagagagagagagagagagagagagagagagaacacacagatgttgcgtcgttgtgcctgacgaactgacggattttactgtcgtccaggcatgtcgagcactggaacgtccccaagatggcactcctgcggcagattttcaggccgagtcgatgggtatgggagaaacgcaccgacgaatgaagcatcggtgttcatcgtgaactaggattatgcatgattatactcaatggtacctggttaggggcattagtagtactagtaccttgcatggaccgcatggtagcctatcaggttaaggctgctcgctcctgttgtacagactacagactacaagcagtaatagatcgaaccataatcattttagttctgggagattaaaccgtattgggacatccttcaattatctgttctaatctaaacaacgccaacagaaggataattagcgatgggatatctggaatcgtttctcggatgagagtctgaactctgaataatctctgtagtttctcttgtgcaatgcaactgcagcatccccgccaggtttcccaaaccgtcagggccgggattaccacgtccctgcggtaagcacggttaccgcgtggtaaccgtgaaaaaccgtacgaaaccatacaaaatttatcaaatatttaaattattctttaaatttatttgaatttaaagaggttaccgtgggttttttattactgtaccccgtggtaagactggtaaccgacgtaatgtaaactctgatcctcgcaatccaggaatcggaatcctcgaaatcaattgaaaactctgatccccgcaatccaggaatcggaatcctcgaaatcaaatggactgtaatgtgtaacgtgccaggattacacatagacccccttcgactgtgtggttccagaaccttcctagcctcgacgggaacgtactgtgtcgcgccttaaacaggcccggcccatataagcagttgggccttctagggtttcttatgtcgcacgactttataagtaggtgtggtgcctgctaggacggccgcaatctttcttccacggcagccgcctcttctggtgatctttttctcgcttctcctgactccctgcgttctcaattctttcgatttgctgcccttgctttgatgttcttgttcgcatagccttctctctcgtggtatttctgaagttcttcggatgaatccgcggttagttagtttgtttgtgttttctgaagcaacagttttgctggtcaaatgatgagagatataactgcaacaatatgatccatgatgtgattcttagtatttaagtctctgatgaccacttcgctgtttctaatggctgtactagtctactttttttttcaaaaaaaactttttgttaaaccggtcctttgtaggaagtgatgaagaaaaggttggtccgtgtttctgatttgtcagtgactgataaccatctctctttgcttctgatcctacggacaaatgacattcttttgttattattccttaaaatctttaaatccccttatgcatttgttctcttgcactttgcctatgttgttgcgaggatgaattatgaacaaacttcgcatgtcagacttcggagatgcttcaaagcatccatgagaagacatgtcatacgactgagcaatgctggcaccatctgttaatctctagctagataagttttcagactatgacaactcactgttagcggccggagaacggagtccttagaccttaatctgaataaaattaaatatttttcagtactatgaatatggacagtaatattttgggatggagatagtattagctttcaatatgcacttttttcaaacagaaaaaaagttgaaagaaaaagaaaaggtaaggtaatcgtcgctcttccgttgtaatcggatcgtaatgtgctgagtaggacagagcaagtgcagcatcgccatcaccagcctaatgaagtaatggtaataggagtgagcaacaaaaaatcagaacgggcgatcgtaagaagattcctcgcaagctgatatcccgcaacaaaagcactgattaatcagaacggcgattgagacgtgcaatgctactgtgatacactggtactggacgttgacgcttctgcgtgtgtaggatgaaaaataatgagatattcccacgcttaaaatggcaaacaatttttttgaaggaagggaacaaaacaattttgggcttgaacaatcacagccattcgctctattaaactgttcaagacttcaagcacagttaagttccgtctggggcgccatatcactgtgcagcatgacccacttaccaactgagaaaaactgcaggatgtcactgtcaactgtctgtgaactgtgacaaatgggtttcttcttgtgtatcgagtgtttaacagcggattgtgcgttgcttttccgaacgtaggatcagcgttggagggacgtgattggggagttggcaaactgtcgtgctcttgcatcccaaaaggagataacgtccagctcatgcttttcacagcttcttaatcattatatcgtgtgattagttgatttgtgcgctatcaataagctgtccgaagatgcaccacgctcgcatcaagctccatataaatagctgacaccagtacatcaagtcattgctacagatcacactcgctcagatcaacaaacgcagatagagagcgccgagaggaagaagatgagtagagcctgtagaggagagagcagtggcggtggccggagctctctgggctacctcttcgagccggagccggaggatatcattccggatcactcgactaaatccgttcaaggaaccaacaaggccccaaaaggcaatattgttcttggggacaagatggccagcgacgaagcagatcaagaacaccaaggctggctttggcctcccctccttgnaaaggaaaaaaggaaaaggaacctttcnccaaacccccccaaattaaggttatttccttttaagccncccggaaattccctttggggcccttttttcccaacacatctaccatactaaccaagtaggcaataactctggccttcttatcacggtgagtatatatcagagagtatatatacctcttgcttgtagactctagaaatggattatggtatgcataagcataacctgagctatttgtattgagtttgccccactttttttttgaaggaccggccgtccacgagagtccgttgtgcgcctggagggccatcgtcgcttggatttctgtttggtgatgaggatgcctaacgtgcaagtgcaactctacaagaccatagcagtgttgttatgactgtacacctatcctttgcatccatggggtggagcaagatttggcccaagtcttggagacttggaccggggtatgtcttgggttgtgcctctgtatcttcagatatttacgtttattcccaacaatacttgtgctccatgtcctggttttagggatctagtttaatttatgtacgtacgtgtgtggcaaaggtctccgccgtatggtgtgaggatgcgtgctaattgctttatcgtgtgtgtgcatgtttctgtatctttgtttcggcctgttatttgttgcatggctatttgacattattgttgtaaattgttgccatcgagggcataagttgtatttatatatgtgactagtaatttatgtttggatgatcttctgtatggtgaaattatggaccacatgtgttggtgtgttttccggataatatggattcgcctaaagattatggtgctctccactgttggtagaaaacaatttaaaccgttaatcttatttgatcgaacgatttatatctatatatactaccaccctaattagcgggagtagaacatggtttagaatgtgtggaggggtataatcgtcatttagtaggaactgaacttttttcttctttttttggctttttggatggaacagagctatgtcagtgaaatggataaccacctatcaatctagccaggaaaaaacataaataacaaaatgaccctaatcactgtagtagccaatcgctcaaagatttatggtgttcatgtataaagtaaccaatcgccttaatcttgagaattatcgatcaagatgataagaatatcataaccgactagcggaaccgatttatatatcaaaactagcctcctctataacaatttagattgattttggggtaagcacgtatttcatatgggtaaatcggaaggtttacgggacaaatctacagaggatatcgactttcgtaacaaatacaaacaatttacaacaaaaactataaaaaattatgggcgcatggccatatcgaggaaaacttacgaaaattgagacctaaacatggggagtctaggacttgggcaaccaacgatgtcttggcgttggcaagatgaccagacgagtaggcaacatcatgaggaactcgggagtcttggacttggggggtggcgcgagatgccttggcgaggcaaacaggaggtgccaatgttggtgtctcgcttgctctcgtggcaggcacagtccataggtggagcgattggacagtagaataggcgcatgcaaacgaccaaccgacacaacactatgatagttgagctagtgagctcatctccactgggtccccccaaatttctaaggcgggggtgagggggctatatgatcaaggagattgcacgcgctcatcatggttggatggacaaactaggcaaaaggttgagaaaaaaatatggctaaaaagtagaagatcggtttattgtcgagggttagggtggttattcaattgaatcgaccacaaccattttagggggcggggggatttttatataagcagctcgttcttcatttcctataagctttgggcctaaacaagaaaacatgataactgttttaattggactcgaacgaagttctcccatcgtttagaccgacctccgaggaaaagcccttatctcttccagatttgatctaaatttgtttaaaattcaaattcatgctaaacatggttgtcaacaatgtcaatggtcttgttcaaatgctatattaaaatgggccgcccaaacactccacaaccaagaacgcacggcccatcaacccaactttcatggcgccatggccgctcgctgctgcagcagcgcccatccactcgtttcatcgacgaccgtatcccgccgacgtggacacctgttgttgttgcctaccagtggtcaatttcccaaactcaggtgagccccccaattaacgatcgttgcgtaggagtacaacataagcgcctatgccgtccgaagccaagacgcagacttgcagaggccagagggaatgaaaggatcaccatcaacgagcgactcttcctcctgcaatctgcaccatcaagattgcctctgttcagcgttttttctcacgctttttcttcgtcttttcgtgcgcacttttctgacttattttcttttccgtggcggcgaggcctcacgaacgcgatgagatgctcgatcggtagacaggagggagggcaggcgggggaggcgacagcgtgttcctgcccttcgccgcacaacgcccacaggcgccgtaactgtacacggtatggacatggcacgctcgatccttgtaatttgtactctactaccgtgtggcgttggactgttctcgctgtcaggtgtcaggcccgaccgcccaactttgagaggacctactccccactcgtagtatttgtaccgtttcataaggctatttacaatgctcataggtgacgttcagcctcaaccatctacgtcgaaaattcggcgcatgtacatatctgccattcccaactgaagatcacggagcctaaacgaagcaacccgttcttcgtcagaactggcaagcgtggggcaagacgcggggcgcattgagagggggcatggccctgtgcaacgccaccatactcgtgcaacggtcacggcggcagcacagggagaagaaggaaagatggcaactgcggtggcctagggcggagaagggaagatgccggcggcggaggaagagaaggcggcggatctagcacctaacctcatcgtcgtcaccgttccgccccgcctctgaacgcaatagtgacagatcgacggagagggccgccccgaaccctgcaagcgcaccgccgagctccccccgcgccatccgccaatcgaaggaggaggagaggtggagccccgccgccgccgtcgccgcttggactgcacctctgccgctcgggccgccaatcagaggaggagaaggagaggcggcgccgcgcttgggccgcgccgccgccgagctccgttgcgccgttcgtcgcgggcgtgccacggagctccccccgcgccatccaccagtcaaagcaggaggagaggtggagccctgccggcgctgttgccgcttggattgtgccggtgccactcaggccgccgattgaagaaggaggagaggtggcgccgctcttgggccacgccgccaccgcttgggccgtgcctccgccgctctgctcggctccgtcggcaggagacacttggtgccgccactcgctttctctccgctaggcaaaattgctgagagaggagagagatggagaggaaaaatgaaggagagatagagacgggacccaccgaaaataatctgcattgtggagcatgtgacatatatagttcttaatccacgtgacttgtgaggttcggtaaaaattggtggcacattgctattgccctaagaaatatttgcccttgcagccgttggatccaaatcgaccggcaaccagggccccatcgccttctcgctgacatgaacgtctgtgagccaacgagaaatcacagtcgaatttccccgcttcgtcgtccccagatgcacacgcgttccacggtaagccaccgggcgactcgacgactcgacgtctctttaagtagtagtactacgaccgagccgcggggtctctcgattacactcccccgtcacactctcccgctccatccctgtccacgaaagcgcgcgcgggtaagatacgaggccgggagggaagaacgaccacggcatggccaccggtctctccggcggcgctatgaccagcttcgccgtcaagaagccgctcctcgcggccgccgtgcgccgccggtcgtggcccccgccgtcgggccgcgcgctgccgttctcgccgctcacgcggaccccgcgcagccgcgggctcgggaccgtcacgtgcttcgtgccgcagggcacggagagccagcaggccccggctccgtccccgccgccgacggtgcccgtgcccgtgccctcgctggaggaagaggcggctgccgcggcggcgcggcgcatcgcggagaggaaggcgcggaagctgtcggagaggcggacgtacctggttgcggccgtcatgtccagcctcggcttcacgtccatggccgtcgccgccgtgtactaccgcttccattggcaactggaggtacatctcctcttcgcttctacttccattatagtatgcggagaagtcatcgccgtaatttttgccggacaagatgtcccagtaatttaagtgtgcaaatggttgttgaccgtggttgatatctgtgcggccgtgcagggcggggatgtgccgatgaccgagatgtttggcacgtttgcgctctccgtcggcgcagcggtaagcggccgtgacaccgcaaaatccctgtttgctcgctgataacgtccttgggatgtcaaaattttgcttaattttgacgctcgctggggggttgcaggttgggatggagttctgggcgcagtgggcgcaccgctcgctgtggcacgcctccctgtggcacatgcacgagtcgcaccaccgtgcgcgcgagggcccgttcgagctcaacgacgtgttcgccatcaccaacgccgtgccggccatctccctcctcgcctacggcttcttccaccggggcatcgtccccggcctctgcttcggcgcggtaagcccagcgccctgcagggagcacgtaacgctctctctggtcggccgggcccacctgtcagagccatccaattgggatctgacctgccacgtgtccgtttcttacagggcctcgggattacgctgttcggcatggcctacatgttcgtccacgacggcctggtccaccgccgcttccccgtcggccccatcgcgaatgtgccctacttccggcgagtggccgcggcccacaaggtacgagaccaccagctgctcactgacgtttactgcaccactactactagtccacgctgctactactactactggctagagagtgtacttttgctgattttctttgtgtggccacgagcagatacaccacacggacaagttcgagggcgtaccgtatgggctgtttcttggacccaaggtgcgtgactggtgcctatgcatttgtcgtctatatgtgcttgtgaccagtacatgacaaagcaatcctggtttccttgtaccgtcttctcgatctcaacgtgtgtgtggtcgtgcgtgcaggagctggaggaggttggtggtctggaagagctggagaaggagcttgcgagaatcaaccggagcttgtgattttgacggcggcaattgcagctagcaagactgcgcctgtcgagctagcagaattgcctttgccttgcaagattttttgtatttctggccgcttcgtcgactccattaattgtcggtaccggagagaaggggactccagaagcggaagcgcttcgagtatacgacgatgtggcagcggtgaagagcacagtatatttgtttgattgtggcctgtggcatgcatgcgtctctgcggctgaacattgtaaggaggatgttctgtgggatggttattctttgaatttcactgcgccaacgtttttggtggagacgttgtgcgtccagtcccctgtcttgtaagaagcaccacattactgtgtataacacatgttagagattgttaaccacttcaatgaaactaaaataggtggttggcaacaatgctgaaatttcaggactttcacatctgtcttgttcagtggtgcgccgcatatgcgaatgattgtccacattgctcccggtcattctacgcgactccatctttattcgtagagggtatgtagtgcatgccatacggcccatactggtattacgtgacaattcacaattttcttattgtctactactctttcataaaagataaactctagttactaatctagatacgcatgtatctaagatttatagttaggattgaacatttttttttaaaacggattgaggtaaaaaagaaaaactcaccatgtgagctcgtttttcgtgtgtgctactagcagcatgatctcggggtcagataaggaaatcacaaaatctggtcattgattagacagccatggagactgggaggtaaaaaaaatataaacaaactaaattgatcacaacagaagtatatatggtcaacaatatcaaaatattccttgttcttgaaaagagagttacatgtatcttgtatttgtgaaatcaaaatgcgttttgattattattctgtgacgaacgattgacatctatgattattgattttgatatttggagattattggtgaagtggttttggagatgattgagttttcaggtgatgaacagggttactgttttgtcaggaccggattctgtgtcggtttcggtttcgggttgtttgtttggatatccgttattgtttcatgtttatggcttctagatggatactatgcgtatgtaatattgttgtttgctaccaatgagttaagttggagatagcttggcctcggaatatggtttctttgtttgattcatgtgtaggtgacttgatgtctcgggaaagtattgccggtgatggattgggagtcaacttggggaaaaggcgatgtccgtgacggtcagatatcatgcaggatacttaggctagagttcaatgcacgtggttggtgaatattccatatggcatacgatggaggtattgtgtgcgtatgggatgcggagtcgaatttggaaggagtccaaatttgatatgattggagtttgtaaagtttgtttcttgtacgggaaggtttcctaggtggattaggacttcatgtataaataaagaggaagcgtgaggcttatcggtatcatttttgagagcaattgagttgtaagtttaattagggtttcgagtttagtcgagattttcgtgaggagtgctgttgttgcactttataaacacagagagaagtaataaagttatcatctactttgagagttcttcgatttatgtttgctcggattcggcggtctaaccggcaagacaccggcggtcagactggcggcatacctgcggtcagaccggtgacgacgacaggaggcataggcgatcttcaggcggttggactgggcgatcaactccagttagaccgatggtattagctcggtcagaccggcagatcaattttggtcagaccgcgatccgtcgaatttgagggtaacttttaattccgcaaaaagtttaggttttggggtatacgaaccattcaccccctctctggttggcctagttcttatgtttttttgatcctactgtattgcgaggggg

SEQ ID NO: 65982 - DNA, 804 bp, Oryza sativa
ttagttttggagccattaaagactacatcatttctacaaagccaaaccgcccaacacagagtttctataccaacaaaaaattgatgtttaagcctaggttgaacaccattcagccaattacaaaaaagattagcaatgctagtaggcggatggattccaaaggttatagacacaacattccagattaatctaaccaaatgacaatcaataaaaagatgttgtatcgtttcattagaattatagaagcaacacttagtgctacctttccaccttctttttgcaagattatcttttgttagagtaacctcaatggaattctaagctcccaaaggaaatatttccttggaattactccgttaaacatgagagttctgtacatggagttgatggtaaatgtttcctttttattggctttccacacaaagacatcattttgttccgtaagttgagttgatataacttttgagaccaagttataccacgctgctaggttatcccctacaatagctcttctgaaagagacgtttaggggcaccttttccaacacttcggccaccattacattttttttcctaacttgattatacaacgaaggatacatcttatcaaaagaggaatcaccactccaacaatcctcccaaattctcaattgtgtgccattacctacttgaaaagcgccacaagaaagaaaagagttttcttaacctccatcagccctgcccaaaaatgagaatcccctggttgttttcctacaagtgtaattgttttcttagccacgtatgttttttctaagtagcttttgcc

SEQ ID NO: 65983 - DNA, 4961 bp, Oryza sativa
gctttttccagtgcaaatgcatgttcaggatcactccttgatatattccacgtcttcctacaggcacataatttttacttttttgacccatcttgaggaaatagaagtgctcttcaggtgtaagcacctcaggatcatgggtaggttctgatgggtcatccggttcaatcttcgtcaaagctgcaacaagtcgttcttccttgtttcgagccttttaagggccattgcaaaaggaaacaatgaaagaccaatatgttagaggagtgaagattccacaacagaaccataacaaaaacaagcaaatatactttcattgtaatgtgaacactggcacatagatattgttgcaatgcattgagtatagaaaagacaatcaaaatctaattagactcttcggcattgaaaattttcatcatgagactatactcatgaacataatgaatgatgattagcggtgtgtggctttgcttctctgatatgctagctttctgggtgggttttgcctgtgtatgacaatgttcttgttttgttttctatggtctgtgaccgtaagctggaaaacccagcaagaactacagtacttgttatgctttcttctaaagctgggcgtaatgccttccctctaaaaataactacttctgtccacaatgaagtttgggtatccttgtaattcccaacatggcatgacatggaaagcagtattaaaaaaatactcaaggtcaagttaaatttgagtagaagtaactctttttgcatgaaaaagaactcaaatcaaatatatgagctacaaaacatataaaggcaatggcaacagaatttactagcttcagtttgtacaaaatcttctcctccgcagtcatcctttgaaactcccttttcttcttccatctcagggatttcaaaaatcttgtcactgccctccttccttttaactttttcctctttgctttgggcctaccagattcatcaaccagcgcaacatcttcttgtttctgctgaggttctgctatggtatgattttgactattgactggtcggcttgtatggatacagcaatatatttgaaggttataactttgccacccactgaagaacccaacatctcggtgaaaaaccttgtgggaagtataactacaacagaatcagaactttgaaaaacaaaagagcatatagactcaaactgaaccacaatacgttaaaccccccaagtgtaaaaagcataatcatgagaacagtgaattgtgcaaatgttcccgttgcggcatttcatcaaacacttgacagtttcagcgagccactaaagtttcatcaaatacctgcaggccgacctacagcagcaatgattggaagcgcaaaactcaggtatccaaatcctcctacccctgatacgcacttaatacattcccatcgagaccgctgaatgtgaatcagagacagaggaaggggatcgatgggtgtttgttttcgtctcttacgatggtgagcaccgccgaggcgcgcgcagctcatggggaggcgccacgctggtagaaccgggggagggataaagcgcccgggacatcggccgccaccccttctccatcctccggagcaagagcacccggctgcccatggcccacgccacccgcgcggcgcagcgagagtcggagaaggcgcgcagccgacggggggggggcgaggagacccaccggcctccctcctcgggggtggtgcggtggcctcaggcacgccgtgccggcgtggacggccgagcaagtgcggcggagccgcggcgtgggagcagcctgcactgcagtcgcagggcgtctcgcgtcgtctcgcgtttacatgggctgctctacccactgggccgtacaaaaaccggctgtgcgcgagactaagtaggccgattaactgagccgcaggagttgggccctgatttgatcgagcaatggactctctcgccgtgtgagttgtcaagtggactatctcaactggattcaacttgatatgtcatttttcaaaaaaaaaaaaaaaaaacttgatatgtcattgactcattgtcaccatacgatgtccccacctgtgtttgccatttgccaagtagagagaggaccgaggaaagacggcgttggaatggctaagatagtagataccctcggtcgcacgtaacgaccaagtgaaaaacggaaaaaacctgtcgttcgtcgccgcgtgggtatctgcagcagcagtttcgtgttgacaattagacgaggaaaaattcctacccgagacaaaagggaaaaacggccaattaataagtcttgaccttgaacatgtagtaaacgaagaagctaacacccggacaaggtcatacaaccttgtaaatgcctcagctggattaggtcattatagccaactattgactccaaatcatttatagttaatttaatagctaattcatacaccaattacatatatacatataaacacaattatggtcccacctatcatatacacatgtatcttgtagtccgtgctacagctagctacaaatctgtagcctgctgctcttctctctcttttcttatcttctcgaaatatgtttacagctggcttataatttgctattatatctgctcttagaatcagccataacggtcttctcccattttaccccgcagtctcacagtcacacacaaaaaaagtccaacattagagacgacccaatcagaaagtaaaccgagctaggtagtggccgccggagtggtgtggaaagattattaaagtcagctcagctggcccgtttctagttcaaagtcaccgctgacaacacaaggtaattaaccatcggccgcgatatgccaatacgtagtacgccatcgatcagtaatgtggcgcaccatccaacggttgtaaaagccactctcgtagtctcgtcctcgcgcacgggctacggatgcgcggctcgatcgcttggcgcgcggcgctcccctacggccggggacgtcccgacgtgtacccccgtggcgcgtggaccgcgcgtaataagccccgtaaattaaacgcgcgatcgatcgaccacatgcgcatggccggcgccgcggccgcgggcatcgcgcggtcccctccccgtccggctccgtgcctcctgcgggtcgagagagaaatatacgggtgtgtcggccagccgcgcacgcacacgcacgggcggtgcggcggtgccccgtgcccgtatggtcgtatggccagtacgtggccgtccaccgcgagctgaggccacgtacgagaggggggtgtcgtactggcgtctggcgtcgtgtggtagccggacggctgcctctccagtcggtgtgctgttgttagagcaagttatagccaactactaactctaatttatttatagtagctcattcatacaatagttacatactacactattaatatctggtcccacttatcatacacacactgcatcttgaagtccatactacagctggctataaatctgtatgcttttctctcttgttatttatcttcttaaaatatattttcagctgacttatagcctactattttacctgctcttagttgttacatacagtacgcgcgcgctcgattgtcggcccaagcctctgacgctccaaagacgcatcgaaaacagttctgttgttaatccaaacgagttctgcctcaaggcaggttcgtaattatgatcggtttttgcgaaaaccgtatgttttttaaaccgtcagattccgatttgtaaaagccaatcgattttagttgattttgtttaagttgatgttaagttatatgttttatcggtttttgcttgggtttcgataaaatcaaaatgggtcagtttacatctaaaaatagaaattggtcttatcggttgtctcatattgtctaatggcttattagagaataaaaaataatttataggtaaaactctctctatatatattcttattttatagcgacttcaaaatttaggtttaaaaatttaaattttaactttggctttggtttattagggcaaccaatgagacttgtaaccattgatatcaaatcctgcttgaaagttggaaaattctgacaagcatctattgagtgatcaattggcgagaatataacatgtaaaagttggttttctcaacttcttccttctagtttgttttcttggaaatatggagtgtttaagaaacccggaaattttacagctgccagcagaagctcttcaaccagatcctaaacttatgatgaggagaaagattgggtgagccaacgctttagattcatctctcagctgcagtttatgttttgaagggacgattactataccagtactcctttgtcgtttaggaacaaactactgttcattggtcccgattctaagcactccaaacatgcaaatcgacaccaaaaatttgacaaaaggtacacaaataaggatgcactagaatcgacagagaacagtagaaaatgattttgagatgaacagagccagaagtgcagaatccggacctttcgtggactagcaagcaggggtacccatgcggccatgcatggagaggcagagcaggtgccaaaatgttcacctttacagttttacacgagaaaaaccctgaaaattcagggaaaaacagaatttcttaccaagaaattcttgtacacttagttaattagcaatcccatcaatcttaacgaacaaaccaagaaatttttggagcatacgtggggttacgtgatttccttgaagaaagccagtatctacacctgatctaccagtatgaagcagaagtgaagagatggacggatcagccgagggcggcgaacccgccgccgcgcatcatctggaggaactcgtggaagtcgacgcggccgtcgccgtcgcggtcgaccttgccgatcatgcgacggcactcctccgccgtgcggccctgcttcagccccagcgacgccagcacggcgccgagctcgtacaccgtgatgta

SEQ ID NO: 65984 - DNA, 2258 bp, Oryza sativa
aaaagattctcgtagtatttagtaatgtacttttttaaatcttcatcacctttaattaaaccctcctcttgttctaactgaaaaattttagtcttcctatgcttgccatttgcaatcatatgatagtattttgtattccggtccccttcaattaaatgttttgttttttatctttggtgccatctaatttcctcctcccttaacagatgagctagtctatttttcaagtagttcttgagatctaactcctgcctagtcaatatttgcacctcggctttttaatctaactgatttgcttttgcacttagttcagccttctcttttctatatgtttcacttgtgctttttgcccaacctctcaagaactgtcttaatctatggatcttattttgctatctttccatcatcatagaacccttgttctcttttctccaaacttccgctactaactcatgaaagcctttcccttaacaactattcaagctcaaacttgaagaaagattgtttggtagcatgagtacgtacaaatagcatatatacttgcagaatgcaagattaaatggcaggagatgattggccatacgcaaacttttgttctttaagtatataatttgtttcacgaggacttggatctggcaaaccaattgaattgcatatctggacatcgatgtgctaatttggttttatttccacccatcaataatggctgtatatgcattaaatatttagatcagatagtacatggaatatgcccatgtagaggaagatactatgtacatgtgaactaaatacatattctgttcgctatcacaaattgatcagcccggacaattcagaatatgaaaatgtattcatgccaacttgaatatgtatattgattaaatataaggtaattcaaaactacaaaaatgcatgttcccataccgtcaaaacaaattttcgcatgcaattgggccgtctgcctgctcggaggtgtcagtaaaagtagctatttttacaagcagatggcacacccgtccatgaaattccacttttcacaagcggtaaattatgtcactgcactgctaaaagaaaaatcatgaaaaaaaaaactaaaacttgaaacccaaaacctgaaaccctagcggattcacccttccccgtcacggggctgcccggcggccgatcctgtcgtggtgccacccggcggcagatcccgttcgaagaggaggcggcggacagatccatgcaggaggggagttgagagagaagggatcctgttgtcgccgccaccgagccgctgccaccccgctcgaggttcttgccatcgcctaggtccccacctgtcgatccgcgtcacgaagctcgccgccgcctgcgcgctcccactcgagcccaccgctgcccgcacccgcccgctagcaggctgcaacttgggaggtgtagacaagggagagagaggaggtgagaaatgagagaggggagatgagagagataaagatgaggagaggattggggtgagagagaaggtgaggagataataattaggacttggaaaattttgaagatgcatgctgagaaggacgagagaacggtaggacttggaggcagacctcttaagtggctgtttgggataatgtattttcacatgcagccttgaaccgatccaacagagccatttttgcatgcagatgcagttacagccatcttcagcctggagagggtcttgtctatcaaaatcgatttatgtaatagtgatttaaaatggaattgcgacaaattagcatagcttagtaggcatgaaaaaactactaattggagaatttgtcacttttacagccaaaaaaagatgtagaacatattctatattcagtatcactaattattttttttagaattacacagtacaacgcacacacttacaacgcacgcgcactcacccctatgaacacacacatgcaaaccctacccctatgagtatcttcgaatactgggccggtaaatcctggagagattgacaaagtcaccataggcgcctcgctgtcgacgggtacgtcgcctaccactgaaagcacaatgccgttaaatcctagaaaattcgcttccatggggaggatctcaggtactactgaggctcttgtaaccaataggttacagaccctttcgccagtatcactaattatgactgctattttgttctcaaaaagaaggtgaaggacttgctactatattttttaagacaagcgtgatcaatcatcctttcttcccacataggcaag

SEQ ID NO: 65985 - DNA, 2624 bp, Oryza sativa
cccatcttccttggccaatcccgcgatggctcgtgcttcttgtctccagccagtcggatccaccagcaaagaagttagggccactggatccgacgatcctgtctttctcgctaatagatgtgatggcatctggttgagggagcatgacgacactcagtagcagcggcaagggggtggtggcaaccagcgggcgaccccggctagaacaggatgtaggggaggagacggggtggagggaagagatggccgggagaaaataaattgatcaatatattaatataggaagggtgtagctatatttatggcaccatatttttcaccaaaaaatagtcggtatgtatttacattgtaaatccttaaattacatatgtaattttagtatatttataatataagtctcaaaattacatatgtacgtcctaaaattacatatgtaaattcaaaaattacatattaattaatatgtaggtagggtgtaagtgtggtataagtgaggtgtaatttctgtgtaagtggcttaaaaaaatcgattatagcatgtgtctacataattttagctaacctgatccggggtcgtgcttgattcatatcatgtaaactatcacggcacgaatctttgtggggatcgagtgatccagaaatcgcctgtaatgaagcaaaaaatgtggcgacagtagtttagcaaatccgtataggaaatacttattttaaaataatttgtataaaaacataattttatttttagaaacatatgttatatattagacctaactcgactttgaaaaagtctagcactatatatactaaattacacgggtaaatcttctattacctccaatcccccattcagcaaattaaaggatgtcgttttagcccgtattgcacataccaatgcaagtgttaaatgcagcaaaatggcctctttgcgcctttaggcatcattaattctagctccaatcaccctgttcggcactgcatgcaaaatatattttcgcgggttgctacgcagagccatgagcttaattaagcgccaactggatttgtttaggggcaacatgagaaaattttgcctacaaaacataaaatgacatctatttgagaaaaacaaaatgctaaaacgacatctatttgggagtagaggtaattttcgggctagtttggtttggttctaaaatgtgccctaccaattcactgtcaattttcaatagtatttcttgtcgtttaggttggtgccaaattttaacaacacatcttttagatagtaaaaattttacccatctaaatttggtagtgtcaaaagttgcccaaactttggcactaccaagattttggtatggaagcaaaccaaattggcccttcgtacagatagctcaacctgtcatccatcgaaaaaattgctcgacactaacgactctcatgctcttgttattctactaagacagttttaaattattgctcatcccgacctcaaaattcttttctttaatgaagtccgacactccgatcgacctcaaattcttaaagcaatccaaccaaagatttgttgagtgtttcatttagctttcatcctttacctgcctttgacaaagcctctgcagacttagcgggcgacacgcacgcataagagcactgataagtcggtcgaacgctcttctcgcgcgcacagtattttatcctctggctcatgtgcttgcgccactgcctacgtcaaatgcaccagctgatgaatcgcgtgcgctgatgcacaaacccagcacgatgacacctcgctgcaagcaaaaaacttatactaacaaagcagcagcagcacgcgctgcattattacttgtatattaaacgaaagttagttcctcttagatttgggaaaacccggatgctgtgcggcgttcatcagcgaaccaaatgatagaggcttaatcttctaggctacagctttcaaatggccacgtcactttcttccacgattgctccggggaatcaagccttctcacgtacagtggaattttaattttctgaaactcccatcaaaatcgtagcgcggatcaaagaaaaacgcagtgtgatagtggcaaaatcgcggtggtgatagaggaacagcccaatgccaatccgagatcagtaggctggaggcccatacaaatatagcccaataccaatcgctgtggtaattgtcctgggccgaccacggctatactggagcccatgtgctcaggtaaggccatgacgcttctagcatattcttccggaaatttctggagatctcgaccatctcccacaagccgaacgcaatctgctcgttcgttcctcgcttctgggactacggaactcggaattgaggcatcctgcgcaacttgatacaagtttcaatcaagagattcaaggtacggtttcgtttctgtttctctcccgcgatttgccctgcaatcctgctttccttgtgtcaaaggtacagaatttctcacatcgatcgtagcagatgtgtgttttcctaccggaactcgttacctccagtctccgctattctttgatcgcttgtttctgggcgcctcgttttgaggcaacaaggtggaatatgactttgagtgtgggtacaccttagagatcaggaatctgacgcgtaggaa

SEQ ID NO: 65986 - DNA, 8509 bp, Oryza sativa
ccctccagtttgctttgagattcagtaccgaagttcagtgtcttttgtcctttttctgctatgtaatactgtcgagcagggttgatgacaattactactcctcagaagcatggcaaggaaaataattccaatgattcagtgctcacagaggatgaaaacatcgagccacttgttgcttttagcaggccacctcctttgccaccagttcttggccccttgatcatgctctcacttttcaatatgtcaagcggcggggatgaaaacaaaaattaagccggtatgccacccatatgcattgcatatgttttgctctttactttgtgtcacgatgccatgctcataatattcagtgttttttttcaggaatctgaatgaaatatgtggtttatctccgaccgcataccgtctccagaggtgttgtacatactaagttgtagcaatcaactactagaaaaacatgatgtagcataagctatgcactgtttactgctgtagacttgtatggaccaagtaagctgctgtcaaaactctgttgctaatgtttcagtagcgaattgacaactttccaggctgctgaaatttgttcagttgtgctgatgtttcaattgctttattttctgtgttagctgttcactttatgattcgagcccttcttcaaaacttttcaattgagccaaataatctatcttttatattattaaaacagccttgaaagaagacatcacgttcgctgtgggggctagaaattcttacattaattggagaaaaggaaaagaagagtctaactagaaatgcaatttaaaaatagctgaaattcggaattaaaaataaacaatattgaaagaagagttcatgtaagaactaaatacgagattaattaaaatttagaataaaaataaaataaaatacggaattaaaaaagttcttacatacgagattaatttaaatttagaataaaaataaaataaaatacggaattaaaaaagaaaaggagagttaagtaggaataaaatttaaaaaatagctaaaattcgtaattaaaaataaggaatattgaaagaaaaatccatataagaatacaatacgagattaattaatatttggaataaaaataaaaataaaatccgaaattagcaaaaatagaaaaataaaagaatagttcaattaggaatacagtttaaaattaactgaaatttggaataaaaaataagtaatattgaaagaaaaatccatataagaacccaatacgagattaattaaaatttaaaataaaaaataaaataatatccaaaattataacaataaaaacgatttcaagtaggaatacaattttgaaactattgaaattgaaaataaaaataaaaatattaaaacaacacaatacgatactaattaaaatttgaaaaaaaataaattcataaattagaaaaaggaaaaaagattttaattaggaatacaatttataaataactaaaaatgatgataaaaaataaagaatattgaaagaaaagaccatctagaacacatgatgagataaattaagtaacgggcctataaaggagtagagtggtggcggttgatatgacatataaaaattgttaataaaacaccaaatgggatcctaataatgattaaaaggagggacaacaagcaggctgtgaagcaaacgggcaagacggttgccgggacttctagaaagtaaaaaaaacaaatcccattgataaatcatatttgatttttaaaatctcaataacaataaaaagaagaaacatgggatgggggtgtataggagtatagttgcagagccgccgccggttggcgggacttctataaaataaaaaaaataaattctaacgatcgttatgttcgatttttagaatcccaatgacaataaagagtagacggcgaacgggctgtagaggagcataatggcatcatttgatgggacttctaaaaattataaaaaataaaacccaataagacaataaactctgaaaactacaaggtctaatttttaaaaggtttggaacttctaaaaagtacaaataaaaaacccaatgataatcatgtttgattttaaaatctcaccgacaataaagaagagaggcaacgggtgagccatagaagagtacaatggcaacgccgctgacggtttggcgggatttataaaaagtaaaaaatgaatccgaacaataattatgttcgatttttaaaatcccaatgacaataaagagaagagatagtggaggggccgtagaggagtataatggcagcgtttaatgggacttctagaaattataaaaatgaaacccagcgagataataaactctacaaactataagatccaatttttaaagatttaaaggagaatgaatagaaatagtggtaaatcgagcaagaaaataaaggagatgacagaaataaatggtatttgacttttaaaagctatataattagaagcacggagatagctatataattagatgacagaaggtttggtcttttaaagttttaagacaacaagattgctacttaataaattttaagtaaaatcatactaaatatatatgattttatctgggtgctagccatgcaattacgtgggccacccaagctatataatagcccacaagaattgaagatctagaaagaggtcggaaaagcagaaacaacaacagaatagagcgctgggtgacaagtgttaggcaattttttttttcttataatggaatttattccggcctgtgcaagcgacggccaattaattacaaaggtttcttgtcgaagcaaattaattacgaagattgctagtcgaaaactgcgacttataaaattacaacttaattctaaaaagaaataattcaaacatcaacccaaaacggggaaaacactattggcagcacaccagcagaaatgaggctccaatttgtcttttctgaaagaacaatgtccattttctggagtgccaagctgctttgaaatgccttgttggctgttggttttttcaccgagtgaagcttatggacgcgaaatggagattgctcgccgacccagacgagcagattgtcgcgacgtcctcgagcagctccggcggaccgctcgccatcatgcggacgttcgtgccaccgatctccagcaatgtggagattatagataccccatatctacatgacagttataatttagtcggatatacggtaccaaatatagatagaatatctttatgaggactcgggttagtttctaacttgtatgtgaaggaaatacccgagatcttagtcggttacgattgtattttatctgtgattccatattctgttaagatatggactactgtactttgtaaagcggactccttcccctatataaggagggtccgtgtgcctctcggggcacggtactttttttccagtttatacaatcaataacacactcggcggaatcatccccggacaggagtagggtattacttcttgaataagaaggcctgaacctgtataaaattccttgtctccaaacccatccactttccaagcttgatagccacccccttttattattgccgaaatcttgtttcgacagttggcgcgccaggtaggggtagcgtcaagtttatgccgactaagtgcgatgggttccgtctccggcatcgacgacgtcaccttccctcccgggcaggcgttccggttcggcagcctcaacttcatcaccaacgacttcggcaagatctctctccttgactcggattcgaaccagtcggggagagaccaggtccccgcgccgttcggtattccgaactcggccgaggcctattctaagatcatctctcccgagtcggcttcaaaccactcggacgagatccaatctactcctccacgaccagatgaagacggcgggtcctatccctcaatcctgatgaaacttcctgatgatttggccactgtcttcacaaccaagacatctcccactcgaagatctaggcaagctccggcttcggccccgatccaatctagatccagggaggttggtgttatactccaacctcttgggacagtctcgacggaagagttggatggctacctcaactcccccggcgtcagttctcgaccaaccgagatcctcgactacgacgacttcggctaccactacgaccaaggcgacctcgacaacttcgacgacagctatgaggataactacacgcccctcttcttcggcgtattcatggatgacaacgaaacggaggaacagcgccgagcccgagaagcggaccaagatcgcgcacggcaagaagctgaatgtcgcagactggaggaagagtgacagcgacaggaacgagaacgactacagcgtgagcaacaagatcgcgaacggattgcaaaggaggctgaagatcgacggcaacgtgccttggaatctgggcggcgaccgagagagctcattgggcaacaagacgtcgatggaacaacggtctttcgcaccccccagcagaacgcgattgcagcaatcactctcctcgacaccctcctcaaggaagacgcactcaaccaaactgatcatgttgtcaacatcttgaaccagacgaagaccatgatcgctgcctcggttccagccaactccgcaagcacccgcaccccgactggtagccgagtccctcatcttcgatctcaagactatcaccagccaagcctcagcattgccggcgtcggatctagtcgcaggagcaggggacatgatgaacggtctgttcgttcgcctcccgaacgatataggaagcgtcgagttgaacgaccacactccccacatcgaaggcgccccatcgatcttcgcgacaccatcaaccagcgccgcgcagcaagaggccatcattcaccagatcgctacgacgacgatgtggacggagttgctgccttcacaagcgatctgcgtcgagtggattggccaaccggctttaagccgactagaatcgagaaatatgacggcaccaccaaccctgagtcttggctcaccgtctatagtctcgcaatccacgcagcaggaggagacagcaaagccatggcgaattatctacctgtggccctagcggattctgcccggtcatggctccacgggctaccccgcggcacgatcggatcatgggcagagctacacgaccacttcatcgccaacttccaaggcacttttgaacggcctggtacacacttcgatctctacaacatcattcagaagtctggagagtctcttcgagattacattcgacgcttctctgagcaacgcaacaagatctccgacatcaccgacgacgtcatcattgccgcctttactaaaggcattcgccacgaggacctagtcggcaagttcggacgcaaacctcccaagacggtcaagcagatgtttgaaaaagtctatgagtatgccaaagccgaagatgctatcacggcgttcaagcagtcgggcatcacttggaagccaaagaaggatacgccgaccgcaggagggagtggaagtaacaaccacaaggatcgcaagcgtaagcccgaagaacttgtggcaacgacctctccgtcttcccgacaacgttcccgcgtcaacaccttcgacaagataatgaactcccaatgtccgcatcatcccaactccaaccacgtggccaaagattgcttcgtctacaaacagtttgcggagcaatacgtcaagaacgcacgtaagccctcagacggagatcaaggcacatcaaagaagaaagatgatgaagacgatgccccgactggttttcaagatcatcgcaaagaactcaatcacatcttcggcggacccctgacttatgaatctaagagaaagcagaagctaacaaaacgggagatcaatgcggttcagcctaacacgccccaataccttcggtggtcagagatagcaattaagttcgaccgctcggatcatcccgaccgagtggtccacccggggcggtaccccctggtactagacctagtggttcgcaatgtcaagctccgacggactctcatcgatggtggcagtgcactcaacatccttttcgctaagaccctggacgatatgcagattcctcgcacggaattaaagccgagtaatgcacccttccacggtgttatcccaggattgtcagctacaccactcggccagatcactattccagttaccttcggcactcgggagaattttcgcacagaaaacatttgtttcgaagttgctgatttcgagacagcataccatgctatactcggacgaccggctctagccaaattcatggccgtcccacactacacttacatgatgatgaagatgcctggtccttgaggggtcatatcactacggagcgacatcaagcaagccgtcacatgtgacaaagaaagttgcgagatggcccaaacccacgagatcactctcgctcgcgaagagatccgactggctgccaccacggcaagcaaaggagaggtgcctacgaccaagctgtcaaagaccgaagaaggcgacaacaaaactaagaagatttcactagatccctccgatcctaccaaaactgctgtaataggcgccgagttagattgtaaataggaaagcgcgctcatcacctttcttcaaaataacaaagatatctttgcatggaaaccatccgatatgccgggtattcctagagaggtgattgagcactctttacatgttaaggaagacgccaaacccatcaagcaacgactccgccgttttgcacaagacatgaaggatgcgatcaaggaggaattaaccaagctgttagcagcgggcttcatcaaggaggtccttcatcccgactggctggctaacctagtcctggttcggaaaaagacggggcaatggcgcatgtgtgtcgattacaccgacctcaacaagtcttgccctaaaaacccttttgggttacctcgcattgaccaggtggttgactcaacagccggctgcgagttactcaatttcttggattgctactcgggatatcatcagatccgactaagagaatccgactgcttgaagacctcgtttattacgccctttggggcctactgctacatcaccatgccctttggattgaagaacgcaggagcaacctatcaacgcatgattcaaagatgtttttcaactcagatcggtcgcaacgttgaagcttatgttgatgatgtagtcgtcaagaccaagcagaaggatgacctgatcgtggatttagaagaaacttttgcaagcattcgtgctttcaggatgaaactaaaccctgaaaagtgcatcttcggagtaccgtcagggaagttgcttggatttatggtatctcaaagaggcatacaggccaacccggagaaaatcaacgccatcctcaacatgaaaccgccaagcacccaaaaagacgtccaaaagctgactggttgcatggcggcgcttagccggttcgtctcacgactcggcgagcgggggatgcccttttttaagttgctgaagaagactgacaatttccagtggggacccgaagcacaaaaagcctttgaagacttcaagaaacttattaccactccaccagttttggcctcgccacatccgcaagagccgctactgttatatgtgtcggcaacctcccaggttgtgagcacagtcctggttgtcgagcgtgaaaaggaaggccatgttcaaaaagtccaacgaccaatttatttcgttagcgaggttttagccgactccaaggcaagatatcctcaggttcaaaagttattatatggtgtcttaattaccgtcagaaaattatctcactactttcaaagtcacttggtcacggtggtcacatcgttttcactcggggatatacttcataaccgcgaagcaaatggatggattgcgaagtgggccctagaattgatgtctttggatatatcgttcaagctacgaatttcgatcaagtcacaagctttagctgatttccttgccgagtggaccgagtgccaagaagacatgccagaggaaaagatggaatattggactatgcattttgatgggtcgaagaggcttacaggcactggagctggggttattttaatttccccgactggggaaagattgagctacgtattgtggatatatttttctgcgtcccataatgtggcggaatacgaggcgctactccatggattaaggattgccatctctctaggcattcgccgattaatcgtctgtggagactctcagttggttgttaatcaagtcatgaaagagtggtcctgtttagatgataatatgaccgcttatcgacaagaggtacgcaagttggaagataaattcgatggacttgagctcacccatgtcctccgacataacaatgaggtagccgacagactggccaattttggttcaaaacgggaggcagccccttctgatatgttcgtcgaacatctttatgaaccactgtacccagaaaagcacaattgaagccctggatactcaaggcgtaagcatgatcgaaacc

SEQ ID NO: 65987 - DNA, 15201 bp, Oryza sativa
cttccccagcgagtcctccagctcctcccgcgtgatccgcccgtcgccgttcctgtcgaacagctcgaacacgcgcgccagctccgcggcgtcggcctgctgctgctgcttcttcttgctccccgctcccgctcccgctcccggcggtgacatcttcttgggaggaggaggagacgctggcggctcaggcggcatggttgtcgtcgtcgtcgaagaagcctcgcaggtggaggcggcgccgcgcgcgactgggaggatggaggagaggttggcggggaggtaggagaggaggccgcgcgggaggagtgggaacttaacgaccggcgaggcgggcaccgtggggacctggcaactcatgaggtcgatcgctttgcttcgctgtggtgtggtgtggtggcgagcagatggccgcaacctttatcttcagctagcttccgccagtgaccatcaaccatggccgtatttatagctagctatacgacctttctcactctattagagcaagttaaatagtatagccaacgaccagctccaattcatctacagccaatctaatagctcatttatacaatagttatatactacagtattaatacttagtcctacctgtcatgcaaacacggtgtcttggagtccgtgctacagctggctacaaatttatagcctgctgtccttctctcttctcatttatctcattaaaatatgtttgtatctgacttataggctgctattgtacctactcttatacggagtactactacttttcttgctttttaacggaaggagagaatggacggacttgtacttcatgtcaagggagaccttttcttttttatttcgatctaacatgtcgaattgacttttgaataaagtaggtttgtgtaatagcattagggatagatatatcaaattgaacaaaatgaaaatgcatttgtttgaaaggatgctggattgctgggtagtggaaagccaggacggtagatgatccaaaaaaaaatcatgtacaaattaaaagagagggagggttcaaaggagaaattaggggacttggtggcacgttgaaattcattgacttcacctacaggaaacaattaattaagagaaagaagttatgcttacttgactatttccatagtgtaatttggtcaggttgtctatatatctattcagactcatactaaaaacatgccgtcacgtataagccatgaaatagaaagaaagaaaaagagtggggaatgcactcacaaatagtccaattagaaagaatagttaatttacactcgatttatttaaaaatggacatcttgtcacgtctggtgctcaaaaaaattttaaaccctgcaaaacgtacttgtattaaggagtatgtaaaaaactttacatgtaaatagtgaggattgtctacggtactgctaatgtagtagtagaccctatgctgcagaagatgtgcatcggcttacaaagcctcgtaaagaacaaaagaagaagcaagaaaacagctccaaaatgaaaagcaaacataatttctgagctcttgccgtcgtattcattccgttcttaaatactacatccgtctcaacctcgtaattgcataggtagaaataagatcttttatgagtactctactaataagtttattataaactttaaccgcttatttgttaaacagttttgtaaaaatatgtttatattttgaagtgtgtagcgtcgataataagtggcgaatctcgaatataaattgaggtggggctacagtaaaaatatcaaatgactaaagcaacttagtttttatcaactcaatattgtttctaagaaacctatatgcatgtaatgaaaagaaacatattacttaacagataacaaaatctatgaccaaattatgaccaaattggggtgtatggtgtacttatttccatatttgtaactcttggcaagcatgaaggaggtgtttagattcaggggtgtaaagttttaacgtgtcacatcgagtattatatagggtgtcgcatggggtgttcgaacactaataaaaaaactaattacaatatccgtcggtaaaccgcgagacgaatttattaagcctaattaatctgtcattaacacatgtttactgtagcatcatattgtcaaatcatgaatcaattatgcttaaaagatttgtctcgcaaagtagtcgcaatctgtgcaattcttatttttttaacttatatttaatacttcaagtaggtgtttaaacattcgatgtgatatggtgcaaaaattttagggtgacatctaaacaggcacgaagtcattagtagccaaccaacccgatctgccactgtcgataatataagcatacaattttcgtcgattatgatataatcattcaaaagtaacttgtgtataaaatgaaatggttatagttaacagtgtcggttattcgagaccgaacggaatacttcctccttcctattgaataagacgcgcacacattttaatacttcctccatcctaaaatatttaactccatcctaaaatatttaacgctgttgactttttaaaaaatatttgaccgttcgtcttattaaaaaattttaagtaattattaattctttttctatcatttgatttattgttaaatatactttatgtatagatatagttttacatatttcacaaaagtttttgaataagacgaacggtcaaacatgtttaaaaaagtcaacggcgtcaaacatttagggaaggagagagtattcaactttttaaatatttaaccaataattattttattataaaataaattttatgcaatgaaaataaatatcattggtttgatatttgaatttaattttatatggttatgatttttttggctacaaacataaggggttttttaagttggcaaaaatttttgtccatgcatgtgacatcggatatacagactattaaacgtagtttaataacaaaaaaaaaattacagattccgccagaaaactgcgagacgaatttatgaagcctaattaatccatcattagcaaatgtttactgtagcaccacattgttaaatcatggcgcaactaggcttaaaagatttgtctcgtaatttcctggcgaaatgtgtaattatttttttctacatttaatactctatgtatgtgttcaaatatccgatgtgacagcttgaaaaatttcgtttgggaactaaacatgtcctaagtacatgaaaaatttaagtccaaatttaatttagtgagatgtagcaggagtatatattttggccttgtttagttcccatttcccaaaaacttttttccaaaaacatcacatccaatcttttgacacatgtacagagaattaaatatagataaatttaaaaactaattacatagttagaggggaaatcgcttgacgaatcttttaagtctaattagtccattattagtcataaaatgctacagtaacccacatgtggtaatgacggattaattaggctcaaaatattcgtctcgcggtttccatacgagttatgaaattagttttttcattcgtgtctgaaaactccttccaacattcagtcaaacgttcgatgtaacacctaaaaattttcttttcacgaaacgggccctttacgttgatgtaagtgaggccgtgttaagttccccaaattcccaattttccatcacatcacatcacatcaaaaactttactacacatataaactaccaactttctcctaacttcttaatttttccaccatctaaatacagcctgagaatcataaagatactgatggaaaaggtggcccctcaccatcatgtcgcacgcgacgcgtttttgcaggtagttggtttgcactctttaaatccaagctactactaggaggatatagtacagcgaaagaaaaaagcaaagaaaacaataggtcaactgaaaccgcgtggagcatcggcagctaaaaactttcatgggaccgttggatccggatctcggtcgtcgatcgtcgctggcaatccagccgtccggtccggcatcgacggccgtcggcacgacaggtgtgcgcgaatgcacaggtagctgcacgtgggggccgcacgtgccgacaggcttgaaatttcaggacagagatgcagtgcagcttgagctccaccggattgcagctcatttgtggaaatgtggcatggcattattgggacgacttgaattgaaaaccgtggcactcagagactcaactggaactgagctgtggtgtacgtgcatggattgggtagattaatccccgtgctaagaatctctgggacatcttggattagagaagagggcaattgattccctcttgaatgccagttcatgtgcacaatgcaggacaggagtaaagaagagacaatgccagcttaaatcaatgtgttgtcaagaggtttgacaaaaaaaagttcaaactgaagtgaccaccgtgctggcctttgctagtttactgcaacatgacaattgacaacgttgaaatctttcacttcggtctagacaattaggtaatgctgcaatcataaaaggcagtgaaagacgatgaaatatgagtccttggacatgtgacaggaatactcttataaaacggaaacattgggcaccctggctcgctcatctgacaaacttacgaggaagcaaaattacaaatcccttgttttccgccagattgattgcctagttgcaaaattggcatcacctatctacaaaactcaacttttgtcctatacatgctagagaacatactgaactatgtagtatacatagcaggctttgttgataaaattgagaagcaaaattgaatatagcaaaactgggtgaatttgttgcgtagcggtttcgctaccaacagggggaaaaagctgtgcaggttaccaccgccgccgccgccaccaccaccgagagctgcacaggactacaggagcacctccacaagaggacagcccagattacatcaagccaccaatcgcctcactgccttgaaccttgaaccgaagccacggtgcgtaatcttggttcacagaagggcaaccaagactgcacaaagataaaaatcacatcacttttccgtatcacaaaaacaatcatgaaaaatgctggaacgattccacatgcttcatgcttgtacagactagagagtgagttttcacctggaagtttatatctatagctacctcaaatctaacttagttttataaagagaatgtaattccagaatccaaagagattctcaaggaagggagttaaagatttggcaagttttgattctttgccaaagcaaacctgaagtgaataaagagcaggctgccaatcagctccagattgtaggatttttgaattgtaaacatattgcatcagataagaactttacaagttcctctcttttaacttccttctccctttttgcatccagatgtcgaaccttaatagaaggaaaacacataaaattataaaaaagtttctgcataaaaggttgagcaaaattctaaaacagtaaagaacttatttagttttcctcaaataaaatggaccaatgaataccaaagacgttaagtttgtgtttatgtcggatgaattcattatcacacatggtacttcctgacaactcttttgaaataggaaacatgaattacataaatttatgttaaacaaccagtaatttaatcagtatcgacacaatataactcactgctgttcatatgaaaatacagttcaaattagtcctacattccaaaaacatgaaaatcattacttacttgaaagtacagctaagatacaagcagcacaatggtaaaccaaagttcaaatgctttaaaaaggtttgtactcactactcaatagcagagcattgctcaaataagtaaatgcatggcagtaaggtatgcacaagacatttccccgattttttaatctgttggtgagaattataacttcttgacagtgtaaagcacaaatgcacctgtaacacaacgttaatgtatttaccttcacaagttctgtttgtgagacacctgcttcagtgatgaacacaaggcatttgatgtcatgatcactggcatattcatattgttcctgaagacttggatcttcctgagggacaaattgggcctgataatagtaaactctcagtactgataaaaacagacttgtgtcacaaacccttgcaggtaaagacttctgcagcacctacctttatattagcttcccaaagttctgcaacaagttccatacgctcattcaaaagaccgccacctccctttgaacaaacaagaacactgatgctcggttcaatcctaaaagccacatatgttagcaagtaaaaaaaaaatcccatcgaacaattggagatggcgtaaagcatagggaagcaatttatttgttcacttggaggtaaccttgggaacccaatgtcagacgaaggactattaggaagaaatttctcaagtgcaatgctgacaccaacagcacccgggggtttggatttctgtgagggttatcaaatacaagtagttagatcacgtaggcaatcacagtagaaaatattgtcatatagtagtatatgactacctgactcatttaagaaacaagtagacttaagaatgtctaaatatttgatgacagcatagctatctaagtggtctttccatgttctgcctcaaggttttcctcagaaaacaaagaatgagatccaggggatggcatgataaaaaggcgtgcacacacaaaaatcctaacttctcctcatatggagatggccactccttttcactcctcttctgtaggatccaatctctctacttctcctgaaaaggcctataatcttattggaagtaaattatccatctctttatcaggacttcttattggaagtaaattatccatctctttatcaggacttcagtgaaaaagaacaatttgaaacatgtagaagcaccactaaattgctggtgaaaagactacactatagaacagctggatgtgaaccctcggccatggtcagagtgtacttagccaagtggtcatcgtaagcattcacttagtattattagaaccaaatctacatggacacgtataagtatacaggaagcatcaaatacaacttacatatgtcctatcccaagcttgctctatcaaccaatcatatcgccccccaatggcaagtatcttttcatgggaacttgatccagggtttccttctttcacatagatctgtgttgagacccagtaaattgatgggccatagtaaaaatatataagtggaatttcagaaaagaaaatatgccattagcgctaaaaaggaatatattaacatgagatctatcaaatcatttcactgaatacacacataatccctccagtcataaatgtttgacatttaggatgagattcagtcaggcttttaaaattacgaccaccaataatttctaaaatgcttagtttgaaaacggaagaaattgtatatggtagatttgcctcaaaaagtactatcattatatcataaaattattctaatataaaattattggctggaattttaaaagtttgaccgaatcttgtcctaaatgtcaaatatttatgaccggagggagtagaagattgttgttgttccattttatcaagtttgcccttttgatgcaaccaaataaaaagaactgcaacactaggttcaaggcggaaatgaactagccatcactcgaacgataaaggtggattgaaaaaaatggtctccatgattatagttgaaaaagaattgctccacatccggttgtagttattaacctgaaaaaacagatctgtgtagtaacattctgaaggaggcatgagtacatcaatagtaatatgttcttcgattgaccatattctcaaacatttgagaaatgctgagatctcatcgagagccttgcaagcagatttatctgcaacaagaaacatagaatgattgacattttagtacatatttgcagactacagcagacaatgtagaggggcttaatcactaccatagaacagggtccctcttaatctagcaagtacttgatctgcagaaccacaaaatctctgatcagctttatgtagcttctcaaccacctcttccgaaagacgaagatcctgagcattcaataaatatttttatacactaacccattacatggaaagatggaaactgttagtaatggaagcattttcaatattcacatgggaatcttgtgaatgcatctcagtaaatcaagcatttacaagggaaaaggtataataacgaacctaattaaataggataaaactttgcatcttgcaaattgttaacagaattattttttccaacttgttcaatattagtaatacgttgatgcattatattgtttttaccaaaaaaaactattcatacaggagtttcactgtagtagtattcagtatgctttattaatcaataaaacaacaactattaaagtaccaccatggtttgattgtgtattgtggtgcttgtacctgtaatagttgcccacgaatcaaactccattgtgacttgcgatcagccttatttggccaatactgaacaagagttgaagagaaaaactgatacacacacagaaaaaaaaggtatcagctgagatgattccacaaatgtgaggaacaggtgagacaaagtactgtacctcagcaacattttgtcgccgttcttgaggaactcctgcccaggaacaaactgcttcagcaagtttgctatgattcagacggataattattgccttcggatcataaaagtgtgccccaacatccaaagtgacctgttgttgcaagaaattaattgtttgcaataacacaaaagtgcatgtttaatgctgaaagcatcttcagtagtctttgcatccatcccaattgatgttgcaaaacttagatactccctccgtcccataatataaggaattttggtgggatgtgacacatcctagtactacgaatctagacatgcccaaaatcccttatattatgggatggagggagtataaactaattatgaaatatggacctcatatgcagttagggaaaacaaggtaaatgagatcacaagatatataacctttacaatttcagcctctggtattggtgaagcacctccaataatgtcgaaatcaccctaaaaggatgcatcatgatatttacagaaaaactactgaaatggcgccgtaagaagataaacaatagaaaacgaataatgcaaactcacattttgtttgacagttgatgaatattcaatgcaaataaaacagttacctgaagaaagcgataaggaattgaatggccaactgctcttcgatgaacccatgatacttcataacgcttaaaggataatatctgtaaatgagttgtgtaaagtagttgctcatcagaattgttcttagcgccatcctttttcaagcacgcaaataaaggcagaagcgggaaagacacagatgttttcagagaacgcccaaaaaaaagctcatgaaatggcaaattggcaaattcagtgaatatccctgggatacagtggagtaccgaacaacttaaaaggcatatgtagcatatgtaaaacttgcacatgactgcattatcatttggaaccaataattaaaaatggtaatgtacccaaattgaacattgaatcttcattagcttttatctagcacatacaacagtcaacacctgaatgcaaataagcacggaagcaccacactgaaaatgttatctacttcataatggtggtgaactggttagtgctagcttggtaggttttgccatctcaaatcttatgtggaggaatctataaatacatatatgtgtttactatagtgccttttgtaaatgattgcacttcccagttatgtgtatatgtatgtggctgtttaatcatatgtgagttatctttgcaataattgagacctagggttcagttattttatttctatctttgaagtttacaagttgtgatttgttgattcgacatctgatgcaagcacaggtaccgtgtcaagtagatacagaaaattttagtgacaattgggaatatctccaactaaataactatgtttaataaaatgttggataagtctttgtggtccttggtcgtgattcttctttttgcttttgggtagtttcacctttttcaggatagcatctaccctttagcatatttttcagttgctaggacagctgcggttagtaggacagcagcagttagcatctcctttatgcctcctttatgctttattcagtttggatgccctctaggacaacatctcattcaaatttcaaattttagactaggagggtgcagcaataggctagcagccagctatggctatatatatgcatccaacctccctcgggtaggtatggcttttgtgttttatgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgccatgtccgacgctcggtctcggcgttctgtcgcctcgagcactcggcgtcagcaggacgctgagctcgccgcagcagaagagcgtaggcgagcaacggctcagaccgctgcagcagcagcaagggcggccagactggcggcagcggagttggcagcagccagggcggaggcggaggcgtcggaagatgcggcacgtgtgacggaggtagaggttgagaccttgcgcagcagcatcaacggctccatcgccggcgacatcaccgccgacagggagcttgaggagctggcaagaggaagggcacgggagcgggcagagcggtgggcagcagcccacctccacggcggtggcggcggcccaagggaccacgcgcccgccgacgggaacccagacgggcgcgggcgtgccggcggaagcccggagcccgcacgtggccctcgcaggcagcgcggctctctctcccctgaccggcgccatggtcaccacggcgtccagacggtggtcagggactttggtccccgcggggggtggcctaccctcaccaaaaccaactacatcgagtgggccgcggtgatgagggtgaggctccaggtgcggcacatgtgggaggcagtccggtacggcgacgtcgactacgacgaggatcggcgggcactagatgccctcatcgctgcagtcccgcccgagatgcagttctcgctttcccagaagcggactgccaaggaggcctgagacgccatcgctgcggcacgcatcggcagcgaccgcgcccgcaagtccacattgcaggcactccgcaaggagtgggagaacctggccttcaagccaggtgaggatgttgatgactttgctctccgtctcaacactctcttacagaaaatggtgcagtacggcgacgacacctacgacgaggagagagctgtcgagaagctcttccgctgcgtccctgagaagtacaggcagatcgctcgctcgatcgaatctctgctagacctctccacgatgtcgatcgaggaggcgttagatcgcttcaaggtcgtcgatggtgatgagccacagcctctctcggggcccatcaccatcggcgggaagctccatctcactcgggagcagtgggaggcctctcagggtgacgggaggaagggggagtcatcttccccgacaggcggccgtaagccgcgcaaggcacggggaggtgtccagctacggtgggcgcgaagacgtgccgagggtggcgcccgcagaggcgcccagggcgttgccaccggcaaccacaagccggcacgagacgacgcctgccgcaactgtggcaagcttggccattgggccaaagactgtcgacagccacgacgcgaccaggcccacgtcgcacgggtggaggaggaagagccggctctgctcctagctcacgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccggccgacgggagttcttcaccgagttcgactccagcgtccgaggctccgtcaagttcggggacgcctccggcgtggagatcaagggtgttggctccgtcaccttcaccgccaagtccggtgagcataggctgctcaccggagtctactacatccccgcgttgaggaattctatcatcagcgtgggacagctggatgagaacggctcacgcgtgttggtcgaggacggattcatgaggatttgggatcgccgtcgtcgccttcttgccaaggtaaccagaggcactaatcgactctacatcctcagcgcgcaggtagcacaaccagtttgcctcgccgctcgtcgggacgacgaggcgtggcagtggcacgagcgcttcgggcacctccacttcgaggccctgaagcagctcagtgccaaggagatggtgcgaggcatgccgtgccttgaccacgtggagcagctctgcgacgtttgcgtggtgacgaagcagcggcggctcccctttccctagcagacgagcttccgagccaaggagcggctcgagctcgtgcacggggacttgtgtggcccagtgacaccggccacaccaggaggacgacgttacttcctgctactcgtcgacgacctctcctgctacatgtgggtgatggtcctcggcagcaagggagaggctgcggacgccatcaggcatgcgcaggctgctgcagaggcagagtgcggtcgcaagctgcgcgtgctgcgcacagacaacggcggcgaattcacagcggctgaattcgcgtcgtactgcgctgatgagggcatttagtgccactataccacgccgtacagcccgcagcagaacggcgtcgtcaagcggcgcaaccagacggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccatctgcgggtcttcggctgcctcgcgttcgccaaggagcttggccacatcggcaagctcgacgacaggagcaccccaggggtgttcatcggctaagcggagggctcgaaggcctaccgcatcctccacctggagacacagcgtgtgcgcattgtgcgcgatgttgtgttcgacgaagggcgagggtgggtatgggacaaggcggtggacgatggttcgactccgacgtacgacgacttcaccgtcgagtacgtccacttcgagggagctgggggagtaggcagctcttcttcaccgagcgtgtctaccctagcccccgaatctccaccgactccgacaccaacacaccctcgggccacgacttcgactacgacgagctcttcgtcgacaccaccccagccagtgactccacatgctccagcaccaacagccactcctccaagcacgtctactccgacgccagctcgtgttgagcgcagcccggtggagttcgctactccgctctcccacgacggggagcgcatcgacgcgtaccacgacggcgagcagctacggtaccgtacgatggaggatcttctcggcgaccagccggtgccgggactggtgcctcgcgacctaaggcgcagttgcaccttgcgtgcgatgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgatgatgccttcgctcccgtggcacggatggagtccgtgcgactccttgcgctggctgctcaggaaggctggggcgtcgatcacatggacgtcaagtcggcgtttctgaacagcgacttgaaggaggaggtctacgtgcaccagccgccgagatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcaaggagatgaaggccaccttccagatgagtgatctggggcctctctccttctacctggggatcgaagtgcaccaggacgactccgggatcacgcttcgacagaccgcctacgccaagcgcgtcgttgagctggctgggctcaccgattgcaacccagctcttactccgatggaggagagactgaagctgagccgcgacagcacggcggaggaggtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctggcaaggcacacttcgtcgggtacagcgacagcgaccacgccggcgacatcgacaccagcaagagcacgagcgggattctcttcttcctcggcaagtgcctcgttagctggcagtcggtcaagcagcaggtggtggccctgtccagctgcgaggccgagtacatggtggcctccgccgcttcgacccaggcgctctggcttgctcgactgcttagtgatctcctcggcagagacactggaacgggggagctcagggtggatagcaagtccactttggccc

SEQ ID NO: 65988 - DNA, 2660 bp, Oryza sativa
attcctgcagccccgttatgaagagggccgagtagacgacatcaattgactagaagaagcccgtgaagcagctttaattcagtcgactcggtatttgcaagtgttgcgccgttatcataatcggaatgttcgatcgcgagcctttttagtcggcgacctagttctgaggaaaattcaagccacacaggatcggcataaattatctcccttatgggaaggaccgttcataattgtcgatgtcactcggccaggttcttatcaactcaagcgcgaagatggtactctcatcaacaattcttggaatattgaacaccttcgtcgattttattcttaggtatttcgtttgtatctttcctctttgactgctaacttcaagtttttccttgaagtttttcagtcggggggctactatgataataatggagtgtaatttttatcaattcaatttgcttacttgatttatcattgccctgtttggtctttcgactaagtcaatgaggactgaaggtttttaatagcttttgcgggttttaggctcaataaggcttgacaaaggcttttaagaaatcagaagctaagtatggaacaccaagcatagcataaattcgtcagtattgtacaaattgagcctccatcatcattaatcatcaaaatcattgttatatcaatcagtatcagttttttcatcatcagaattatcagacccagtcggccgaaggtcgacatcttggaatctctcaaccacgtcagcaacaatcttgtcagcggctttttgcgcatcattgatgaggtcaagagcagcttcttcgctcgtcccgtctgcaaagccatcaatggcatcaatgtcaactcttggataaagggatttggtcatcgccaacaccagacttgctcccatacttccagcttctttgatgttcttgaagtaagtatccggagcgactctcagcttgtcgaagatttcggcagcatcaagtgtacttggaccggcgttattgaagaacatggcttggatgagtggagtagcggcattagcgactttgtccctggccccttcaagcctattgatcttgtcaactaagacatcaaactgtgcctgtgacttgatcttgtggtctgcatcaacagattcacattaacgaatcagcatatagaagataatggcttttgaggtattgatttttggtaccttcaacctcctttaaagctgagtccctctgtcttgccagttctgccttatcattttccagagtttgaatctgcttctccagttgagatatcttggcagcttgcactacattgactctggttaatcaagattacaaagataacaacataagttagttgggcagagtttgtgtgtaccttttgatgagccgctcagttcaaaattggattcctggagctcagcaatccgatccctcagatcatgttcattcttcctggcaagctcttttgtctcgtgcagctgattcctggtggcttcgagggtcccaagatgagggactaacctctctaaggtcgccgttttggcttcgttcctaagatgaatcctctgcaagacagtttaattagcgcctggactaaatggcaaacgagatggttgagatcaggcgccaaagagcttacatttacaatgcgggtggcttggctgagcgcatttttcagcaagcaaacttcttcatcttctttttgcttatttattacgattccttgaggctgcatgttgtcatcccaccacttgaccagaatgggaggacgcgaatcctcagctgcttgtatccggaggatctcttcttcatcaccaatcattggccctagtgtatccataaataaagatgaggcgatcaaataaagtctgttggatcgaaatgatttcagatagtgtgtttacctgtgatgattcccggtcggggacgagtagactcttgtgtcttcacaggagatctggtttctgagtcattgccagcatcctttccgggaggattgtttgtttgagcttcaacctcgggaattttttggcttggccctgcatccgactggtttccagtcggggactcctggttaactctgactccagcttcggccgactagcttgcggtcgtgggttcgttgctgggttttacattgtcgctggcctgcggattatcactcgggtgatcttttgcagtcggcccggtttcttttgaggtgtctgtttccatgttagtcgggtcagagtctttctcagaaggatctatgtcggatggtttcctacaagttttgccatcggtgttatcttcatgatgggagaatattaatacaaggaaggttgttatatgatttgtacctggaagactttctgatttttggtacaggatgactggaggttttcttcttcggattagttggcttcggaggtcttccggtcgctcctttatctctgagctttccggtatcatcgccttcgtcgtcacttagaaccagcttcctcttgcgagaatctgactcgccgactggatcagaagcacttggttgggtttcagaccgaattcttggttctccgcttccctgaccagtttggcagcgaggtgattggcgttgagcgattgggggatccgatttcatcaaagcaaattcctgggcgtgatatcctttattgttaactgattcaacaaaca

SEQ ID NO: 65989 - DNA, 5656 bp, Oryza sativa
cagcgagctttggcaggttgccgatggaccatgggatctggccagacagggagttgacactcaagttgatggcacgcagtgcgacgcagctgccaaggtcatgggggatctcaccttgtaacctgttgtttgacagatcaagggcttggagataggtgaggttgctgagctgcggagagatggcaccgacaaggccaagatctcgcatgcgcaaggcagtgacgcggccggggtgggcatggctgctgcatgttacacccttccaatggcagaaaccaaacatggtctcattggagctccaagaagacatggctcccgatgggtcctcagtggcaagagatttgaaggatagaagtgcatagaggtcggtgctactactgatgggctggacagtagtagctttacccaaatgcagcatgtagattgtcgtgaaaacatgaggtaactggagtctttgggcgagttccatattaattggatactgatgcaggtggctttggccattcgactcaaggacacatgcaacttatatggatgccactaccatactgttgtgccatttactagattgttaatttctttatggaaatacctacccaagatgcacctgtgttatcctataattaatggcacatgtcaactttatcactataaggcctatttgtcaacctggctgcgtgctctagctttagattctcatatttgtcaaggtgaacaagtaacatcttcctacttgatagccgtactactcaagcgcagtcgatgcattcagattgtactagttatttctccacattgtacctgaaaattttgaattctagaaatataattgtcttggaaatttgaaaaccatcttggagttctccctggtgtttttcaggatttattggtgtttttgcactattagtgcatgaaaaacaattcaaaatacaccatgcttaaaggaaaaaaaagagagaagtatattgccgatcactagacttgctcttatgtgtcatccaggtctctgaattctcaaatacatttttaggtccccgatcttagcaaagtgtgttattctggtcccaaattaccacgaccctccaggatcctacgtggcgcttacgtggaatgccacatgggcgttgagtcattttctttatctctttttctccctgtttttcatctctcattctatcttgttcgtgtgaaaataaaaacataccaaaaaaagttggtgaacctagaggggaagaaagaaatgaaaagaaaattttggaccggaatgtccatgtcacaagtcaagtattgactgttccttttgttcttctcttgctatgcagcatttatgaaattggcaatgctagtactaaattttgggcccattcgatcacttccatacatccaacttctgctcatgtgttggcggctgttaaatgccgattctataccgccaacatctgcataaagtttagataataaaacattcaacatagtgataggtgcttaatctcacatgttccacaagtgttggtgtatagttgtatgcagatgataaaccctgaagttgggaggaaattcagactaaagtgaggaaaattatgtatccatacaaggaggggttgtgaacttcattgaaacaccagtggatcaacccaaaactccgcgaaatggatagaagaaggtctagggaattcaccgaccgaaggccaggccaggagggcccagcccaggttcggccgaaaccccctgatcaccgttgatcctggggtttggcgtggacgctcctgatgttctcccaatgacggttgcggggcagttcggagatttccccttcttacaaccgtcataactgccctataaaaggacctcacttcattcactctcacacacacttccaagcttgagctgaattataagaggttctattgtactatattgtatactagaataggaagagagtagagtagaaggagtcggatgaattccggagttgtcggtaatcttctcctatttcttttattctgtttattactctgaatttaatataatatttttcttgagtaatttaaatttatcttgtgagaattatctctttgttagttcctaaatggcatacgggattattgttcactataatcaactaaaatatagctattgctttggtgagttatcaacactaaagtagatattaattgcttaaacatggtgtttaggtaattattatccagtaattgctgcgtatcccacattacgtttgaggtgggtgtagaggtggtgacagccctcgagatcacttaagtcctccctgtccgggtacgtagtagagcgacatctgggaacagtgggttgccattgcctgaagtattgcgttaggattaaaattaagctttccctagacactgtttctcactagtgaatcatctctatcctagcctatcaattgcttggtgtccttggatgaaccggaggaagatctgaccacacacattcccttggattcgatacccttggaatactccgtaggggaagtgctacatcggtatatccgtgcgcttgcggattttatccgtaactgtatcaaataccaacaagcatttctggcgtcgttgccgaggaacggttgttgatcatttccgaacctagttcatcctcgtatcctttttcatttttgttattctaccttcacccctgctatcccagagaagtattcctgtcaaactcttctcgaccatggagcaacctctttttgagctgtctgctcctcggggcgaattctatgagccacctccttcatcggagcccatttatacaactggctatgaaattcgtcccgaactaattagtatggttagggaaaatccttttttggctttgatctagaaaatccctaccatcatctgtgagactttgaacaagtctgctcatgccttaagactcgtggcatgagacaagaaactgtgcggtggaaattgttctcattttctcttcaagagagagcaaagcaatggtacacctctaccgttggatgtgtaaacggtagctgggaaaagctgcgagacagattctatcttgccttcttcccagttacccgtattactgcccttcgagtagaaataaggagtctgcattgatcaaaaacgaatcaatcggtgcagcttggtccagattcactaatttagtccagtccggaccaaccctgtccttacccgagtatgtgcttctcccacatttccatacgagtttggataaggagtctgcattctatttggacataaccgctggaggatcattcatacacaaaatgccgtcacaaggaaaaacgattttggatcgcattctagaaaacacttccttcatgacgcagtccaatgaaccccagtcggaggcatccgtgtccaagatagaggaacctctaacgatcgagccacttgctgaaccatccacttttgctagctcggttgatgagaaggttcctgagcagccgtccgtcgagaatgaagaaattcagactctggatagtgccgcaattctgtttagggacggttttgacgaagaatacggcaataccataaactattttagtaagaggaaaccacccgttcccttgtcacctcccgatcctatggaactcgggttcctacgagaaactgtccgggagttgacatccataatgagcgatgaatggctaagggaggcagagctttcatccgaagtaattcggataaataccgctccctgaatcattccttgtcacctggaagggaacgacctcgtctctgagtccaactgtcggggccaacctcgtctctgagtcttttgcattcgcttatttaatcgacaaggcagtgaccccgacaaacaaattcttcaagcatccaaacggaaatatcatcgaaggatttgggattgtgcaagatgtgcctgtctgctttgaaaacagggaggcgatcttagatttccacgtctttgaaatccaagactttgatatcctaatcgggctgcccattgagcaacttatcatcaacacaccccgatttggtagcctcaaaataatactaggagagaatgaattctcaattccattctcgcgggcaaggatcaccttgaccgaccctctcccagaaattgagtcagtggaagaggttaccgcagttcctcctcatgagtctcccgaggcccttctggaagatgaggtccccccgatttcatcaaagaggaagcggatcccggcgagactctcgacctgccaatcatggaaccaccatctcgacctccgcttgagcttaaacctctacctccaggcctacgatatgccttcctacacaatgacagagaggctcctgtcataatcagtgacaagctctctgaagacgagactcaacgtcttctcaccgtgttagaaaagcatcgttctgttcttggctactcatttcaggaccttagggggatcaatcacgcgctttgcactcatcgtattcctattgaccccgagagtactccctctagggaacctcaacgacggctcaataatgcaatgcgagaagttgtaaagaaagaggtcttgaaactcctgcatgccaggattatctatcccgtaccatacagtgagtgggttagcccagtctaggttgtgcaaagaagggaggaatgacagtcgttgcaaatgctcaaaatgaactaattccgcaacgaaccgtaaccggatgaaggatgtgtatcgattacaagaaactcaacgaggcttaaaaaaaggatcatttcccgctacccttcattgatgaaatgttggaacggctggcaaatcattccttcttctgtttccttgatggatattccggatatcatcaaattcccatccatccggaggaccagagtaagactacgttcacatgtccgtaacccatcccaaattgctccaggccaagcacgcttaaccctggagttctttggagattgacttccggaaaagaagttgcaacttgttgatatgagtattctattaatcctattaagccctaggccgggatgttacaccctcacccccttaagagagatcgacgcccccgtcgatctaccctaggccaggaacgtcctctcttggccacgtccatgtgtccagtgccagcgcatgtgccatgctgtgtaaccactcccggtctacaccagacatgcgcaccatgcctgcgcaactgcgacacacgcgcccgtgaaaccgcgagagtcggctctgataccattttgtaacgtcccgccttcccccaggccgggcccgcttacatctgatagctttcataggtcatagactgccctcacagaccaacacatgtctcctggagttctttggagattgacttccggaaaagaagttgcaacttgttgatatgagtattctattaatcctattaagccctaggccgggatgttacagctctcctctacccgccgccaccctcgccttcgcctctcgtcgccggaagagccctagcgtcgtgcacccttgcgccgccgtcgctccagccgtgagccgccgtcgctctagccgtcgccgtcgctcgagaagaccgccgttgtgctcgccaagtcgtcgccgtcctcgtccgccgcttcgccaccgccgaagaccgccggagcatcgccgtcgccgtcgacccgaaggttgccagcgcttcctcct

SEQ ID NO: 65990 - DNA, 10131 bp, Oryza sativa
ccctcccccccccccccccggtcgcccgaggcggaggattatcgatttttagatgtttccctcttgtctttctctatttacaggaacagtaacccaacaaccagttcaatataagcgtgcatcaccacgacggtacataccattcctcacacaccgaccataccgcgatcttgtgtgatctcccattctcccccgtactacaatattgctcaacataaccgggcaattgctcatttgacgtatttcgaagtgtaactaccaatttaatcccattttttcggtttgattatttgaccctattttttaaaatcgaagatgaacactgaccctactccattaaagcgagttaacggtgttaactaaggggtaaatagtccattttgcccttgctttataacaaatttataacgaatttgatttatcttttacatttgagacaagtttgaaaaatttagcttcaatattttaatttgaaaattttggatcggtttaacaaatttatctttcattcgacggtttttcacaaaataaggcaaataaaatttggcagaaattttttaaaaaattgacagaatattgtcttaattttgtgaatcccaaattacatacaatgaagcaaaaacataaattatggtcaaatccaacagagaaaatatcaaatagcaactgccaccgcgcgtcggttgcccgctgcctccctccgcgcgcccgcgcaccagcagcggcgcaccaccgccccctcctcccttcacacgccggacgctccggcctccctcctcgtgccgctccccaccgctcctctctgcgtgctccggcgcccctgccgccgcctctctccacgcaccggcgctgtcgccgtgcctcctccccgcgccgacgttgtctcctgctcgctctccgcgtcggcgtcggtgccaccgctgccatcgcctcctccttccctgtgttgccactaccgagatgtgaacaagagagggtgtcgaaccctctaccaccgccacccccgacggcgcgcgtcttcccaccacggcgcgcaagagctggggatcaaccaccgcaccagctggggagccgctgccgcaccagctagggatccactgtgatgaccacgtgccggcgcggatccccccgtcccaccaccaccacgcatgcagagcaccgccaccacgcacggagagcaccactgccaccctccacgagcagacgtcggcgcggggttctgcttcacgccgccgccgccccctcagtgccgccgccgcaactcacacaagaacgagagagagaaatgtgtggatagggttcggtggatggatagggtttcctatgggtattctgggtattacgaatattagttatatttcttttttattttaaatcaaaacttaacagggtcagacgggagcttcattttcgaaaaggatggtcaaataagtaaactctaaaaagtagagtcaaattggtagttaagcttcaaaacggggtcaaataagcaattgtccctaaatgaaatgtagaccccgattttggaaatcgaaaatcttctgtgtttatccgtaccaatccctggatcagtagttggtatacacatacatagttggatcacaacatatcacgaatgaattcaggctaaaagaattaaatacttacattagggccaggtaggccaacaactatcagagaacaacagcggaagacaaaataatataagggcccggttaacatgccacaggtagtcgactggggaacgagacctagaacaagaccgcactccgatcatcttgtgagatacgcaagcgtaccgacaagggcttctcttcaacactctcctaaaagatatataaatagcaagggtgagtaccaaccgtacccagcaagccaccacaacaacaatgcatatgatagagggtttttcaaggaatggcttcaggttcttttgcataaagctagttttgtaattcttttcacaagcctaagacctagcatagactgatcaaattttaataccagttttcacattaaacaacgacggttctatccaccatccattatgatcccaaggatagcttcccgccattgaatcgtcatggttttctgaggacgtccaccttcccgcctctcaggaagtggctccaacagcataaaatcatcatgcaatatcccatcccacacaagttaagaactttgagtctagccaagtgtaatacatgtcccggtgctcaataaccgcgagcacggctattcgaatagatttggtttactcacactgcagtggatgcacactttacccgcactccgtgactgcccaacacatgagcctcgtcccaacacatgagatgcgtcacggcaaagcttttcgatgacctcgcattggcagtacccgctccataaacttaaatcctcatgcactctaggcgtccatgtttctagcagtgagaggagttctggcgctcccgggaaagagaagtctcacacatatattaaattatggttcaagttaagttctctctctcacacactcatggcagtcctaccaatggcgacaccgatgtagggcacgcctctcggccctacctcaacggctgttccaccgtagcgcacctgcctcactcaggggtgaaccatctatgcagggatactgcctccgctcggctatctaatccgctaggtctatacccatatgagaagtgcggttgtacgggggtcgtttcatgcttaacttcatggctcggtccttaattgaccggggacggtactagccttttccagataccacccaaatcctccgtccgccccaggcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctggaaattgctgacgttgcctcacgactaaccgatacacaaagtctataatacgcgagaaaaaccaatattcaaacaacaatcaaatatgcacaaacaaaatatatttgttgaggttgaacctaaggttgctcatattattcgcgcttgctaatgggttccaacatgctaagggctaaagtttcttaatctttctgttatcatggtggtctatttaggagctagccaatgtagtatgaatgagatacgtatctggctaatttgtggtttagtctagctaatggctatggaaggattatggctacacatgcatctatctaaataaaatggtcgtatactagaggttctgttgtcgggtggatttaggatcaatcaaataattacagtgaatcatttgtattatttattttattgatggaagctttactttaattatgaacatattttacttgtcacaataaattataaaaggttaataattatccatgctttgtatgttagagttgtttaggttaatcatattatggttacagattatcccatcacataattttacaatgaataatcctaatttacagttgaactataattataattatatgaggtcaagatttataactagtatttatctgatatacatgtttgtcatacactccctcttaatttcatatatgcaacacgcaaattaatattataccgtaccactataatgggatgtatagtatatgtgtaagcaacaatatcttattattggatcatatatttgagtagtttcttttactgtaagctatacaatacatgttgattttaagatggctctatttggttaactaatggatatcaactgactctatatatatatattctacttcacatgacattgtatcaactaattttttttaagtggtccaaatacaactagctctgtgattactctcctaaacaagttaaagattcatctatgtgtgtttatattttagttacataatcataaggctatacttgatttaaataacctataagccatggatttaattatatggccatcgaatattaaataagtactagtattttcctatacatccattcatttgagacatcacataaaattagtttgtgtggttgttacagtggcaagacatgttagagacaaaacttattacatccactctactgtacaatactaattttatttattagcatatttttaagttgactattatgcatcatcttgatattaattatttaatatttataaatatattttatcaaatagtgaattatatatcattggaaagcttatgaatttagatgaatttaggttcaagtttcactcaaatcggagctgaaatgaataagttatgctagtgtaaagattcaaatttgaattaattctaataattgtgaaatggtactgttcctaattcatttatttataatacaaccttatccacaagctatagtgactgacaggtggggtcaaggtcttgattttcttttctacagaattatttttctaagggaaattggatggaattaatgacaggtggggcccactctaacctctctcctccattctcttttctctctctcctctgttttctcctctctctcacggcctcggctagaaccggcgggcggcacggcgcgatggcaagtggtgggggagggggaggctcaccggttcggcggcggggtcgacggagacgcggcggcgaggtcgacggcggagcacggcgcggcgacgaggcacatcgcggcggcggggcacattggctcagcggcggcggcggcggcttccaacgaggcggcaacgccggggatgggaaagagagggaaaagggaggggaggtggtgggggtagtgtggggagcaatgggcagccggggaggggcttatataggcgcggggaggggtggccggctttaaacgacgacgggacggcgcggcggcgtggggctcggggcgacggcaacgcgcggcggcgggacggcgcggcgcaacggcgacagtgcgcggcgcgggcggggctcgaggcgctgatggcgacggcggtgacgcgaaggcgtggtagcggcacggggctcgaggcgcggcagcggctcagggcgacggcgacgggacggccgcgcggcggggcgcaggcgcgaggcagcgagaggacgggcgtgcggcggctcggggtgcgaggccgacggctacggctcgcggcgcatggcgatggcgacgcgacgggcgacgcgacggcggcaacgggagtggcgcggggctcggcgcggcgcagccgacggtgacaggcgatcatgacgatgcgacggcgatgacgacggcgcgcggcgcggtgatgatggcgacgtgacggcgacggcgacggcgcgcggggcgcgaggcggcgcgacggcgtgcggcggcaacggcggagcgaggcgacgacgacggcgacggcggcgcggggcgcgaggcggcgcgcagcagtgggcggcagcggcgcggcgcggcgcgtgcaggggcacggggcgcgagggggagcgcggcagtggagggggggaagggctagggaaccacatcaaacacctaggccataatgaacagtgactttttcctaattatccacttttgaggcatatttcctattaaaacttgtcccataatttctagatttcacacaattagagttttacccaatatatgttttattttagatgaaagttgaccaaaatttaatattacccatattttatatattttcctattgtattatttaaatgaggtttaaatctaaaattaacctagataattttggaggctttgagggttctaaaattaatttaaaatatcctaatgtggcaattattattacaatagcacattgaatgaacttatttgtataacaatgcattttacgtgggtctactcattctataaatataaattgagacttagtacaacattaatctaattgtttaattaaacactcacatattcttatttatgtataaagcctaatttatttatatgaccattattttatatgagtgattttcatgctatgaggagcttgataaggtgtttcaaatattaattatatattctagtgagatactctattatagatagggccattgatgtgatcattatttcatgtgtacttatatttcatgtgagattggattcaagtgaattatattcaactatgttgtttccttttgttaaatatgaaatcaggctatcaacatggtttgattatttaatatttgatttgtgatttgtaccacagggtttaataattgacttgtactttatttggcctggctttcatgtgcataaatatttatgggattgataataaatatcgtatcgttgtaaatcgtaactattgctcgggtgtaaatctttagattgatttttttccattgcgtcaatttatggtttggcaagcaataacaaccataacttccagcatgatgcaaaaagttttaaaaagttcgaaattttagtgatttttaatgtcaggaattttcaggatgttacatgaaacaacacttatcttattgcacttgcacatcttcatcgatctaagatgtttataagtccagatctgtacgtagtcctcactactacgaaaaccatctttcgtggtggccattttagattttcgctggcagaatttggagccgtcacaaagcaaaggccaatgaagacatattttcgcaagcagacatacgattttcgctagcggttgcgatccgcttacgaaaatcgattttggcaagcggacaaacgatttttgctaacggttgagtgtcgcttgcgaaaacccattttctctggtggttgcctaaagagaaccgccagtgaaaatcaacccaccccgccaaaaattccctaccccaaagtcaaaattccccactcggccgaattcaaaacagtccatatttggaaatggacataaacatcattcaaacacaatccaaatccagagcatcacaaatacatatataatattggcatcaatccaaatacaacattgacatcatcaacagaacagacacacagattaacctaacaaaaacacaccaaaacacacaaaaacacacaaagagaaccaccgccgaagccatcgggacgagtcaccaccgctgccatctgccggtcgcggaaccaaaacacacaaaaaaacgcttgctggcagcgtcgcggtcgtcgtcgtcgccgcggttgcagtcgtcgtcgtcagctccattgccagggacgagccgccgccgtcaccaccgacggggacgagccaccgccatccgccgccgggaacgagccgccgccgccgccggggacgagccgccgccatctgccgctggagacgagccgtcatgtgctccccgcgccaccgccggggcagatccatgcgtcctccccgccgccgcctctgttgtgctgccggcggcagcctcctcccctcagacagatgggagaggaggggatgggagagcaggggcggcgcggggagccaccggtcgtcgccgccagagccgccgccgctggtcgtcgccaccagagccgccgcctccgtcacaggtggagaggccgggagggaggagagggaggagagagaagaggagtggataagaagaggaggggatgtgtggtgttttaatgtggagaagaggatgaggatgggtaggtgggtgttttaatgtgacagagatttttggttggattttcactggcggttctgtttattggccgccataaaaaattggactgccagcgaaaattatctattttcactggcggcgcacctaattgaccgccagcaaaaatagacatattttcgctggcagccgcattagatgggccgccagtgaaaataaattttcactggcggtcggtgcccctcaccccctcgttataagtttgctggcggttttcacatttttctccagcgaaaataatagaccaacaccatgaaaaatcatttttctagtagtgcctggtcttctagcaaaaggtgattctctaaatagtttagtttgtatgagatctgtatgtaacagatcgaatgttctaaagtccaaaatacatgacaagaatgtatgggacatttttcatcaaagaaaaagaatgaatgggacatcacaacattccatgatcattattagatcttgtaaacataaaacccttatctctacatgccataagagttgtagtgtttccgccccattttttgtcgtattacatttccgtcttccgtctcatatggtcatggacgaaaaaatggcagacacactatggatttttaccatttaaatgagatctggttttccaatgcaaaatatcactagtagatgaaatgatctttagtaccggttctaaacccctatatattaatcccggttgtagcaaccaagataaagaaaccgagactaaagttcttgatctttagtatcgattgaaataactggtactaaaaatgtacaccaagtaaaaaaaatatgtgggatgtgagatttgaactcaaaatctctctcctaagtccttgcacgtgttactatcccacctactacacacatctgacttggatagagatactttggtgttaccaatcgggattaaagatccttcagcattagtcttggttggtgttaccaaccggttctaaaagtgtttctagggacttggacttttagaaccggtattaaagcatctttagtatcggttcttaatctagttgagaaagatcagttctccagtagtgtatgtctagccttcatgtttaactggctgccatagcaatcattcatcagttatcatagtttttgcgccatgaattaaattaatggaattgctaaacctaattcgatagaaaaatatagacaacatcttgtaaatttctaaccttcagctatgcttcatcgtgctccgatggacttcttctccaactccggtattcttgatgaacttcggcgactggtggaattgaccccgaccattccttgggcttagaggaattgccatgggaggcaccaccccatcgatgggtggtgaacatgggctagtggtgatacatcggaggtacagggatgaaggaaggtgatgggtgagacggaagcaaagtggaacttgtggttaggaagaagtggatggtggtggctaggggtgggcattcggtctacccaaaatttttggtttcgatcttcggtctttcggtcatttcagtctttgagaagttgagactgaatttcatcacaaaaaagtcaggactaaccaattcggtctcggcctcggtctcggtcgtaaccgaatttggccagttgagataagattggcaatgaaattttttggtagcacttaccctctttctagacaaaatttaacagttatacatcacgaaaatacaagataataggcaacatcaaacaccaaacaatatatcacaagatcggatcaagtagcaagattaaatcgcaagcatcaatggaggcggaggggggctggtcggctagaggcagaggtgagctggagcctggaagcggagcccagaggcggcacacgggtgcacggcggtggagacggaggcgggatggatggaggtgccgaggcagagggcggaggtgggctggaggcggcacacaggcacaccgcgcacggtggtggagatagaggtgggatggatggagatgccgaggtggagagtagatgcacctaggcaggaccgcgggatgaaggcgccgaggcagcacacagcgctggcgctggcgcctggtggcacgatggaggtagaggcaagaggcgaaggcagccgagtgcgatgggattgggggatggatggaggcggcggaccgctttggcggttgtggctgggtgcctcttcctctctggggtttactctatattagtgggcttattaggcctaataggtctattgggcc

SEQ ID NO: 65991 - DNA, 52474 bp, Oryza sativa
  unsure (1)..(52474): unsure at all n locations
atcaccgtttagaaatgcatagtgtaggcctgaaggtaagggctttagctcaattggggcacgtgacggctgatccatttttggcagttcaatcgtttctccagattcatcctccccttcattgaattcttcgatggattcattgaaatagactctggggcctcgaatggagaaatggccatcaccttctcaattggttcaggaataggaagaggctccgtcaatgaattgattgattgcaacacaaggacagaggtggcgattcttcctatgttcaggttgaggacaccggattcgggcatatctaagagtttctctatgggatggcctatgagtatgtcgaaatcagatatatcgaacacatgaaaatctaagatgacctcaacgctgttgtgccgtgtgggcactccagagataatccctaaaccttcggtagtagagtttgtggaaattcggaaggttttgacggttggttccaacggtttgtcccctaagcaatcaaatgcaaaggttgctgacataatattggcaccaacagagggattatacagaacacggaccaaattacctccaatgagacacgtaatggttgaggagtggcatcgtatctgaatcgattcagatgagagctctccttcccttaaacattcattactcacgatggtggtcaacttcttcaccgtctctttaagcatagctttatcgagaggttcattagaattgaccttggtcggtggtctcttctcgcaggaataattcgaggtgttctcataatctttgaaaagatcctcctcgaattggaatggaatttccggaggatgaatttcttcttcctccggctcctgcgactgggatgaggattcgatagttgagtcgggttccgactccacgtgcagagggttcctcatggataatctcgancctccgggacggncttcgctttggccaaaangaaattcanttttnccttncgaagataagatcttannaggaagttctctttcccttttnccgnnnaccaagnntntttgggttnccctttttttaattttggntttgggccccaanaaaaaaaaccatctcacggaattcagattttcaacagactccttatctaacctgtaccaaaaatgttgtaacaacacatggtcatgtaaagacaagtctgggccaaactgagttaacagtgagaaccttactcaggctgcaccgagggattccttctcgttgtcggaaagaaaggatgtctaatcgaagattgattacacaggttaatggaaagaaagtaaggcagaaattgcacttaagctactcccattcaccgtggaatttcttgacagacatagtgtaccattgcttcgcttcatctctatgagaaaaatgaaacaatttccacttaagagtttcatgtgtcatgcctacgatggatatgcaagaacacactagctcaaagtcccgaagatggaggtatgggttttcactgatactactagagaaggttttctctcgaaccatggctataaagccaggactgatttcatagccatccgaaagggttggttttgaagaacacgatggctcacaaagattagcccgaggagcagaaaggttttgaattgtgggttgctccattaaggaaaggaataaaagaagaagaaataaaaataaagattagcaaccgttctccggcaacggcgccagaaatgcttgttggtatttcttacgaccacagataaatccgcaagcgcacggaataccgctgtagcactttcaccttcggtgaccccaaaaagatatcgaactcagggaacgcgtgtaatctacctaaggctaaggcaatccagggacaacaactataggtaggctaggcaagctagagaagagcattctatgtgttttaattatctaagctaagcaaaggtaatttcctatctgttgcttcgggcaccgacccctgctggtctgccagcgtggttccggctatagctctatgatgtatccgaacgtggaggattattgggacgggattcaaagctatcaccacctgccgcctacctctgacaaatccgtggaatacacaataaacaaaggtaatctgtaacctagacaccacgtctaagttattaattactactctaatacttgtacatgaacttccttctttatcaagagtcctagtactagagcacttagtatgaatactaaacaatgaacccgcaaagatgaaaacctatcttacttagactaaataattaaataacataagaaaggaacacgaatgcttactttatagaagaagttctccgaacctggagcagagtgtaccgacagctccggtactcctctagaattcctcctaagaagctacactcgtcgaggtagaaatcggatgagcgccaaacttccgggcactcctccagagcttccccttactctctaccttattctaatgtacaaaagatacaatagagcctcttgtaattcagctcaaagttgtgtctattggaatgtgagtgagctcctccttatataggctccaaatgacagttaggggcatgggaattgtctaaaacaacctgcaaccgcctctgggaagaaatccgagccgtctaggtgaaagcagatggcgggaagcgctaggattggttcggccgaacccaaaaactctcctcccggcctctccttgggctgggaggttgcttattgggcccccaacaacctgggctatgttttggcccaattctaaatggtttttattgacttattgggcatctaatccgtgtaaatatgtcctgaatacgcggagatgcattttgtcatatgacggatgtgttttctcctcaaattacttgcatacacatatttcaccaacactagtggaaatgattagtaataatacctaccactaagttggataccatgttttatttcattatatacaggtattgacggtcagatattatgatttaaggaccgtcaacaatattcaccaacactcgtggaaattgttagtaataaatcctatcaataggtttaatatttcattgatttgcttttttacaggaattgatagttatatttggtatttaaggaccgtcaacaatttcaaaacatgagtaggtattacctctcatcgagagggcctaaggctgtattcgataccaggagttcctaactcccccctctcgttttccacgtgcacgcttttcaaactaccaaacaatgtgtttttttacaaaaagtttatatacgaaagttgcttaaaaaatcatattgatccatttttgaaaaaaagctaattcttaattaatcacgcgctaatggaccgctccattttccgtgtgagggtgatgggttcccaacaccaaccaacgtgcacagcctaaacctgtctaaacctttgtcctgatatccatccaaatttagatctcatacgctaccccttttactactgttgatataggacactgacagttggcgcgccatgtaggggttgcatcaagttttacaatgacaatcgtgatgaaatcatctttaggagtcgtcagatttgtcttccctccaaggaagacatttagtttcggcagttttgactttctcaccgacaacttcagcaagcattcagtcttcgactcagattcaaacaagttggcggggttcgagacttcctcggtcccttttggtctctcgaatgcggctgtggcccactccagatcggatttccatggctcggcctcaaattggccaggggagtcaatgccactagcttacccggacaacatctccaacaacggcggcaaactaccctaagattctgatgcaactctctccgcttctcgctgcgacgatttgggacctacaccgtccccgtgaattcaatccaggcatgattcgaccatgtccgaacatggtcccagggaagtaagcctcctgattcgtttgctcgatgattcctgcagcatcacggagattgtatatgacctcgaccactcggaggactatgccagattcagcacgggaacgatctacagctccaagtactccaatgattataccctactcagggaagtctttctggttggagcaccaaaagaggacgagcaggcccacatctagtaggaagcggaggaggagcgcctacgtaaagaggagaaagaccgcttgtggaaacaatgtgacctaatgcatccagggtgcgcgacatgtgacaacatcatccaaactacaacaaaacagcattgctgttgtaatgctacttgacaccctaatcgatgccttagacaacgccatgactctgatgctcatcaaggtcaatgccatgatggtcaccgcggtcgcacaataggaaagggagctagaggcactcagcgaccaagccaaccgccagaggagtctattaccaacacacccaagactccatcgggcaaccgaccaagcaaatggccatctcttcacctttcaagggaccgccggtcagccgagagcagtcggggccacacagcctcaaatcttcaacactgcgagcagaataacggaacaaatcctttcgtcgaaaaccgtgataacaatcatcgtgaagacgaccaccatgaaagtgaccatagacaggaagacgaccacgggcatcgggaaggcaaagacctcaggattgaacaacaccgtcgtcgccgagagagaagaccaggatcgctgcagttcaccactccccccccccggtcgacccatataacctgattatgctgatgaaggaatagcaacttttacccgagacctacgtcgagtggactggccggccgacttcaatccagctggtatcgagaagtacggcggtaaaaccgaccctgagtcgtggctcaccatctacaccttggccattcgcgcagcaggaggagatagcaaagccatggcaaactacttgcctgtggcactcactgattcaacaagaagctggcctttggggcttcgagatcggtttgttgcaaattttcaaggcacctacgagaggcccgggatacagttcgacgtttaccacgtcatacaactgaaaaataaattattaaaggacttcatccggcgtttcttcgagacatgcaacaagattccagaagacacaaacaatgtcatcatcgttaattttcagaaaggaattcgtgacgaaaatctcatcggcaagttcacccgcaagccgccacttaccgtcatgaagctcttcaaaacagccaattcagccgaagccatcaatattgtgcgggaggacaagcagtctagtgctccacatctggtgaaggataataatgaatatcacaagaaggatcgcaatcgacgacctggaaacttggtggccacaacgtcttattgtcagtcacattgtccgagtgctagaaattacaaccgaatcttgaacgggcccagtccaaatcacccaaattccaaacaccctgctaaggactgagtttgttgaagaccgtgctaagcagttgaagctagcagctggaaaaggaacttcaggacagaacaatgacaatactgtccggatggtttccaaattccaatacccagaattgagctaaaccacatatttggtggccctttagcttataagttcaagagaaagcagaagctgatcgatcatcatatcaacataatacacttggtgaataacaattctcaaaacacgagtagggtattacctctcatcgagcctgaacttatctaaacttttatccatacaatccatccacttttaaatctcgtacgctagcccttttagtatcgcctatatagaacatcgacagtttattaatttccgtattcaccaatgccagtgccgtgtgccatccgaaaccactacaaatatgctcgaggttgaaaattctgtaattgaaattatggttggaatatgtcaaaataaagtctagagttgatatagactactggacctccataaatgtttaccattggaacacagtattagtcctagctagtcaataggtgggaagtaattcgacaagtaggtactggtattggatatacaaagagtttatgaggatgtttgtccatccaatagacatatatccaaatatatatgaatcttgtttgaattttcgatccataaatcaaccgagatctagttctatgccaaatttttacttgttcccacaatcccgtttcggcaccaatttttaagttgctgctgaccttattttttcacctgggaattaaaatgtcaacgagacatgcaggaatggaatggaatagataatggatacacttccgaagttcttaaacagtgtgttttttctaataactttcaatatatatatgaatttcttagaatacctttcaaaaaataatttttgaatttaatttgtaatagttagttcgttcttttgtaccttcaaataattatcacaaataattcatccactcatccattccattccattctattcagcacaaaagagtggttgttcgaacatgccatgttaacatttctaactttgcctaaataccatcgaccatttgcatgcaacggtgaccatatatactttctttatacagacataataatcttctgctattatatcgaccattcagaagttttccatggtaaacactagggacaaaatcgtggagccaaatcatctcaccttctaattaaaaaaagcatctcacctgcttcactcacttttcttttcatcagggaattagtttgagtgaactaaatcaatccataggtacattaaagctatatccctggtagtattctgaattaaacagaagaaaatgaacctcatgcatactgcaacaaagctctactatgcgcctctaatttttctccttctactggctactctatatatgcaacactatatatgtacatctaaaaaaaatatagcatgattgtcaccttgtcctcgctcttgattttttgaattatcgtggcgactaaaaaaatgatgtagacccctctttggaagagaacacaatgattggagctaatctctctaatatactccctcgatccgtcctaaaatataagtatttttagcatagtgtcaagtcaaatatttgtaacgttggctattaatagaaaaaaaaaattaaaaagatcaatcatgtaaaattaatgttactagatttatcattaaacaaactattacaatatacaactctttttttgaatatcattgatcaaagtagtatctggaagaccatgtcgaagtccaaacgtgcttatattttggggcggagggaatacaaacagcaaaacatgaaggactctcattattcaaaactgagcaaaatagtcgttgtcaaaaccaacgaaagcaatctctaaaataaacaaaaaactgtgaaagcatgggaagaacttggcatcattcagacatccaatccccgagctgacagacgttatagacacaggcatatgtacagagcgcagttagctgcgacgttgctttccaacttcaaaatgatggttaattaatcaaatgattgatctacttgatgaattgttgcacatgcagtaaagaattaataatgctgcttgttatggaaaaatcctggattcgaggacaaattaaagtcgatcagacaggagaggaaaatggcaacatttgataaaaggacaaggctgattagaaagatcatgtcaacagtatcttaaagcagttgaatgatctgttatttttagctaaggtaatttaattatatattcaattggatgatcatgtcaacagtttctttaaaaaatagctgatttctaaaggcctcgactagagagggtcgagaaactcataggtaattaaatgaattatggaccacctgtaaaaacaatctaacataaaaacatgtaatactccctgcggctcaaaatataacaatttggccccgttcgtttcttcggtaaggataggataaaattttaaattctcgtggcacatttttcaaactgctaaacgatacattttgtgaaaaactttatatatgaaagttgatctaaaatatcagattaatccattttttaagtttgtaatatttaaaactcaattaatcacaagttattatcacctcgttttgcgtgaaacacttaatctttatcttcctaaggagattcaaacaccacttttgtagcctttaagatttgccccaaattataacaacttcttcaccaacattctttttccaaccaatcacaaccctccaccattcaatttttccacctacctacacttcgcatccaatcacaaacttctcccatttaattttttttaacttgttaataaccgtcttatattctacaacggaggtaatattacttttttggacctaaaagcagaaaagcacatgtcactggtgcagaaattatttttacaggtggcgcattacccctttacgtgggcgtttctcaacccgcctctaggtgaggcttttagaaatcagctatttttgataggtgcatgaaagaacaccgcacgtgaaacaaatttagtctcagcctgcaaaactacgattttcacaggttttttcataaaccggccgctagttgtgttggataattgaagaataaaataaaattgcagcacctatgcagcattgcatgcccatagggatgaaaactgagcagatatgaacaaataatgccataccatatttgttttttttattttcttccagatatgaaaacgaatatgaatatatcacatatggaaacaaatatgaattatctcaaacacaaataaggataaaatatgatcaggcatgaatacataaacaaatattcccttgaacatgaaagccacctaatagaatcaaataaatgtctaattgatactaaaatatataaagtatagtataatttataaaaatatttataggtctaaataatattaataatgtagactactgattaaagaggtagctaggttgaaggtctagagctagaaagaaatggggtatatttcattcctttagtggatatgcgaatagcatatatatatatatatatatatatatatatatatatatatatatatatatatatatatatatatatatatatatatatatatatgtatccgtatccggactatccgctccaaatggtacccatatttgtcagtactaccatagagacagtgtatctatatgtgtagtggcgatggagagagatacaatggcgggggcgaagccaggatttgagattaggagggtgtggagtgaagataaaccatgagaccaaacaacttatattgatagcaaaggaagtgaaatagttaacgtaaataataagcaatacgtaaactagtccttttaagagaaacttgaattttagctctttaataatatcattgtaagtttgaaactagtctttattgctaaattcttttaatgtaaactattaaataatctcacaaataagtatcatctattttactttgaaaaagatgagaaatcacaaactaattttgtagatcatgtttattgctaatatttttagacttgctaactaactaaactgataatactttcaaagcaaaatttgctacaggacattcaaaaaacgtgtaattagctaggagacaccacaagaatgtgtatttgctatagagcatcgtaaaaaactggtaattagctgatggacaccaatgaaattattttattatatttgaaggaatatgagagagaaacaagcattaaagaccagtttacccttgcctcaaattagttagtcttcactaatcacatattctcatcgccaagaaaagagcaagagagaggagaagacacggctggccacgccaccgtcactctctcgagcgcagcagcagagtcgtgtcgtttcctccgagggcagcagcagtcaccactgccaccgccgctttctcgagcgcagccgtcgccgctcccttcacgctgccgttaccgcgcaccggaccacgcgcaccctctgcgccgtcgtcgccgctccctttctccgcgcataggaaccatcgtcgcatctcccattttccggaagaagcaaccgccgccgctgccgcttcctttctccacgtgcagcagctgtgctgccaccacagctccctccctccgcaagttgccgctgcgccgccatatgaccgtgcgaggcgtggcgtcggcgccggcgggcggaggcggctgttcggtgcgttccggcggctgcgggtgcggtggctagtggcgttgtaccgccgctcgctgcggcggctgcgcgcgtactacaccaaggcggtccaagacttcctcgagggcgcgacggccatgagcacgctgcatgcactcgtaggctgccaccgactgctcgtttggcgccgtgttcacgccgatggtcgtcgtgaaacaataacaccagtggttgccgctcctccttcgctcgcaggacatgaagaaatggagcagtagcaccggtgacggcaggcgagcgaaggagcggcggcgacaggcgagcgcagctggtggagcggcgacggcgggcgagcttaggaggagcggcggcggtggcaggcgagtgtggcgggcggagcggcgacggcgacggcgacggcgggcgagcttaggaggagcaggagcggcgggcgagtgccacgacgacaggcgaagcggcagcgagcaaggttgaaggcagcggttgagagcagagagagaatgagagagggagtaaaggatatggaagaaaaaaagaaaaagaaaaaaaatcaaagggtagaaccgtacttacatagctgtttctctcttcaatttttccagatataataaaataatcccacgggtgtccagcagctaattaccacttttttgtggtgccctacagcaaaaacgcgttcttacggtgtctcctagctaattacacgttttttagatattctgtagcaaaatttgcctactttcaagctacacaaaataaactagataaatacttatcttagctaacttaatatagagtaaaaacatgggggtgtagtggtggtagtgtttggatagaggggtgttggcacctttagcaccccctacctgcgccactgcctccagccacgcctcctcctcgccagtgtcgcccgtgaaagctgctcctatcgttgccctatgcagaccatcgtatacactccgccccgctgattaactccgcctcggccttggcctctgcctccacgccatccccggtcacctcttcctccatggccccctcatccttgtcatcggcgtcatcaccatcctcatcagagttttaaataaataagttgttattttttattgtttttatatgtaaatcattttacatatgctacacaaaacattttgcgatattcagtgtcaaagaaatattttatgatattatcttctgttttaagtgattcccccctcatatgcaaaataaaaaagaagagtagcctttcaaaaagaagaaaaatacatgcatgaaagaaaccttaaaaaatatacagaaacttctatatattttgtgtagagcctagagaaattcatatatttttgaagagaaaaactagcgaagatgtaccgtccattaatggttataagaaaaggacatccttttttatcgcttggatgtaacctttgtgcgtaccatatcctatcttcctatcccttctttctatatagttaaagacccaaagctaaattgtggttgagccacgtcacctgtaaatctcagccattgaatatgatctgaacgcttggtaacgcttcaatcccagcccacttctccttccggcccgtttggttggggggagtttttagaagggattgggagtttagagggatgaggctattaactattttatttggttgggagatatgagaattttggtgggatggggatggggaattgagaaatgaactccctccttttcaatacctggatagggggtggtaattgggagggaattcctcctttacttcgcctaaacaaatctcagccatccgttttcattaatgatctgatctccatctaaactccctatcaatttccaccacctaccaaacaagagactgggatgaaaaatcaaattcacatcttaatctcaccatcaatttcctcgtgtaaactcccaatccccttccctcaagttaccaaacaagccgttcattgccatccgccctaccgataccgccaccagatgtggtcgcgctcccttctcctgcacccgtgctccttctccgccccgcacggcgccgcgctcgcgctcttttctgcttcgcacccgagcgcgcgtgagagagatgcgccgcggagcgctccttcccctcgatcccccgctgtcgctgcgctctcttcttctctgcccccgtgcgcacgcgagagagatgcgccgcgggcccgccgacccccgccgcgccggttccccccatcgcgcgcttctcctccccacgtcgcactgctccccccatcccccacacggcagccacgccgcagcgccgcgcgcctgtagccctagccaggtgcggctgcaggtatcgcgtgatggaggatgcgctgggagccctagcgccatgccggtattcacttccttccttaatcacccgcatttacaatagaaactgccaaatcaattgggtgaggaggcgaaccgccaaatcaattgggtgaggaggtgcagtggttaatacaattcatgtgccccttctgatttgtcttttataattctcttgcaaaccttttgataggcctcttgcaatccggcctctcctcaaatccatacatccctcacatcaaccgttctgtgtgcaagcctcaaccacgcaccccttcatcctacaagggcacatgattgcaatcgagtcatgtaaggttagttgtcgacaacctttatcgattcattgcatgtaagcctattgactgattttatatgtctgaattggttatttgccctgagtactgattttaatttcttaaaaaaaatgtcaatttattctatttggtaaacctgaacttgatatgaaatttgaccggattctatttgagtgtgcattatgatttaaactaatctgaggcagtatgaaaggtctgtcgattggtttctctgaacctaaaagaaattaatccctatcctatacactagctgttgttttagtttgtttatgagagattcgtgatccctgcatcctatacttatacttcctccgttccaaaaaaaggcaaatcctaggtttccgtgtccaactttgacagtccgtcttatatgaaatttttttataatttatattttcattgttgttagatgataaaacatgattaatattttatgcgtgacttgtctttttaatttttttcataattttttcaaataagacggacggtcaaatatttggcacggaaaccagggtttgtcttttttgggacggagggagtatgttctaacacttcaatttatttgagcagttgggaaggacccagaggattgctatatagttgtcctgacatagcgaggagcagcaacttactcggtatgtattttgttcggctcttcgcacacaattcatgtttttcctacgactttctataaatgtaaataaataatctttatcctatgcactggctatttttccaattacttaagaaaaaaaccgtgatgcttgcagcggatacttatatttcctaccactttagtttgtttgagcagttggggagataccagggatcgctacacaagtgtcctgatgtagcgaggaaccgcatacctgctcggtatgtcttctgttcagctcatcctgtgaggcacttcagtacgtgtgaattccacatgatttttgtctcaattaaatttcagtatatattgaggtaaaaaaaaagatcatgcagaacataccgcatttgtcgcagtgaaagaacttatccacaccaccagttctgaaaaaaattgagcatatccaaaattgatcaaactgaataaaacagtaaatgcagaaaataattcatagagatagatttgggacttgcctgcatatgccgcatccatcacagtgatactggttctttgagacctggaacaaaccaaacaaatatatttgtcaggatttatgaaccataattgccacattagaaacttagatgtaacgtagaatcatcatttataatccaaaaatgcttacatcatcatcaaagaagttgcatttttcacagaagtatttccccatgcatgccccacaaccagagcagtactttgtacccgtcgatcaaagcgaacaattttcatgtgatcagcacagaaaaaaaagttagcacactccagaaattctactgttgtacactcgagaaattctactgttgtactgttgcacgcgcaggaaagctatgcactgagtgctgttttcgtttgttaaaaaagaaactatcctatgcactggctatttttccagtttcttaagaaaaaaaaccctgatacttgcagctaatacttatattccattgactttaatttgtttgagcagttggggagataccagagaattgctagataagtgtcctgcatagcgagggatcgcagacctgctcggtacgccttctgttcagctgatcctgtgctattcctaaaaagatcttgctgttcctaaaaaaattctgcttgcaatgtttccagtataagtttgagagattttgtgattgtgactataaatttgcaactccttggacttgaaatgagttttccttgcttggtacttttagcaattaatgatgcaaatatcatatttaattggtcaagtagcagaactactcacttttgaaattatatactatgttatatcctatttggtcaggtagcacaactgcccacttatatcttcattcttccctccataatttttttatacattttaatattatgtgtgcatgtagctaaatctaaaggagtttttgttgcttctaatgttcccaggtcatatgttgaaaggagtaaaacgcagctccacattgttagcttatgaccttgatgccgtttcaaggttttcttacttgagtgcatattttgcgtatcagtttgtttttagaactaaacaatacaatctgattgttcatatttacatgcatatttcatcttttctaatgtgcccgtcgcaatacgcggggtttcatctagtattattggtacctaatacctattaagtggtatttaatcttataaaataagatatataagaagccacatcgtcaataattttaagctatcaaatggtattagtacaaatataacaactgttggatcaagaagctacttatccatctaattcaattatttattagtcgtacatccaccttcctttactcttcctcatagtcactcgtagcacttttacctattttgcacataacaccgtgtttttctcttccaagtctagaaaattagtgctaacttttttcgaatacaatttaaattatattttaagatgttagttttgctttattatgcatgattagatagcaaataatataattattatgtattgtcgacgtttgagatcgcgactacggtatttggacggtatggggatcgttggtatcagggtatatgcgagattgaggtcaaagagatagagacagggatttttatacaggttccggccacttatctgacatgtaatagccctacatcctgttggccgaagccggtgttgctcctttattcatcataatcacaccagtacaataattgggataacttgtctagctgtcgtcgacttggcggcatggataaccaattcgtggtcgacgacagggtagtcttcctcctcgaatacgaactcgtcgagatcagagatggcactagatccctcttgtcggccttcgtaggcaccgtattgggtttgtctaggcttatctctgatgttgatatctagcagcgtattggtttgtgtatatgttgtgtcttgtggcttgtcccctctcttcctagggggcttgtatttatacccataaatgcccccttgtccaaatagaactagggagaccaatatggatacaatccgagtagttcttgtcgtttccatgtagaactctagtcgttcttcgacatggtacatggtgggccctgccgagcttagtcaagtactattaggtatgtggtattcataaccatgacatgcatctttacttgaacctattttcagaacaagtctgagtgaagtagagagatgcaaactatctagctgcaacgatacctatattgtgcataaaaataatattcatatattataacaacacacaattacactttaaaaaataaagcatgaattgtattgtaataacttatgtatacataaatccacattatcatatattttgtgcatacaaagagttgcacctaaccatttaaaacttccactactacagatcctatttttccgtgcgggcgttctgattatcccgtgtggtggtccggcccgtctgcagccacgtgtctgggaaaatcggtattttcgtgtgcgggcgggctgaccgcacgggataatagattatcccgtgcggtcgtgttatacggaccacacgggataatcgtttatcccgtgccttccaattataccgcccgcatgcaacaaaaaaaacaaaaaaataataaaaaaaaccctaccctaaccctagaaacggccgccgccgctcgcgagcagcacgccgccgtcacccgagctcagcgcacccggatccacacttcgtcatcgtcccgcccactgccaagccgcgcggggccccgccgccgtccgcgcccgctgtgcgtgcacgcagagccagcagcatcgcctcgtcgtcatcgttgtcgcgcccgccgccgctcgttcgctcgcggagccgccgcaccgcctccgccagcagccgccgcgccgcctcgtcggcggcggcggcagcggcgctcgatcggtggggaggggaggagaggaaagaggcagagagaggagagaaaagcggcagagagaggggaggggaggagatcgaggagagtaaagggggagagagaataaaaaggaagaagagagagagtgtgtgtgtgaaaaatttgaagtgggtgggagggaaaagtgggagagtatttttcggtgtggtccacttaaaaagcccgcacgcgaaaatcgatttttccgtgcagtcctcttaagtcgaccgcacgggaaaatgcatttttccgtgtgggcaagagcccaggtccgatccacggattttttcaggcggagctacttatggtccgcctgaaaactaccggggccggcgtccagtctagtagtgttcgactttgttcggcaagtatgatacaaacatgggccatacaggtgtctctttctgctagactaatcgcgtgttcaccagcccatagagagcaaccgtacctattccgagcaccacacgttatagtctcccaaattatgggccaaaaaagctggacctatatatacttctaactgtgtgagaaagagcgagagatgaataattcataaatttcacatgttgtcgtgactcgtgaactgaatatcagacgctattatcaactaacacaacaaaatctatcttacaatacactttttaccaagtgtaatcatattgtactattaatctctccattttatatcataagtcgctttaaatttttttctagtccaacctttttgagtttaatcaagtttataaaaaaatattataatatttttaatatgaaataaatatattatcaaaataaattcaatgttacataatgatactatttttttagtgttgtagttgttgataaattttttaataaacttggtcaaacctaaaagaaattgactagaaaaaaataaaaacgactaatggtatgaaacggagggagtagcatttaggctcttcatgtatcgtgacaaaagattgttctgagttttgtctttaaggccgagtttagttacaaacttttttttcaaacttacaactattttatcacatcaaaacttttctacacacataaacttctaacttttccgtcgcatcgttccaatttcaatcaaacttccaattttggtgtgaactaaacacaccctaacagttcaggtagtgctcaaatggttggatgaatggacagtgcacatgtacatacacagttgcttgctaagacatgtaaatacacttagtattttgcttatgtagttcatgcaaatcatgcacagatagtttcctttgtttaatggctatcttgtccattggattgcctatcttataattttataggatttctcatcacattaggcatgcccatttgtgaaaaaaaaatttgctaagcccatgatttttttttttgcaactaatgctacatgtagtaaaatcttcagcagaaaaaaaactacctatgagtattttggtttgtcacatgcacatcacaatagtcatgagctaaataaagtttgtcattttctgaattccaatgtgccttcctttatatgtcaaattcatttttttatgcagaggaccttatacttgcaattaatggtgttttcttctacagaaccctccatcaagctagtaagctaataagtctataacccaagttgacaggaaacaagttgactcccattttttgtcaggactcatgaaagtgaaaaacactttcttaactatgggttcttggattgtaaataatggggaacaaataagattttgggaagataaatggctaggaaatatggcttatagagaaaagtatccatctttatatgctattgtcagaaagagaaattcttctgttgctagtgttatggcttttgttccgctcaatgtttcttttaggagagctttagttggtcagaatttaacactttggtatgaattgtgtgcatctattgttcatattaagttgaataatatttctgattgttttagatggaactatcatcagaatggccaattctcggttagatcaatgtacttatctttaattaacaatggttacattgaaaaaataagttaatttggaagcttaagatgctgcttaagatcaagatctttatgtggtacttgcttaagggagttgtgttaaccaaggataatttagcaagacggaattggaatggtaatttaagatgttgtttttgtatgaaaaatgagtctatccaatatttgttcattgattgtcattttgtaaagtttatttggagagcagttcagttttcttttggtttatatattcctactagcatatctcatggtttttatgattggcttcagggagtggtaaacaaaaagagcaaactgatacttgttggagcatctgttttgtgttgggctttgtggttgagtaggaatgatagggtttttgacaaatcacctaccattacctatatgtaggttatttttaaggcaacatattggcttcgtctgtgggcacagttacaaaagtgtgatgaagatggagaattctaattgttgcatgtcgtaagcttgaaacgatggttatgcaactgtttgccaatcatgaatggaaatttaccaatagactggaataatgttattttgtatagtttggtttccttttaattttggttggtgtgtttgcttttatttggactacactctcttatagagtgctactccctccatcccaaaatgtaagtatttttagctatgaatctggacatctgtatccagattcatagctaaaaattgctatattttgggacggaggtggtagattataataattggctgtagctcttttgtgcaaatgccgggatgttattttattccattatctaaaaaatcaagctagtaaggagttgcgagttgcaacctcccccctcctactctctcttccttggttgtacctttttcatccatgttttcccattagctttcagttcaaatgaaccacggttagtttaccatatagttgttttcaacatgattgtttcttaagcagacaaggaagtttgcgatcaccctaatgagcgcattccgcggtagtgagcagacaagatttttttgcttcttttgcaaacatgaattcagttcctctgcttagattgctatgaaaataccaataggccacttcatagctgtatacctgtatcatgtcaattatcaaaccatgcttgcacatccaagaaaagtgtgtgcagcggattattgcagatatactttgatacagtaagtgaagaggaggaatttggatacatttatatgataaataatttccagtgctatgatttcagctgccaaatttacaattttcatgtacaccgggatattcttcttggatgcattcattaacttcaaactatatatgataaggaatttcagtgttatgatgctacctgccaaatttagattgttcacgttgacaggggatacttttttggatgtatttataattaataaattcaaattctttaacaatttatgtgttatcttctgtgtagataacaatttcaaaatttttcagacgcagaagactccaaagctcctattcctgcaaatgacaggagatactccaaagctgtcatcgacaggcttcctatagcttaaatgcttaattattagagtgttattcacttctgtaaaactgatctttgctcggtcgacccaaaaccataatagttccggaactaaaaataatctttagccccggttaaaaaccccacagctattctatgatctttagtcccagttggtatctttagtcccggttcatcccctgttagagacatgtcagggggccgaggatctttagggactaaagatcactttagtcccggttggtattaccaaccggaactaaaattcaatacgtagtatataatcccaaacacttatcctctcctccacaatcgcaaccacttattcacacagatcgatcctccccttcctcctccccttcccctctcctacaaatattacacagatctttcctcccattcctcctctcctcccctctcctccccctcctcccctttctcctcccggcagtggcgggcaggtggccagcggggccgcgcgcggcggcggccgtggcgggcggcggcaggcggcggcccacattgttttcttttcttttttttataatttgtgattcactaagatgtataatgttgtgattcattgtacatttgtatagatctgagatgtataatctgtgtgatgtattttatttgtttgtaattttttgaggatttgtgatgtactacctccgtttcatattataaaagtttctagcattgcccacattcatataaatattaatgaatttagacattcatatatatttagattcattaacacccatatgaatgtgggcaatgctagaaagtcttataacctgaaacagaggaagtatttgatttgtgtgtataagtaactttaagatttgtgatgtggatttgggatgttactttgatttgaggatttagggtttgatttggggatatgtatgccactcgattcaggagaaaaaaaaagggaccatctggactgccgctaacctctttagttccggttggtgttaccaaccttattatcacccactgagaaaacatttgaagatgcatgcatgttgccacaccttgcatagattcagaatgtcgacctaaaaagagaggtgttcgccacttaaattcagagcttgtaattgcaccaagagtcttaagactaaagtatacgccattcctgaatgactcaagaccaagacttgattgttcaggttcagataggatatcaaagctacatggattttttcttatacaattgcttgtttagagtaattgccctactagacaggagtgggtccactattgattcaagggtattcagatgtatacccaagattttttaataaaaataagtacatatacattacatatatgtattaaaaaataatttaaaaaagcttcaaacagcccaacaagcaatcaaactactctttttgggcctgcttcatcctttggcccattggcgccggcccaaatttctcacccggccactccctctcaggcctcagcccgcactcccagcccactccctttctctccccctcccctaatcctagcttctgcctgttgtggaggcggaggtgcgcggcgcgcggcgggaggcgactcgcaaggcggcgcggcgtgcggcggcgggcggccggctgcggactgcggcgcgtcggccagcaagtcgcgaggcggccggcagtcctgttactcctggacagcagcacaggtagtcggggatggggagtgattgtcgcattatctgattgaagatttgtagtataaatattgaattcactgatttcatgatttattctacacttctacttatctaaatatctagtataattgcttagttggtagaaccattgtttatttgtttagttacattcattgaaagagaattcttcttgcaagttaaggataaggacatcatcacttatttttaaaatatcaagcatcgaaaagttgatttctaaattgtaaaatttcttcccaatttattcttttctatcctttatgtattctatatgttggtactttgatatattaccaattagtatttctataagttaaacaatttcaagtaatgatcaattttatctttgtgtgaacttatgctcgattttattttatatcgctatatattatataattattaatgtgtgatactataaaagctaaggcttttaggtgtatgaacaaatttttttaccctttcctatttcaaatacacaagttgaaaatgttagcccccccactgctactagacaagcttggtctagctcggtctgttactcaggtttcgttgtctagctcatgaatctggtaattccactgtaatgtaagcgcactatactaatactcctactacttctaaaaagaagagagaaaatctgcatgtggggtcctctactgagctgtcaatcaagtaaggtcgaaccgtttggtgacatgatttattttccttaattttacgaaactggagttttccataattttactactatcatttctgtccatacaaaaccatgataccatacagacaacaattttctgtacactgacgttttacatggaattgaagacaaatattaaataatatttctatggcacaagcgtaaatacattggtaatatccttcaaaactagatcaaatcttgctagtacatatgatacgttcgataaaaaatacttgatgatatattataaaaatcgacactgatgaaaccaataatacctactcaggtggtgtttgaatcttctgaagatgaaaatgaagattagatgtttcacgcaaaacgaggtgataataatatgttattaattaagttttaattattataaactttaaaaataaattaatttgatattttagagcaactttcatatagaaagttttcgtacgaaacacatcgtttaacagttttaaaaacgtgccacgataatccgaagtggatggcgcacagttttgacggactcatacagggatgaggtgtgactgaggtggctgtcatgtagtagaggtgcatggaggaggcagcatgggatgaatcggctgcttccatgcgagaaagtcacacttatcacgtttatactgtcgacaatatacctacaattgcagcccctgaaaagaatattacaacccccttagaaaaaagaatgaaaaacgctatatgatgttatacaacccagatttctattaaaaaaaaagataaaacgattactcggatcataattgagggtgtcaaagtatacttttttttctttcatctctaaacactaggtatgagtaatccgcgtacggatgcatcatatatgggccgcattgctacactgggcctaactatggtttggacgatggtcgttccaggcttcggtgccagtggcaaaggcaagaccaaataaccacttccatttttcttttccttcgcaaagaatcaaagtccagttgactagtttacgagttgcataaattccacggatgtgaatcagattccaagcattcaacagcacgtccaacgtacacgacaagacgaaatggttacaactaatttactaatcatcatctgggattagcatttttttttctgcctgccagatgctgagatgatttgctttgctgatcacaaaagaaagaacaaacccaacctacagccagctttgaagccccgggtttgttgctgatgcatggcattttccagactggaaacgcagagcaaaaattcgcagcaacggtcctccccccatgtgagccggtggggcccaccgccgcccgctacacgccatcgcgatcccagcgaggtccagccgtgtagtgagcgagagcgagagagagccgttgtgtatacttaacaatgccaccgttgtatatatacaatccgtgttgcaagaaaatcaatcgacataagcaagggaaatatcagcatctgcaaaaatcatctcagattcgttcgccatggcgaggatcccgttcgccgccatcgtcgtcgccatcctctctttcgccatcgccgcggctgcacaggcgcccgcgccgtctcccaccagcgacggtgagggatcggatccttccatgattcagtttcagctgttgtgattttggcctgatttatttgtgaatgtgtgattcagtttcagctgttgtgattttggcctgatttatttgtgaatgtgtgatgagtttgcagggacgtcggtggatcaagggatcgcatacctgctgatgatcgtggcgctggtgctcacctacctcatccaccctctcgacgcctcctccgcctacaagctcttctgagcttatgcagagatctcttcgtcgccatggtgttccttctccttcttggatctcctcctcctcccttttgatagtctagtggtggatctctcattctcggtgtaattaattagtgggatttttatattctttttcagctcgcgttcgtttgtaatttgggtcggtggtactgcgctgaggatcgatttcgcattgtgtatatcattcatcattctttgctgttctcatatgcatttgtatcatgttgggaaatttgttttatccctaagttttggattggatttgttgcttgctccctactcgacggacgtgagcccattaattgcaattgggcttacggaccagctcggcatgggactgtacggatttgggtcaaatctatatctataacttaatataaatattcgtatttttccggtcgtcacctcatatgtgcggtgtttgttttccccctcgcctccccacaaatcccagtcggaattgcatcacccccatccaaaaaaaatccccaatcgaaattcaatcaatcttcacaatgggaattcaatgaaaccccccgaatcccaattgcactaagaatcgggaaacacatcccaaaattggcacaatcaaatcggatgaacacactgcaagaaaattcaaccaatctttatccccgaaaaatcatcccacatacatacatcacaaaactacactccctcctgccggtggatccatccgcggccgccgccaccgccggcggatccatcaccgttggatctagggcgggagggaggcgagaggggaggagggagccgccgccggcccgcggccgccgccaccgccgatggacccaccctccgacgttgccgacaccgccatcgccgccggatctgggacaggagggaggcgagaggggagaagggagccgccgccgccgccgtatccgcccgtagccgccgccaccaccgccggatccacccgcggctaccgccgccgccgccaccaccgccggatctgccgcgggagggaggctagagggggtggagggagccgccgccgccgaccctagagggagaggaggagggggggcgccgccgccgaccctagagggagaggaggagggggggcgccgccgccgtcgctttgagagaggggatcgggggcgccgctcgccggtcgctgctccgcgccgctgcagccgctcgggggaagagggggggcggcgccgccgtcgtcgctcggcgaggaggggggagaggcagggggaagaagggaaatgaatcttagggttagggttagggtttgggtatatttatttaggttaggattaatctggaccgtccattcgatcggacagctccagctgctcccacgtcgggccgccgacctattgggccaccgaatggaggacgcaaaatagacttcaatggagaaaggaaacaggccagacacatagaatagacaaaagggaggaaatataaactttgctatattcggcccaaacatagaaaggaggattttgatttttttttcaattaaataattgttaaatgatttttgtattattaaaaattagcaattaagctctgataattccaataaaattccaaagagcgtaactaatcatggagaatttaataaaattaaatttaatcatgtcattttatttttcacacttgctttacttgtaaattgatttaattatacacctacctacttaaaaataccaaatattttaattaattacataatgtaaattttttttttaactttttctcaatttttttgttctgtacacttcccgttgcaacgcacgggcacctttgctagtaattctaaaaacaataatagtctttttctcttttttagatacacagaacaaacacagaagctcataatacgcgcacactcatacacttatgagtatctccagaaaattggaccggcatatcttaagattgatgaagtcactacaagtgtctcgctgctgacaggtacgtcgcctatcacaagaaaaataattagctataaatacaaacaccactattaagtataggacttgaatggagctagttccaccacaagtaacctaagctcactttgtaatatattcttcaacacattacaaacgcacacaccaacacatacgccttcgagtgactcgattggtaagctattcttataaacggatctaaggaatcggaccggttaccactatgaatgcctccaaaggaccagatcgtatagtatcgcaattagttggcaaggttccttgtggtacaacttgttcatccgtgttccaattttagctcgccatgtgtgctcatatagagggtggtaaagtagcatctttatctcaagttagcttctgatcttagcaatgatagggagaaaatcagctagacactggcacgggatagatcatctcaaccgggtggcaaacctcatatgtgtcgggggagagctcccgtcacgaaccaaaggtcacagatgtaagaagtcatctgtatcgggcattttaccatcacggatgatagttatctcaatcaggccaaaactaaaacccgtcacaaataggtttgaccctacagatgagtcaaactagggcccgtcaccgattagatcatctgtgacaggctcatacttgactcactagtttgggattgatgaagagagggtgagagaaaagaatggaaccactctcacccctaggccctacgacgtggccaacttgcagaagctaggtcgccgccacaagaggatatgaatctagagtgagcttgcatcaattgcttaggaagattcggcaagaggatgcctagatgacacctccaaggagagaagcgacgaaagaaccgccgccgccatccgtcagggtctcaaagagaaccgagaccgagctttcacctggcagccacacttgaggggttgagatggcccgacaacgccctcaggaggggagtgacgcttgaacgccatcgttgctgatccggccaaggccgggctgggttttcgcccgccgtccaccgcctgccgatctaccactgatgcaccattgctccaccgccatctaaacttccgccagcgcatgggcatcactgcaccggtgccccccaccggccaatctccgcgcactgccaccggttgcacctccaccggcctctcctctcgctgcgccggccaccgtctccaagccagcaaagccttgtcatgtcgcactgccacctcggctgcgcctccacgcaccgcggccacctccgccgcgcctctgtgtgcgctgcctccaccgccgccggccaaccagctagccactactcctcccgctggctgcccgctgtcgccaccatcgccatgagtctctcggccacgcagccacctccgcgagcagcctctgtcgcccccctcccccgggccgtgtcgccggccggccggccagccagccggcactgctcctcccgccagctgcctgctgttgccgtcatcgccgtgagtctcctgggccacgccgccatatcgtgtcggccccagaagcgtcgccgtcgccgccgtcgcccacgaccccgccggcctctccctgccgtcgcgccagcctcctgccgcctgccaccgctcgacgaccgtgcgcctcctcttgccaccgtcaccacgaggtccgccgtcgttggggtcgcccagacccgatctgaccgcagggaggctagatttggcgccgggaaaggcggatccgcatccggtgtgggcggatccgctgcgccgaccgtccggccgccacctcctatgatccgccactgctgagaagcctccggtgtcccccgccgctgggcaacctcgtgaggggagcgtcgcgccgccgccgtccttgtggccgtccggctttgccgacgagccgctcaggcggcggcgagtcgaaggggaggaccagggaggggatcctgtgtgtgctcattcaacagaaaatgatttacggcattcgcaattttcctaaatgccaacaccgactgtacaactacgaaggtaatgagttcaggtcggctggcccttccattgattgctaaagaaacgcaacaagtaagttgaaaacaaagcatgctgcaaaaagatccgaagtttgcaatcatacattgtccaatgctccaaaggtacagtatacaggtagcaacatatatgcaacttacagaaatacagcacatagacattttttagataatgggttaaaccagcctctacatccggatatacacaaccaacagaacatagacatgaacttacagaaaaatggatgtacataggcaacacaacatatacatgaacttacagaaaaaaccacttactgcatatcaatcataaatcccaatgccagcagcaacaaaccgcaaatgacgacagagggaaaatgtgagatacttcaagacatcgagcaactagatctggttacgttgttgctaggaaaacacatcggaagatacttccttacatctgggggaaaaaaattccagatacatgcagttgaaaaccgaaaaaaaattcaagggaagagcacagcgagtgcttgttttagttccagataaaagtataaagaataaagatatcaattaagaggaggccgtgggtgccgcatctacacaaattcgaaaaatttatgatgttcctcctcctcctccatagtcagcaggtcacttttaaagggctgctctacttgctgaagcttcgtgcactgcgatatgtacacatacttcatggatgaaagagcgtgcaatccttcgatggatgatagctccgagcagccaaatagaaacaggtatttgagctgaagatttgtgccggtcggaatggactccatgttacagtactccaaatttagggcgatgagatgagtgaggttctgtagacaggctggaaatgacttatcaagaccaccgcacttgttaatatagagtcgccggagtgatgagggcaaaaccattgcctgttcgcacaccaagttatcgcaccatgagatcttcaggtcctgtaggtgataaagttccgtgaaactaccaacgggtattgattgtagacttctgcagagcctaatctctatggacttgatggatggcagatgttccggggacaagaactgatcaagatttcgcagcatatcacagttgtcaagacatatatactagtgaggcatgaaatggcgttgcttcttctgatactgctgcttgcctgctgcagcattctgccaccaccagtagaaccacaaaaaattgttagtacttcaacacctaatgatgttaaccttagctcttcgagggaaggtaacgaggggattgataggcttctcaagaagatacacttgcgaagctccatcatccttaaagtcggtaggctttctggattaaaccaactaggagaaaagctgtcacccgcaaagctatcgacattaaggcgctgaatccttgacggagggcacaaaccttcggccacaccattgtcatcgttcatcaccctgggtacaggctgatctcgccacagtagaactagtgcctgaaggtattgcttgtcaatgagtctagcctcaacagcctcttccttgctcttaacattatagatagaactgatagttagcgttccactgagctgattcatgcccttcagctcactaatcttccgcccattccctatcccaactgtaaaatgtatcaagttccgtagaagagacatatttccaagcccacttatctctgataatttcggagagcaacccattggcagtgctagacgacgcaagttgattagctttgtgacatccggactaataacttccagactagaactacttgcatcaagcacttgtaagcagtaaaggcaccataatttttctggcaattcttgtacatggctacgagatatatcaagataacggagactgtgcaactcaccaatgctttcaggtaacctgaccagcatgcaaccttttaagctcaaaaataggatattagagagctgattaaaccaggtaatctcaaacatgaggatggttccaaacttaagtgaatgcaatttattcaaatactgaatatctcttgtttggctcagggactcgctgtccacctcgactgacatatagcgaactgcatgcggcattctcctctggttctgatagctcaaatcctgcatcaagaagcacttgtccacggagatggactgcgccatatcatggatcaagtcatgcattacatatctactttgatcaaggcaattggtatcagtttgaagaagaaacctgcctcttaaatcatccaaatacctaatccctatgtcttcaagacgcatgctcccttctggtgcaacgaagccctgtgccacccacatgccaacaatctcatctcgttcgaagctataaccctttggaaacatggagcaaaatgcaaagcaactcttaagttcttgtgggagatgtaagtagctcagttgaagggctggtaatatatcattgtctcgatttggcagctcccatagttccttgttctgaacagtcttccaatgttgcacagtcagctccatattcaacaggcgtccaatagttttggcagccaaaggagacccgcataacctagaagcaatgcttcgaccaatatcatgcaattgaggatatgactcagggcactgtttaccaaatgcacacttcttgaagaactcccaaaatatatctctatccaatccctcgattcggaaaggattacagttgttgctagcgacaagattagcaacatctggagatcttgtagttactaagatcatgcttccttcaaacccatacctcaatggtgcaaaaaatgtttcccattcgtccttggcattaggccacatatcatcaagcactaaaaggaactttcgtctcctcagttgcttcctcaattccacctgaagagcgtctaaactgttcgatgatttgtactctttcctggtgatggactcaatgatctcttttgttatccttttcttgttgaagaggtccgaaatacagacccaaattctcttgccaaagtgagcttccacccttggatcattgtagatgaactgagccagggtagtcttccccaccccaccaatgctaacaatcggcaagacagaaacattgctgacgaatttggcctgagcaagtctaggcctggccctgatactctctctttttagttgcttcgctttggatgctgatgtggcaactgtgcccaccgctgctctctttcatttcgcccgtgcggcaccaccactcctggtgagtggcacgtgcagtgactcaatcatctgatcttgttcattgtcacatccaatcatggaacacacacccaacttctcaatcactaaatctcgctctttgtcacgaccaaacacttgaggcactccaatgactgaacttgtctctggcatgtgttgaactttctccatcttaagacccagaggcttaagcgctctctctaaatcatccacggccttgtcaagcttatcttgagcatcctttatccttgttttgctaccacagatcaagttttttgcacgatacagagaggaagaaaagaatttacctgctcggctacggtcagtgtcctccatcttctgccgcagcacctggtcatcgaacttgcgaagaagatcctcggtgtcatatgtggtgtccttgagctgcgtgagaagcaccgcgagatccttgttcttgaaccttccccactcgccacgattgatgactaagcgagcattgggcaaggatgcccggaggcaggatagatcatcttccagattggtcgctccgtggatgttgatcccagttgagatgatcttttctacggtctccatcaccgccatagtcgtccttggctcctccggatcttgtcttcgtcttctttgatgagtgcgagcctcaagagtgcaaggagattatggcgtgggaagtgaataatgcagcagcattgacctactaagtctaactacagaggcactcctttccacataatgatgcaagttgtgagttttgcatttaatgagttttgcatttaatgctgctgcatttaatgctgcccaagcagcattaactcctttccacataccgatgcaagttttgcatttaatttactaacaaattaaatgcaaaacttgtagatatgactcacttgacaatcattccacgtgatcctgttcaattatctaatcatctctctaagaccttaaccgcactacatattttgcatcttaagattccatatgtctgccagtaaaaacacaagtgcgcaacccacgagagaagaataccttcggatagtagactgtagcgtgtactttgtataaaccttgggtttctgtgaaacattttggcgaaaaatctagagttactagaaaaaattagatatgtttgaaccatgataaaatagaaagtggcatgaatgctatggtatgtttttgtcacctttttgtccgtgacactatcacaagaagtgaacgagcacatggattcccacttgatcgttaagaaagtgggaggaaatgcaattgtggatgcatttgaccaaaaaaggagtgatattaacaaaggagaatttagccaaaaggagatggaaaggaagcactaagtgctgcttttgcaattgtgaagaatcaattcaacatctctttttttattgtcactttgcacattttatgtggaatgctcttttcatgatacttggttttcaagtgccatcctgtattgctaattttctggtggttggtcatggtgcttagtacctaagtttagggaccaactctttgttggagttgtggcaatgtgttggccactttggcttgctatgaatggtatacactagtggagaaactatctttggtcggtctggcaaaatccacaatagttccagttccaaaaagaaccgggactaaagattgtttttagtcccggttataaaaattttgatgatcattaatcccggtttatcccctgtcagatgtttgtcagggggcgaggatctttagtcccggttggtgtcaataaccaggactaaagatcacttatcctctcctccacaattacaacttagacagatcgaatctctcccctctcctaagatctaacctctcttcctcatcctctctcctccacctcctccccttcctcctctcctccccatcctccccttcctcctccccctcctccccttcccatccggcgggccggcggggccacgcccggcggccgtggcgagcggcggcagcggcattgttttttcttttttatttttaaatttgcgattcactgatatgtacaaatttgtgattcattgtttggatctgtgatatatttgatttgtgtgtaattttttaggattttgtgatgtattaaatttgtgtgtataagtaactttatgatttgtgatgtgaatttgggatgttactttgatttggagatttggggatttgcctacttgattcgggtgaaaataaaaaggaaaaaaagaaaaagaaaaggggaccatttggtactgccgttattgtctctttagtcctggttggtaacagcaaccgtcaaccgggactaaagatggatccttactcccggttgaaaaaccgggactaaagtggggttcccaagcgggagtaaagatggtttttccaccaatggtagtctttaacgtcactatttttttgggcgggcaccgggtgggtggggggggcattaggctcaccagtggtctttgcttcttaaggaggaggaggatggtgaggcagtgaggaatggatacaaagaaactggaaacaatcactatggaactgttcttaaaatcggggtggaatgggagaggaagactacaaccttatttggctctggtgaagcgagtaatgtaacgtggattttggttaatttttgtcacctatggtggcatatgttctataattcttttttaagcccaagtgcctgacgttgtatgaccgtggttgtgtaaacccccgttgggtgtataggttgggtttttattaggcaaaatttactacagcacattgaaaaaaacgtgtaattagctcgtggacagcgcaagaatgagaatttgctatcgggcaccacaaaaaacgtgtaattagctcctggacactcagggccttattttaatattttctgtgaatttggagagagaaacactagtgagagtacgattttgccccttccctcacaagtcacaccggccagagcacagcgccgccaccacctccacccgcggtcgtgcgcccacgcaggccgccatcacacgcacatctgcgccgccgctgccgctgcagccagccaatgaacgggcatgccgctgccgccgccggcagctgacgcactcgtgcgccgctgccttctcccccatctgcgccgccgtgccggaagatgaggaagacgacagcgacaaggatgacaggaaggaggaggccgtggagctcggagatgctgcgcatcgactgcgcgtggaagtccgtgaagccaacgagcatccccgccgtgtgcgtccaccgcgagaagctctacgccaacacgcggtatgggatggtgtacgcgttcgccgagctgcgtacgtggagcgcagcttcctggtggagtccccaccaggctctccaccgagcaccggcgaccgccacgggctgatgcaggtggagctgctccggcccgtggccgcagctgaggaggaggggttcaaggtgcgcgtgctggacaagtgcggcgagacgtgggaggaggcggacgacatcggcgacgtggtggtggtcgtggacgcgtccggtgcgggggcggcatctacgcgggagtgccccaggttgaggctgagcaccatgtacttcgccgtcgaccccaccggcgagacgcgcgtgtgcacatacagcctcgccgcagcgggcagctacgtgtcgcccacctctcccgccgtcgtgagcggtcacgctggccgcctctcacaccctttcccaccgacatcgtcacgcccgctcctcgccgctcactgccacgcccgcgtcgccctgcctttcccgttgtcgcgacctagcgccgtcccgcgccgcgccgccagcgcacgcaagccaagccacccctatggtcccaatccaagggcacacttgtctttatttagtgtttctctctcgaaatccacaggaaataataaaataacaccccgagtttccaggagctaattacatgtttttttatgccaggcagcaaattctcgtttttgcggtgtccacgagctaattacacattttttcgatgccatgtagcaaattttgcctttttattaaacccattattataaaaactgggaaggtagtccgcgcatacgcatgggcatatggtttgaattttaattatgaaagttgatgcgtggatgatagttttgaaatatttattgacgctattttaaacatgtgttcgttaataactgttttgggcatattacttgaaaccgtatatcctcaaagttattagaaaaaaaatgtgtcacaataatggagttgcttcatatctatttgtattatgtgcgactctttttcaaaaaaaatttagagttagtctcatttggatgaccctaagttgattttagatatttgaatatagcttttttagttttctaagtcactaaggatgtaaaagcttaatcataaattattttttatcgctaataagctatttagcatataatcagctattggccaaccgatgggcctgctgaatgtttcacgttggagcctatatctatagttgacttgacctatgctgctgatcaatgttacacgatggagcccaccggcctaattgtctggcttattcgtgaaataagccaaatagaatatacataaacgaaaaataatatgtgaataaaacttttatatatatatttttagcaatttaaaagcaaagattgaaaaataaacttcgataaaaaaaacctaaaattaacttctaatttaagattgaaaatttaaatttttactggtaagcataaccataaacgaaaaaaaagatgtcgaagctccttcaagatttttgtgggaggtatcgttaattcgtgatcacatttgcgtcgaagctccttcaagatatctttgacccggcacctacaatcagtacagagcgttaacacggacggaagaagttgcaggatctttcctcagaagcatccttttgccaactaccctaggaattatatattgccaagaaaataactactgttctggtgctgaatgtttcattcaccttgaacttttgtcaactgccgtctccaaaggagagaaaaaataacataaacttttacgaactccagatgctaaaaacttaagatatttcatctcaccattatcttgtattatgtgattcagaaagtaaaaaaggaacagttatgcagtaactaggagtggaagtgcagaatggattccattagacagtgatgattgagagtaaattgaaaagaaacaacttgaagctctagtcctgtggagattatggtaacccatacccactcggccactatattttgattaattggatatagcgggtaatccatgtttatattatctattaggctagaacttaggtgttatgttgccttatatgatacagcacggcctatagtctcggctaaatactaccatgtaatagattaagaaactgatgcctattcggtttggttttcctctttataaccctgttctccaacctatataaggtgggtggaaagtcctccaagagcataaccacacaaataaccagagataaacacagttagatcgtcagatctatacacacccagcggttacaattctcgaaacaggagtagggtattgcttcttatcaatatggcatgaacctgtctaaacctttgtcccctctattcatccactttacaactcatgcgctacacccttttcttatgggttaatcgtatccatgccattgtaaaatatgtcgattcagagaaatgccctacaattcaccaattcttaaccgctccattgaaattttagaaaattaggaccacattttcaatccatctccatcttcttcctcatgtgcacgtgggacccacccatcagattcatcttcttcctctatcctcactttttttatgatctctctccaccgcagtcaggagggagggatggactggtgcggcatggcttggggcatgaactagatgcctatggcggcggtgacggcggacggtggcaggacgaacctaaggaggcgggcgtcaacttcagtgccgccgtggcgtagattgcgcggtggtgggtgaacgggaggagcgacggcgacagggtcgctacagggctccacggtggcagccagggcggggcggtgcacggcatgtgcgtgggtatcgatgcgacgcttgcggaatgccgggcatggagggggcggggtggcatgccctatagcaccagcacgtcgtggtggcgcgggggcagctagaaagaggtggaggttggagccggaggcgaacggggacgttgggccgctgccagggccgaggctgaggtggagccagtccctggcgccgttgtttcctcgacctccgttgctgctgctcctgtcactgctactaccactggtcccggcgacctcctactggtggtggtggtggtggtgggtgttggtggcggtggtcgtctccgttgcgctgcagctagaggtgctggttccgcgtcagcagcgatggggacccacccatcacctccctccctcccgcggtggtggagagagatgagaaaaaaagtgtggaggatggagaaagaagatgaatctgataggtgggtcccacgtgcagatgaggaagaagatggagatggatggaaaatgtgatgatagtggcacggtcctaattttgtaaaatttcaatggcacggttacgaatagacgaattgtagtggcatttctctgaatcagcatatttacaatggcatggatccaattaatccttttcttattgccgatctagaacatcgatagttgactgttgacggtcgttatagaccaatttcgaccgtcaatatatccagaaataagaagtagcaacgcttgcatgcatatttgtttaagtataatctatcagttaacgccaaaatttggtaagcccaaattcatcatcggcctagagtcagtatcggcttcagagtcttagaatcggccgatgggagtcgtcaaatcgccagcagttgtgttcttggtggagttggatcaattaaaggaagcttatctagaagagtccgagttcaaggaggatgtgacatggcagtttatctattaattaggcagtatttgtaagtttccttttatctttaggaatgtgtgtttagtgtccgataaggactttatgttttccttttatctctaggaaagtttctttcttgttctacaaggactagtatttacccatgggtataaatatgtacacccggggttattgtaaattatctcttgatcaataatactactttcggcgcatcgccaccctctttcccgaggtttttacatatcaaccggcagaatttggcacttgacgcggggctgcatcggttcagttcgatctccagcgaaggggtaagtcctacgttccaccagccctggtgaatctgccggctacgttggtgttgttcaaggctgcatcgcttcaatatcttagatcgctctggtttggttgatacatttgcctacctgatatctcaattctatctctagttgcattgtgtctagagatgcatcggtttagttgggactgtctcagttaggtccaatcttctgccttagccgatatatctttacaatcacaatgctgttataaatagattttttatatccatcacattagacaaatctatcggctcatcgagtattagattatcatatacaatctcgtgctgcatcggttaggttcgacctactagattgttgttgataatataagtcttgttaatccgataggttcatgctaatgttttatcagggtgctagctaataagttatctggacgttgcatcggcttacaaagattacatataagttggatttagccgattgcaataaaggtttcattgttgaatctaatcttgtggatttcatgacatcggacctccagccaatgtatatgctttaaccttcggatcagtgcttattctattatatcattgctagccgattggtttctactggattatattgtataattatattgattatcatcagccgattgtctttatatcattatctacattggacatatagccgatagctcagaaccctatcactatcggctggtatcggcatcggctggctatttgatatgttgtttacgtatcttgtcagttgcaggatcaaactgactggcacgcccgcacctcatcaacctttggacctgcactggagctaagcagatctcccaggcctgtgtgtgttttttgcatcaacactatctccacttgtacttcgaattttatttgaatacatagatctccacataaatggaggtgaatcgatggaaaataaccaaacaatcaatcgaagtccgagaagtggcagacttatggatggatgggcttacaaatccaatagaatacctgcaaatagggccaaccactgtgccactggacttaggatccatcgaccgatgcaccagagaagacacatgccaaatggttcagcccagggttcgaccgaacccccagctgcgccgttgatcctctccttccacgtggacgctcgtgatcactttgcaatgacagttgcgaggcattttccaacaattccaaccatcacaaccgtcaatggtaacctataaatggacttcacctcctccatttccaagagcactcttggtaattcttacgaccatagataaatccgcaagcgcacggaatatcgttgcagcacttcaccttcgggtgaccacaaaaggatatcgaactcagggaacgtgtgtaatctacctaaggctaagactatccagggacaacaactattggtaggctagctaggctagagaggactttatatgtgttttaattatctactctaagaaaagttaatttcctatctgttgctttgggcaccgacccctgctggtctgccaacgtagtttctgctatagctctatgatgtatcctaacgtggaggattagtaggactggataaagcgctgtcaccacctgccgtctacctctgacaaatccgtgggatacacaacaaacaaaaggtaatctctaacctatacaccacgcctaagttattaattactactctaatacttgtacatgaacttccttctttatccagagtcttagtactagagcacttagtacgaatactaaataatgaacctgcaaagatggaaatctatcttacttagactaaataattaagagaaaattcatgaaataccatcaataagcaccctaatcccagaaatgccatcgacaaaatcaacttcctaaaaatgccattgcacaagcctctttctcccaaaaatgccatcaccatcaactccacaccgttgcaaccattacttttttataatgaccattttgccctcagtgcaaaatatacccaattttcactgtcaaagaaaaagagagatgaaatgaaattcccggcggtgacaaggcggcgatccatggcggcagcgcagtggaccatagcggcggtggcgcacggcacctgccgcggagaggaggtcgcaggaggagctccggcaaggtcatgacaattgaaggacacggcggcggcggcgtaaacaacacgatgacaacgccggcttcactcagcctcccagctacaaaaaggaagtgcatgtgaagcttctgaggtcctagggatgacacctgcacggggaatcggatggtggctcaacggagaaggaggatttggcggtggtgctcagcggccggagttggggaagacggagtcgatctcccagcttgctccaccgatcttggtggttcttggggcgttttgcagagggggacgaggagaccttcacggcgtagtggcttggctcggggcggacaggttcagccgggcgacgatgacgctgaagcggcggcgaagaccggtgcgcgcctcctcctcgccggcgcctgcggaccccatgccgacgcctgcggcctcctccgcgttggcgcctgcaacctcctctccgcgccccgcgtcaccgccgacacctccttggaccaccgcgccgccaccgggcattgcggcgccaccgctgtggatcaccttctcgcagcagtcgccgaccaagagaggtgcgctgtcaccgggagagccgcctggatcgggtctagtgttagggattttcaccatttcatctcccttttcccttttaccgtgaaatactgggtatgtatatttgtgagtgagggaaatttggtctttgtaaaaaaacataacggttgtaatggtgtggaatcaacgggatgttgacggtgatggcatttttggaagaaatatgcttgtacaatggtatttttgggaagttgcacttgtcgatggcatttctaggataagggtgtttgttgatggcatttcatggattttctcattaattaaataacataagaaaggatcccgaatgcttacttaatagaagaagtttctccgaacccggagtagagtgtaccgacagctccggtactcctctagaattcctcctagaaagctacactcgtcgaggtagaagtcggagagagcaccaaacttccgggcactcatccagagcttcccctcactctacctattttctaatatacaaaagatacaatagagcctcttgatttagctcaaagttgtgtgttttgaagtgaagtgagcttctccttttatagtctccatatgacgttacaactatgggaattgtccaaaacaccctccaacgatcattgggaaaaaatcaggagtgtacacatggaggtgaacgggttcggccgaacccaaaaatccacctcccggtctctcttttggctaggaggttgcttaatgggcacccaacatcatgtactatgatttggcccaattctaagtggttttgattgacatgtgggtcctccaatccatgtaaatgtatcatgattgtccggaggtgtattttgttgcatgacagacgtgttttctccttaatatgcatgcatacttatatttcaccaacactagtggaaatgattagtaataatacctaccactaagttggataccatatattttatttcgttatatgcaagtattgatggtcagatattatgatttaaggaccgtcaacaagttagatggctttgcctctgcttttcaaaaccagctaagttttaacaaaatgctagaaactcaactagctcagatggctactcttgtccctgctaatgaatctaggaggattccagggcaacctgagccctctctagagaactttaatgataaccacaaggggaggaaaatccactcgcgaccagccacatcctaacactgcaggaacaagaaagaacaataaggaggcttcaccatctaacacaaatggagaagaagagacaattcagcgggagaaggctgcgccgcaggagtactgcgacaccaacctgctgccattcccccagcataaccggaagccatccatcgatgagcaattcgctcgctttattgaagcgatccaaaagatccacatcaacatacctattttggatgcgatgcaagtacccatgtacggttgctatctaaaggacattctcaacaacaagcgaccgatgccaaccgcggaagtggtgaaactaatggaggagtgtagcaatgctatactcctccaacttccggagaagaagaaagatctggggtgtcccacgaacaggccttgtgcgaccttgaagcaagcgtgagtgtcataaccaaggatgtcttcgacaaattgaactacacagtgttcgcaccaacactgatgcggctctagctagccgattcctcggtccgttacccagcaggtattgctgaggatgccctagtaaaaattcgggatttcttcatcctggtggactttgtggtcttagacataaactctgacaaggagacgccgctcatcttggggcgtccgttcttaagcatcgtggaagccaacattgatgtaggagctggagaaatccggctcgacctcaatggaaaggaggagaagttcgaattccgaccgagaatagaacaatgctctatggtgaagatcaagtacgggccaaatccacaaaatatccgagaggtcgaagttaaaccctcaaagacggatagcctcattgcattcatgaagaacttcctggagaaggaagcgatgggcaggcaccgtccagatccaaaggtggcatcaagaacgcaagctaaaaagcctgtgacaccagccgccaagaagccacaggatgcacccaagacgtaaaatgactagcaagtgaagaaatcgacacccactctctcacctccggagcagggtgccgcatcatcaagctaagcatgatggaggtatggtcttgctcgtcggactaaaaacgacgttgcccttgccaataggtaatttggtatgtatctcatatttgccttttgcatcaaaacatgtttattttttcaaaattttgcattaggaataaatttgagacaaatttataaaaatcaaattttgagcaaaaataaaataaaattttggccaaattgaacgtggctcccactcaacttatcgttgggagccaacggccaaaagtgggcccagttgggcctaccaggccttgttcggccaaaccggccaggcaacggtcagttgtggcactttcaggggcaacggctagtaggtcccacatgttagttctagccgttttggggcctctataaaaaggaattggctggtggaggagagttcaccccaaattcaacatagtttcactctctcacacactctctcgcgctctcaaattcatctcaaacctagaggagttggtctcaagtttatttcctgcattttgattacatttttagcatctacgagtggctttggtgcaaggctaactggcgggtagaattaatccttgttactagcttaacccccgctcgagtttgtcttgtgctcttgctcattttgtctgcaggcatgaagagacgaatcacgcacttgtttaataattggtcaagctgtcaatcaagccatcaccaagaagagtcgagtgcactttctttcatcgaggtctcgttggaggaagcagacgctttgccaagactgcttagcgactcagacctcaacctcaaaggtgagcgggaaatgcaagcctatcatatgctcaaggatcggccgtttgctcacacaagagcatacgacccagaacttctttagaaaataggtatagatgttgatttctacattgtttggaatgctttaggatgggagaaatttgctgtggtaattaagcaatggttctcgcttacttaccttgcaatttctaggtaccttgctagaagtagatgatggcattttgtcacgctcggaaaatagaacactatattccgtttgtgagtgcataaatccttgtcctatgaggcaaggtacacattacaaagttggtaaataacaaagtatataagcaaaagcataaatagagtactttattacattggcaaccaaagttccaacactaaaagataaacgataaaagccgaaagctatgttgggccaccacaggcgcttgatggcaggcacgagctagacatcaaagccatcatctccaaagtattcctctgctggaagggggaaaatggagcaaggctgagtacaccaccatactttgcaagccatgccgggaaaatgcaaatataatgcaagtgagtacaaagaattcatttataacgttattttgcagaaaactattatttcaaagcatgtaaatatttaactgtatttgaataaaacacgaacctatctctagtcaattattatcaagccgcgctccaacgcgatcttgcctttatgcaggccaaaaagtgataactccaattattcaaatttcaatagaattaaactctaactagggtacattgcttggtttgcccataaccgagggcgtggctattcaaatagattagaggtgtacatcgttacccaccaaacccgtcttcctcacatgttgccatgtgccacatgccaccgcggcatatgacataagctatgacataactcatcgtttggtaccgccctaaacaaagaggaccgacatagacttcccccaccaggtgccctaggtcaagcaaacagtctatgcccccgagcatacagccagagacgtcgaccccatcaagggcttcatccatccctatccgtgtcttccttgtttatgaccgtactagacgatgcattaagcctttcctattagacaggtggttgtacggaatatgctttgcaacagaggcccgaagactgttacttatgacggccgagatgcgactagcgaaaccaagcaccccaagcccagccgaaaacatgtttggggaattttgaaggggaaatatcatgtcaaggttaaacagccactaaaccatattaaccattatttaaaagttattcccaaagtctaattattggaaaacatctaattgtttctatttaagcgaggctaagcatatccctaaatttactagtaagcaccacatacataaagttcccactagttttattttcctagagttatcaaggatcgtaataatacaagtaataaagctaaaacaaggagaatcggtaaggctaaataaaacagtgataagcgcggaaatttaataaagtgaaatgcaataatttaaataaacataattttataaattaggacaacaatatgatcaaaatgacatgacttgccttgctcgctaccaaaatcttcaaaatcaacctcgaggtagagcatctctccggatctgcagcgtctacactgcatacgcaaagaaaaagggctaaaacataaattaaaaccatataagatgcagaaacaaagcactaaaatgggttctttactgattaagggaaaattagcaatttgaacgagtcaattccgagttcaaatagtcaatatatgaccatttgaattttagatgttgtctgaattgcattttgcgaatttgtggattgattttgtaaaggaaacctactgagtgtgcgtgctgaaacagcaaagagagaaaaacagagaagagggagagaggtggcagaggacatggcagtcggtctccaccggcggccatggcgcagcgacacgggagaggtgagggtggcggcgaggctcaccagagcagcggggacggcaatgaaacagtgatggtgacgagcttggttttttgttgatgttcgtcattgtctccgaggtcttgatgttctttttttgttgttagtttcttcttcctctttggtttcattacctggtatatctcaaacatgaggtgttagagccctgttcttcgaagaatcccaggcatctcccgctcatgacatttgcggtcatcgttgttgaaattcttggtgggaaggggtacaacctgagccgtagatagtgaagcattcatggaggatcccaaggatgcgaacactaccgaaggatagcgtgctgctcccactgagcaggagcaggacaagccactcggccatggtgaggttattgtgcactgtgaatgctcctagcaaagccaatcgtttgtgccttcggcttcttcaccatcgcctagcagtcacacgccatacggtttttctccagtctagcagctgtggacatggcgacaacagaattttggcacttagtttccctatcttcttgtctaccttttaggccatttttttagttttctaggagtggttggaataacatggtcatcaactccagcccaaagcacacttggtttgcaccggtaggtaatactagtacaaaaaaaatagaccagactgacggtccaaccggaaaaaaccagactcagagtaatcacggttcggttagataggaagaccggacatgcatttgaaccgctttagaccagatgaactgggaaaaccggcaccggtcaaaacattaggtccgatgttgggccattccaagactaacttaacgctgttgggccataaatgagagtgcccctttggtttttttttgtgcaaaaatagggaacaaaggtgctctagctaggattcaacctcaggtcactgagttggagggaaaagtcactagcctttcgactagcatggaaaatacacataatacatgtaagatacaaccacggttcaaccgtcgggtcaacggttggattggtggaccggtgaaccgagaggtcggccgggtcacccaccggtccggctttttacactatggtaggtatactcatgcttgctttatatagatatgcggaaacgacggagtggacactaccggttgacggtgtgctgctccagctgagtaggacaagccgcttagcagtgattgctcttcccatagccatcgtcgatgcattcagcttcttcgccattgcccagtagacatgaaccgtaggattttctgcaggaaagcaacggtggatgtgggtacggctcaattttggtatttatttttcccatcttcatgtcaaccttttaggcattttttattagttttctaggagcggtttgaaatgatatggtcatcaactccagcccaaagaacgcgtagtttgcagtgataggcatactcatacttgttttatatagagagatgcgaaaataatagagtggacactaccggtggatggtgtgctactcccactgagctggacaagccatgaggtcatgcaccgtgattgctcctgccatagccatcatcggtgccttcagcttcttcttcgccattgcccagcagacatgaatcgtaggattttctctaggcaagcaatggcggacgtggcaacaactaaattttggcatctaatttttgcatcttcctgtctaaaatgtatgcctttttagacaatcattcagttttataaagtgagttttaagcatactaagaaagagcaaagtggtttaaacacaaaataaaaatgtgtcttccagttttcggttgtttgtgtgacaatcataactaggcttttatttttgaaaatatttggtaatagctacaaaataaagaactgctcattcgttgatccttcacacagcaataggacaaagctaagagtacatcctttttagaagagagtggtcgctgatatccaaattccgtaatgaacttgatgaaatttcttgcacatgaatcaaacaatctatcactagtagattttacaaacaagcatgtgttgttcaataaatcaaataccatcacatctagagaaacaattgtaagcttcatatttttctactacatggctcgagatcacgagaaagaatactgcaagcacaagcacatggtcacaacctgcttgagctacgccgtacaaattattcaaagttatatggaggtccctctgttctctatgtctatgtctctgtctttgtcattgtccccgagttattgatgttcttttttgttgttagtttcttcttcctctttggtttcatcacgtggtagatctcaaacatgaggtgggagagccctgttcttcgatgaatcccgagcatctcccgctcatggctttcccgatcatcgttgctgaaattcttggtaggaaggggcacgacctgagccgtagatagtgaggcgttcatggaggagcccaaggatgcgaaaacgacggagtggacactatgggaggatggcgtgctgctcccactgagcaggaggaggacaagccacttggccgtggtgaggttattgtgcactacgaatgctcctagcacaaccaattgtttgtggcttcagcttcatcgccatcgcctagcaggcacgcgctgtatggttttctccaagctagcagctgtggacatgcgatgacggaatgctggcacttagttttcccatcttcttatctaccttttaggcccattattttttagctttctaggagtgcttagaaatggcatggtcatcagctccaacccaaaggacacttggtttgcaccggtagatatactcatacttgctttatatagagatgcggaaacgacggagtggacactaccggtcgatggcgtgctgctcccgctgagtaggacaagccactttgcagtggcaaggtcgtgcaccgtgattgatcctgcgatagccatcgtcggtgcattcatcttcttcttcgccattgcccagcagacatgaatcgtaggattttctccaggcaaacaacggtggatatggaaacaactaaattttggcatttatttttgccatgttcctatctaccatttaggccttatttttcgtatttctctagccgtgcttaccaacgacatggtgatccactccagaccaaagaaagtttggtttgcatagggtggtatactcatactttctttgtatagaggcgtcttggcaaagaaaaatgtgtatgaaaggttgctgttaatgactaaacaaatccattcagttttataaagtgaggtttaagcatactaggggagagcaaagtggtttcaacacaaaataaaaaatgtttcttccagttttcggttgcttgtgtgagaatcataactaggcttttatctttgaaaatatttggtaatagctacaaaataaagaactgctcattcattgatccttgacacagcaataggacaaagctaagagtacatccttttagaagagagtggtcgctgatatccaaattccataatgaacttgatgaaatttcttgcacatgaatcanacaatgtatcactactagatcctacaaacaagcatgtgttgttcaataaatcaaataccatcacatctagagaaacaattgtaagctccatatttttctactacatggctcgagatcacgagaaagaatactgcaagcacaagcacatggtcacaacctgcttgagctacgccgtacaaattattcaaagttacatggaggtccctctgttctctatgtctatgtctctgtctttgtcattgtccccgagttcttgatgttcttttttgttgttagtttcttcttcctctttggtttcatcacgtggtagatctcaaacatgaggtgtgagagccctgttcttcgatgaatcccgagcatctcccgctcatgactttcccaatcatcgttgctgaaattcttggtaggaaggggcacgacctgagccgtagatagtgaggtgttcatggaggagcccaaggatgcgaaaacgacggagtggacactatgggaggatggcgtgctgctcccactgagcaggaggaggacaagccacttggccgtcgtgaggttattgcacactacgaatgctcctagcacagccaatcatttgtgccttcggcttcgccgccagcgcctagcaggcatgaatcgtaggattttctccaggcaaacaatggtggctgtggcgatggctattttttggcatttatttttcccatcttcttgtctaccttttagggattttttattagttttctaggagctgttcgaaacggtatggtcatcaactccagcccaaagaacgcatggtttgcagcgataggcatactcatacttgttttatatagagatacgaaaataacaaagtggacactacaggtcgatggcgtgatactcccactgagctagacaagctgtgaggtcatgcaccgtgattgctcctgccaaagacatcgtcggtgccttcagcttcttcgccattgcccaacagacatgaactgtaggattttctccagacaagcaacggtggacatggaaacaactaaattttggcatttatttttgccatgttcctatctaccatttaggccttatttttcgtatttttctagcagtgcttaccaacgacatggtgatccactccagaccaaagaaagtttggtttgcacagggcggtatactcatactttctttgtatagaggcgtcttggcaaagaaaaatgtgtatgaaaggttgctcttaatgactaaacaaatccattcagttttataaagtgaggtttaagcatactagaggagagcaaagtggtttcaacacaaaataaaaatgtgtcttccagttttcggttgcttgtgtgagaatcataacagaagagaagtgtgctataaatttatagctaattgtagcacagattccaagacgctgtgtatacgagaggtgagactagatattaatggtgtaatatacatgaatttataggtaagaaggaaacatatcctatgcacacaaagcttcccgtgcacaccaactagcaaatatcacagaaaattctacaaaaaaattggacattccctcctaatagtattacacgttcgtgtgaaatcttattttcaaattcattatattttagctgtaacaaaaaaagataaaattctgacagatttttacccttaaaactgtcatatttttttacttttttgttacagctaaaatataatgaatttgaatacggtactttacagatatatgtaatactattaggagggaatgtccaactttttgtagaattttttatgacatttgttagttggtgtgcattgagtatgcacgagaggcttgtgtgcataggatatattcccaggcaagaataggccattagattagctatagatcacta

SEQ ID NO: 65992 - DNA, 3866 bp, Oryza sativa
tccaagacctagggccggtcctatgattttgagggccctatgcgaactcatcgcgatgggccctctaagctatgtataaaattctatgatatatatagacgctaattttacttgcaaaaacaaaaacaaatacatccatatatatatatatatatatatatatatatatatatatatatatatatatatatatatatatatatatatatatatatatatatatatatatatatatatatatatatatatattaaatttaacatatatggtaattatcaagaaataaagtcgaccaaaataataatatatttgtaacttggaactaatatcattattcattaacttaataaagaatagaaccccatcatatccattgcttctcatgaaaacgtacttcttcgggcatttcttgatgcaaaatcatcaagaacgatattaagaacaatagtgtccaagatatccttctcgattgagcacatagccaagtcatttaacctttcttgcaacatagttgatctcaaatagttcttcaaaacttcaattttgagaaacttcttttaggtgaagctaccgtcacaggtacagataagagtattcgataggcaaaacatttggatagaaatctgcatccataacaaactttagaatctcaggcacggacatcgaaaaatctggcaaactcacttgcaacacctttaactctgaataaaaatcgttgatctcaacatcgcatgaggtactagactactagtattaggtgttggccccccatcatcatgggcccccaccatcatgggcctcggcggtcgcctcggctacatagggccagggccggccctgccaagacctatgtaataagtggttatagttttaactcagttgaagcaaaggctgggtttataaccattattaaaaaagggaggtggtgaaatattatattatatcatttaggtatattaattaaactcaatgtaaagaagagagacaacttgtgaacttagggttggtttggtttgtggcctaaataggccttaccaaattttgtcaatgccaaattttgacatgattaatttcggtaagacaaagttgtgtttggattgaagccaaaatagtctaagttcactattaaaatgatctattttcttaggcatgtcaaaatctggcttaaaccaaatagacattaaacactattaaaattgtcaaatattggtaaatgtaatttatgcctcaaccaaacgagcgcttatttcctcgatggaattcgaattcggaagccgaaggcccagaagaccgcaacatgcggagcacgtcttggggtggccgggtggagcgggatggaagggccccactcgcagtgtcacaaggaggacgccgccatttcctcccccacaagaaaggccgaaagcgaaagcggatcacaagggggtagcccgtcaccatcagcgctcacgcctcgcgcacctgcgctctccctcccccttcccggcctaggtgtcggaagcgcggtggggaggaagcgaacgcgccgccgtccgggtctcctccgcctcctcctcccgagaatcgtaagctccgggcatcctactccccctcccgctcccagtccagtgtcgcgtcctagcggcgctttgctgtgttcgtttggtagcttcgattcgcacgacgtggttcgctgtactgcttcgagatgccgcgatcgctcgccctggagatttatcgcggctccggcgtattcgtctcgtgcgggtttttgtggcgcggtgctcttccgctggttcggttcggcgtcgcatcatttcaagggtttatgctagtgtagctttcgggaggtgggagtggtcgccgccggtatttcgatttctctcttcttatttgacgcccaaatgtgccctgttgcttaacctagttctgattgtgctgacgaattctaacccgtcgtgagtgtgattttggggttttgggtgctagttgtctcctaagatattataaggagatatctccgttgttttggtgttatggactgcggactacttgtttttaatgttcgatttctagaagttggaacccaattagtcgatggaattcacagaatctggtatcgtgattgagatgcaaaatcgtgtttatttcataaagcagatggatctgttcatggctgcactttactgttcgatgtctataatctgtgtagctagatttaccatttatcacacaagtttaatctagttggcagtacggatctgcagttttgattatagtggattcgaatttttgtgcactgtgagtttcattttggtatttgtacatctacaattaagagtttcatgtagtatgtcgtcatgttgatctactgttctgcatgttcaaagtttgaagctatctctaagacatactgtattatggttcgttatgcatttcaacaggcttttaacacttctattactgggatgaatttcatcttaactgagcaatgtatgaagcattgacgcatgtattaatgaaatttcacgtttttcaggacttctattttgcctctgcatccaggttatttagaactctgtattcaggactgcacaatgtctatgatagcagcaactcttcgtcgatcgtctagagtaactggtagtcagaatatcatggagatatgtcttggaccttgtgtatcttctggtgcttcttcaaggtggttcagcagctgtactaagcactcaaacacttccatacttaaccagatcaaggcagttgatcggtattctccagttaatggtatgtcaatgatcagtagggtgcctctttcagctcatatggacacaaactggttgtctacttcaaatcccagatttaatgcactgccaggattcttaggtgcttcaagcatctgccgagcatactcctcagacactgggattaaggcagaagttccacagaatactgtctcaaatgtaccttccacagaaaccgttgcgcttggaacatctgatggtggtagttcttggattgatatcttcgacaatgctcgcaagtgtactctagatgctaccactgatgcaggcaagaaagttaaggagctgactgatgcaattacacctcatgtacaacagttctttgatgcaaatccaaacctagaaaaggttgtggttccacttggcgggacaatctttggtacaatgatggcttggtttgtcatgcctatcgttttaaggaggattcacaagtattcgatacagagtcctatatcagcacttttggggagctcaacaaagaatgatgtctcgtatgaaactagcctctggagtgcattggaggatcctgcgaaataccttatcacatttatggcattttcagaaatgtaaggcttctttttactttttctggcagattttatcgttgttgtggatggggtgcaacacactctagattgatgatatttcttcaatatttgcaagagatatatccatcttcgtattgttgaaatgttcattgttctgatgttttctcttcctcagggctggattcaccgcaccaagcatatcagcttatcttccacaggcatggaggggtgcaattgttctctcttttgtctggttccttcataggtggaaaacaaacttcatcactaaagttgctgcctcaagtattgatcaaaccaggttgtcagcatttgataagatctcgtcattaggactgattgcacttggagtaatggctcttgcagaggcttgtggtgtagctgctcagtcaatactaactgttggtggtgtgggaggtaatgttatattcccttcagtcataaatatttgacgtttagatcaatattacattaatttaaaatttaataagtttatgatatcaggatagtactttcg

SEQ ID NO: 65993 - DNA, 7933 bp, Oryza sativa
agccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttgagtagttctgaaactagttgttgaaactagaagatgttgatgtgggcaacttatggaggttaagtcaagtggatcgatgaataagaaggtgatggtcgatctgaagtgcccagatgtcaagatggaatgaagttggcatcctaccttagaacctatgccgccaaagtgtctttgaagaatagttagtagggtagaacgtttgttgtttgctttgtgtgtaggtatggttgcattcccgtcattggagtggttcaatgatgagtgtgtaattatactaggttgcttgcttaatcaacttaaacaatataatggtctacacacatcagatcagtgttaacctggttaaggtcttgtctttagtgtaacccttatcctcctatcttctctaatctgcaatagatggtgaacactcgcgccagtggaagtggaaacaataacaatgaagataacccaactcttgctcaagttctggctcaacagactcagttaatgaacatgatgatacagcagatgcagaaccagcttaaccaagggaacaacaatgctccaccgccgcagaacaagttagctgattttcttcgtgtgaggccacctaccttttctagcactaccaacccagtggaagcaggtgattggttgcacgctattgggaagaagttggaactgctccagtgcacggatcaggagaaagttgttttcgcttcacatcagttgcaaggacctgcatcagaatggtgggatcatttccgaatgaacagagcagaaggacaaccaatcacttgggcggacttcacggaagcattcaagaagacacacatacctacaggagttgtctctttgaagaagcgtgagttcagggcattgaagcaaaaggatcaaaccgtggcagagtatcttcatgagttcaatcgtctggcacgttatgctccagaagatgtgcgtactgacgaggaaaggcaggagaagttcttggaaggcttaaaggatgaactgtcagttacgttgatctctcatgactatgctgattttcagcagttggttgacaaagcaattcgacttgaagacaagaagaacaggatggataaccgtaaaaggaaaatgactgttttccaggaggcacaaggtagtagtcagagacagcgtatcaagccactccaaattggtgaacctttttctgctggtcaaggacagtcgcaacagttgaatatcggtggtgagatcaaaacagagactaatgaaagcaatgaagttaatatcgagcaagctaatcagccggtgccaattcagcaggatcagtctcaagagaataacagtagtggaagggagcagcaggtatgtttcaactgttacaagccaggccactttgcaagagagtgtccgaagccgaagcatcagcagccgcaaggtcaggtcaacaatattgtcgtcacaggagccaatgcagtgccagttgcgtcttcaagagttgcgtcttcaagtgttacaactcagccaccagtttcaaagaagcagtagttttctttaaagccttagaataattatcggagttatggaataagatagactgcagtttacctattccctttttctttctagccgttccgattctcgggacgagattctttgtaaggggggtagtttgtcacatcctgatttttgtttcaggatttataaattatttaataaattaataatataatttatattaagtgttctttaatttacaagtgaagttaaatgtgggaaataaaatttcctaaatataaagcatggatggatttaatttttattaaattctccatggttaattcaactctctgaaattttctcggatttttcagagctcaattcctaaatgatacaaagaacagttcagtaattatttgatcattaatgatctaattataattgttaagagcttttcttgtttaaaaatccttaaattataaattgttgtttaaaaggaattattagaaatgattttaaaagcctagaagagaagatctaattttaatttgctaaatctcaacataaaattgggctagataaaattttgttaaatactttgcttaattctataattcctagatttttctgggatttatttgagctaaggaagtatttttaataaatggaattgcatttcatgaataatttaaattgaaaaaggtttttaaaagtcttcttttggctttgggccgaaagccggcccaaaacctctctctttccttttcttcctccccggccagtcggcccaagtcggcccagtccgccgagccgccgctctcctctctctctcagccgctgacaggtgggtcccacttgtctgggtcgtcgtcctcctcgcgccgccgccgccgcccgaaaccctagcgcaagccgccgccgtctccttccaaattcggccgatcctttccttctccggtgaaatcttttgaggggaaataatcttctcgatctcctcttccttttctcttatagaaactccggtcaattttctttggaaaccggtggattcgagtttgattcggattcgtttttccccaacctttccttctcgtcgccggcagccgtgggccttcgccgccgcctcctagcccctttaaaaggacccccgagctctcctctacccgccgccaccctcgccttcgcctctcgtcgccggaagagccctagcgtcgtgcacccttgcgccgccgtcgctccagccgtgagccgccgtcgctctagccgtcgccgtcgctcgggaagaccgccgttgtgctcgccaagtcgtcgccgtcctcgtccgccgcttcgccaccgccgaagaccgccggagcatcgccgtcgccgtcgacccgaaggttgccgccgcttcctcctcgtcgccgtcgtcgtccgttgttcttccgccgccgttttggtcaccgatgagttcgccttgtcgtccgcttcatcccggtgctttccgtttgtgccgtagagccgccgttcgccagcgagcgtgcgccgtccgagccgtccgagccgccgagccgccgctgccggaggtgacgtcatcgctgacgtcatcggagtcgtccgccgtgagccggtcgtggaccgtttgatctcagccgtccgttttggatagggttgatctcggccgtttgttcccgtgaaccgttgccgtgcacccggtccaccgcaaaccctagccgctgacgcaataatccttcttttccttttcaaaaataattcattattgcgtcataattcaattaaaatccatataagtgttttaatccgatttaatctttaaaaattcataactaattcatttgaactcagtttaatgtggttcaagttgcaaaagttgtgtaaaataaagatctacatattaaaattgtccataaattgaattaaatttatttaattctttttaaatgggctttaaatagatttaatcttgtaaaattcatttgaagtcagaatgaggccgttcaagactcataattcatctaaaattatgatctacatgtttgtttactttttatgtattgtttatttggtttttattagtctttttcttcgttttgtgtgttagcttgtcgtttccgtcgttgcgaaggttcgcgagtgcgccggaagtattcaagaagattaattgaataccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgatcttgattactttattccttgataccttgggttattataatttgactagttgagctttatatattggttcagctagatattagatgtgattgcttagccatgcttagaaacattagcacactattgggataacttatgattcattattatttaatgatggtttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttatgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcataataattatagatgttatacctggtaataattagcttagctcctggtttggagattagatctgttcagccgggtatggttgttcagaatggttgggcctgggcagcacgggtgtgctgttcagtgttgattaaaatttctgattaattactccaatgttttacttctcttaaatgttttgctaaatgctgcttttacaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacagacatgatcgaagatatcatggatgacttctcagtttatggaaagaatttcggtcattgtctgcagaatctaaacaaagtcttacaatgatgccaagaaaaggacctggtgcttaactgggaaaagtgccatttcatggtccgtgaagggatagttcttgggcatcgagtgtccaaacgaggaatcgaagttgatcgtgctaaaatcgatgtgatagatcaacttcctcctcccgtgaacatcaaaggaatccgtagcttcttgggacatgccggcttttatagaaggttcattaagaacttttctgcaattgccagacctctgaccaattgttagccaaggatgcgccctttgagtttgatgatgcgtgcctaaaatcttttgaaattctcaaaaaggcactcgtctctgctccaatcattcaacttcctgattggactctgcccttcgagatcatgtgtgatgcaagtgactttgctgttggtgcggtcttaggccaaaccaaagataaaaagcatcatgcaagctgttatgctagcaaaactctaaccggagcccagttgaattacgcaactactgaaaaagggctgctcgtggttgtttttgctatcgacaagtttaggaggagccaaggtgataatttatgctgatcatgctactttgaagtacctgctcactaagaaagatgctaaacctcgtctcttaagatggattttgctgctccaagaatttgacttagaaattaaagatgaaaagggagtagaaaattccgtagcagatcatttgtccaagctgcaaatcactaacatgtaggaacagccgatcaatgatttcttaagagatgacatgctgatgacggttcgcgattccaacctgtggtatgccaacatagtaaactacatggtatccaagtacgtaccaccaggggaaatcaatgaaaactgaagtatgaaagccgccgtcacatatgggatgagccatacctgtatcgggtctgctccgatggcttactacgaagatgtgtgccaactgaagaaggacttaagatcatagaacgatgccatgcctcaccctatggtggccattacggtgcattccgcacccaggccaagatttggcaaagtggcttcttctggaccaacgatgtacaaagacttaaaagaattcgtcagaagatgcacaagctgccaaaggcaaggaggaatcactgctcgccatgcaatgcccctcacatacaatttgtaagtcgagatattcgatgtttagggtatagacttcatgggacctttccctaagtctcgcaactgcgagtacattctggtggcagtcgactatgtctccaagtgggtagaggctatgtcgtgcagcgctgcggatgcaaggcatgccaagaagatgttcacagaaatcatcttcccaagatttggtacccccagaatggtcataagtgacggaggttctcatttcattgataaaaccttccgagacctcctacgagaaatgggagccaaacacaatgtggctactccttaccatccacagaccagtggacaagaagaaacatcaaacaaataaatcaagaatattctgcaaaagacggtcaataaaatgggaacaggatggaaggatagattgccggacgcactgagggcataccgtacagcatacaagacacccattggaatgtccccatatcagatagtctacgggaagccatgtcgactacccgtagaacttgagcacagagcatactaggacgtcaggaattggaacatggattttgaggaagcatgagaatggagaaaaatgcagattgctgaacttgaggagtggagagaaaaggcttaccacaacgcaaagatatataaagaaaggacgaagcgctggcatgacaaaagaataaagatcaagaaattcaaaccaggagacaaattacagttgttcaactccagagttaagcccttcggccacggaaaactgcgcagcaaatgggaaggaccgttcgacgtcatcgacacctcttcgcacggggcaacctgtcacaccccgaagttctttcccaagcctaaattggagttttaaatggtctcaagaaaatacctgtgtcaagcaagagtaaaccttaataaattaatgcaaataataatcggaattggcatgtggaatttttcttgagttttacatgccgaaatacgctaacaagatttttagtggaattttcagagctctcgatataattttaaccaattaaaattgagcacatgcaattttaatcccaggaaaaatcctttttccttctttttcctttttctttcttttcttttctttttttcctttgaatg

SEQ ID NO: 65994 - DNA, 4870 bp, Oryza sativa
  unsure (1)..(4870): unsure at all n locations
atatcagcatgaagcccacttaccaagaccaaaatctccaattttgatatcattgcgaacatcaaaaaatatgttgttaggtggcaagtcccggtgtatgataccctggctgtgaacatgcgctagtccctccactatttgtcgaaataggcgccatgcatcatcaactctaaaagatgaagtatatgtctcaaaatactgtcgcaaggttctgggcaacatccaataagatcaaccatcatcaatattgcaatcaatattatgcttaaaaatgataaaaaaaatccagacagaatgaagatatccaaagttcaacagtcaaaattctcatgactagcttagatgaattgttcaaaagctgtacaattatatatttcccttttatagaaaaatatataatataaaactactgtaatggcagctggtctgctcagcaaacaggtgaaactggttcaagtagtcaagcctgtgaaaaaaagccaacctgggctgctcatgagctagttcagcattgtatattctgtaacagaactgctgaaaagaaacacactcatatccctttaaaaaaaacaaacattgattagcacatgcataatcacagaatctgctgtgacagcaactcaaggtatcaaatggagttcttaatagtattacgggaaaaaagtaagacgttgattagggtacaggagtagtcatcctaaatcatttataacaaaaagaagtgcagtgatcagatttattaacaaataaaatacaaaatccataagggcaaggcaatcttagcactgtttacttcatagcatagtgataacacgtaagtacctaggacagtattccatttggatgtacaagtacgtggattcctgcttatttccaccacctgcatctgataagctgatgttgtcgtaactgtacatagagctctcagcagtacatgacccagcagcattcaaaacatgatgttgaccatactcagtttcaacccatgcctggcatatcaatgacaggtgagatgtaattatctgatttcattaacgtgatcatctaacaactttctaaaaggaaaacatatatgcagaaatattcacctggtagtaacgaacaacatgctgatgttgcagtcgtgaaagcgtggctacctctctgaggaccttgtcaaattattaatgagacacataaaaaaagcataacagaatgctggagtaaaataccaaaaagaagaggaaaatacaggtatatcttcctccagtgaaaaaagaagccatattttgacttttcaaaagtcaagcactttgaccactaactttaatacagtatattcgtagaagatacaaagcgtaaaatttgaaaagtatttttcatacaagctcgtccataccattttcatatatccaagctacatattctagaaaacacttttggttaaactttataaggcttaattgcatgcattctagggcgacatgttttttcttgacaagaggccagatggagtaataaacctaagactgattatagaggctcacataaactagaggaagtcacagttcaggctttagttttaaatgtcaaacatactaactacttagttattggcatatgatagtgataactaaagcaacatgagtaacattctttctttttttttgcgggaagtaccatgagtaacattgcatctacagctacatgaacaatattgatggtctggacattggcctcacattgcagaagacttttttttcaatcattgacaacgtattggagaatttattggttcaaggcaacaatatttagaaatataatcagatgctgagccaattagcaaacaaatagtgtttggcttttaaaaattgaaagtctatctacccttcttctttacacttaaagtgtttaatacaacaaatgaacaaaggtgatcgtcaaaaatatacacaaaaaagaaaaataaacatgaactgcacagtgccacagcactcagcacatttcaattaagagaacaagatcagaagtatacaacccttagaatcttttcattcacttgaggacttctatctttcagacgtatcttttttacagcatattgacgtccatctaacttgttcttgcacagtgcaacacgaccaaaaccaccctggcctgtcacagataatgtcttagaagcccttttgtcatgaggatttttgaggcctcatgttacttcatgaaaaatatatgaagatagccaaattgcatccagattcaatgttaaagttgaagacctttgatatacaataatccactctatagcaagcagcagcagaattccacatactcataatggatactaaaagatgtttgagatgctggtagtgataatatccattgcaactcacatgtattaagctagttatagtaactacggaaaaagaaagtccattaattagaggctgtataataaatgcagatttacttgtgtcaccttttatgattgctaagacaaattatacatatagttattcttaaaaatcaaaatttacaattcaaaagcagctttggattatagtaatcaaaagtagggacaatgctacatttcctaaagaaatatgcactatgtaaatggttaatgccacacaaaaaaaaaaaggtccacaataaaccaccacccaatagcttctttaggctgctcgaaagccgataaatattcangtcagtatcttgatatagtcttgcctaggtccacaaaacactatcagatgggagttatattctcaccaagtggacgaagctcctcaaaatcattcaaataacgagaatttggcctggatgatgaattgtcagctcttcaaaatagagagcactctgaagaggtctaatcaatggcctaagaaaaccaagtaaaattagagatgaacaacccacctgtttcggcagaaggaaatcatgagttagcaaacaatagttaggcatggcttaccatttgtggcccaaaaaagtgtccaaaagtttccccaaagacagcaggagatttcgaaattaaatctttagcccattcagaaaggatcttggtaacaggagaaatgaagataattcaattacgaacgatgataaagaaaattacaaaagacatgtcaataacaatacatggacaattgaacacacccctatgttgcataactccgatgatattgctggcaaagaagctgaaagagagtccttagatgcacaagctagacgaagcaagtgtacctagtacagaaagcaaataagatataatagtgaaggataaatctttttaagttaaacattgtaaggtgaagagagtaccagaattaaatcttttttcttattccgtgaagcatcatcaaacatgtcaaaagatggggtatttgaaaatccagagcctgaaccagaatcttcatcattccaatcttcgtctgaaagatcagagtcctacccatattcacaaatatgcagccagataaggcatgctatgagttatctatctattttacttaagtcttatgtagatgcaactactcaaactcaaaggtaagcaggagaacagtttgaaaacaaaagcaggaacaaactacagaagtaccaaacaatgatcacatgacccacttcaaaagaaaagtaggaacaaatgaacatcaggattttaaccaaaagttcacgttggaaaaaaaaacatcatataagccacctaacaaaactagcgaacatagtataatatcaaacaagccctcagaagttgataaaggctcagataataaacacttgctataagactatcagatgagttcataatactagagattttcagtttacataacacaatccctccattacactagtgatgactagcccgtgaacaaccttaggttaacgcgatattatacattttgactttacataacagtatcccttgaattacactatccattggacaacattagattaacacattttgtatatttaggcaatgccatgctgcatcaaaaattagtataacactgagaaaatatacaagtgtgttcattacctcaagttgatgcacactgctaaaactcctctctggagtacctgatgtattttctctgttgctcgtagaaacagttttgctgtcattttcagtttcctctgcaacgacatgcaaactgggaactgtctcccgaataacatcatgcttcattatatttttctgaccagcattatccggtaataaaccctttgcaacattaacctcatcagaagaaacacgggatttttcaataattgtcttcctcttgcttttaagattagatttgacttgagaaccaacaattttcccagcactatcagttgctggatctggaccttgcatgctccaactacctccatcatataattgactatacaggtcaaatgagttatgcatgtaagcaactccatggtaagaaccattgtcaagcttaactttcacgtctacatcagttgtttgttgtactttgcctgaacccacccagggagcctacaagatatgataccaaataacatcagctatattcagcagtactatatatagcttgggagaaatacaacataaaatttgtggactgccaaaagaaaaggataaatgatctgactgacaaaagaaaaggataaatgatctgatgcatactcgacatctcatgaaatgctacatctgtacatagtatgcgattgcacacattaagaagtgtgttcttctgaacgtgaatattaagaatcacaactgggaagaaaggacacaaaatccaaggcccagccattgaaagtagaaatggtgctgagatgacatattagaagctacatatcacatctgtagcaaccgagttccttaatttatacagctaagcaaatgcaggag

SEQ ID NO: 65995 - DNA, 684 bp, Oryza sativa
gtcttcagcataacttttggtctgtacttaccaacatcacagcgtcatgtttggtccatccaaattggtagtcgtctgttgctgttctagagatagggctgcaataaaattgaggttacctaaatgtgataattccatcggaatcaacacctttagcataccataaattgatggtgttcttattcttacaggatttacgtccattgtgtaatgttgagtccgttcaacttatgagaacttgtttactaagtaggagagcagccaaaattacctatcgctgactctctatgattcgtcataattctttgtgtattacagacaaaggatgagtggctgtctacaacacaaggcattcttctggaggctgctaagattatcaagttacatggcgttgaactgggaagcaccacgcagtgctgctgattacggtgcttttggaagttctaagtaggtaagtgcaattaatttagctgttgggccatgcagataatactttccaaaacacagttccggctgttataagttcacatcgaaactgctactatgttaaaaacacgtagttgttcccactgtagttgttccacttctgttcccacattacgttcttccattccatttgtcatttagcatccggcagtttcaaaacgagtttttacatttgagtgcatatttgttcccaagttt

SEQ ID NO: 65996 - DNA, 10464 bp, Oryza sativa
  unsure (1)..(10464): unsure at all n locations
ccctctttgtttaggcttataagacagtttatgagccaaaaagtctaagcctgaacaaataagtagctttttcgtctggcctttttaaaagccataagccactcttacactgttaagccaaagccaaaagctaggttggagtagcttttttggcttatgtgaagtggaggtataactccaccaataaacctaagggtttaaagccaccggcttataaaacatataagccaaaacgctggcttaaaagtccaagcttaaacaaagagggcctgagtaaccatgaaaagactgacttaccatgcttgttgaatcattagctggagcaatttctgacaagaactcttgggcagcctctaccaaattgaatatcataacacgcccttctcgggaataaatgtttgcctagtaacaaacaccaaaaagtctgttaaagttatttaacccattcacaccaaaacatgcttgggaaagttatttattcacagtagaatgtaaaaaacaaaacaatttatagagattctctagacaaaacatgattgaaaaccctgtttttccctgaaagttaacccatttccttatttttcccttgcttctgcagggtccacatgtcattgagacatcatgcgcaaataagggatcgggtgaatttgacagggatagataaagaatcatctaaaacaaattaggataaagtaatgaggaattttaatgaatatggagtgtggtgatcggaaaactttcatttatctacaacaaagaggttatactattctatcatttataatgcttgcccataaggggtaaaattttctttgcagttcaaaaccgagcactggaaagaaaaaggatgcaagactaatagtctaacacggttcgatgaaaatgatgtctacaggcatgccaaatacaatatgaccacaagagcaaaggcttcaattaaacattctcttcaacaaattcaatcagaagcaataggtaataacaccaaggcctggtgttagggaggataacctccccactcactcaggttcaagttttagggctaaacgacttcttcagtgaaggaaaatatcagaagaaggaaaatatacctgatcaacaagaagggaaagcaaccgattagcatcttctctagataaggtcttttcaggtagaacccgcaactttgggcacttgtgggggtaaccagcaaaacacctatttgtaaatgcaagctagatgtcaactagcgaaacaacaaagatatatgttgtatgcataacaggataagtcatagctccttaaaattaaagccatacgttacatcaagagtcgctgaaacattcgaatctccaaagcccatgccatcagaataaggcctgtttacatactcataagttttaaaaactttatttgccatgatgcaggtgatacacttaagagtatgttcaagaaacacgagaaagtacctgatacatatagtaaaacgggtctgaggtgattctgatgtcactttgaagtcctcaaggaaaattgaacccctaattgatatgcaaaaggatgtcggttaaaccatgcaatcactaacagaagaaaaggggcatcactaaacaaaattgtagtgcttttatttttcattttgcaaagcgaaacaatcagtacttgactactaaattgttaatgaataagttattcagaacagtgaaactccaattcaaaactcaaaacaaaggaagtaatgcttgctactgcatactgctaaaaataagcaaaggcgaactgcactagctagtggtatcaggttaggtacccacatgctacgctgctcagaaattggacaggaaaaatatccaaacggcacaaccaacctacaatcagcaaaatgatatgaaagcaaactgcaatcctcaaaatgaagaatgctaaaatcatgtgagcaagcatcagagtaatgaatgagtcagggcatcatactgtactaaggtatgtgaactaatggactattccgtacctcccaaggcagggggaaaaaactcgagaacttcggtacagtctatgcaacaccacctcgaaattcaaaatgcggcattcagtataagttggggaaatccaggcgaacgatatgatgaaccacacccccacctgaatctcgtaccagcataggagacatcacacacatgccacctcgcaattcgaaattccaggccgactaactaaaccggcaatgccgcgaatcaactcgaagcacgcgcatcgcacactaccaggcagcaaaccagcaagcaccaaccatcactccatcagcgatgaaccgattcacaaacatgcagaagctcaaactcgaaaccaaccacgcgccatcaaccgattaccacgcgaggaggataagcgtactacgaccaaaaatggggtgggggggaggaggggacacgcttacagtgccgtgagctcgtcggcaggcggctgtcgcctcagctgcccccgggtccttgggncgcttncgcccgcccccgcccttcttcttcttcttcttcctcgcgctgtgccccatcgccaatcgcaatcgtcgtcgtcggcggcggcggcgaactagccggaaaggggaggcggtctcgatcggatagggattgggaggcgatctgcgttggcgccgcggcgagggggaggaggagggaggttttggcgtgggagggggaacgaggggagagcgcgtgcgcgtcaactcgaagcccagattagattgtgctcgagtcgagtcagtacagaggcggcggcgagcgagatctttgcgggagcctcgcgtcggatgagcacacgtcagaaagggaacccgggcacccgcggatgttatttttggcttttccgtgcgtcatcttccttctccttttttgcgaggataataattagttgtcgtcatcttggcagtagaagcggattggcccgaagatttctggagtttaaaattttgcttttgaaaagtttttgcacagccagtgcaattttcctttgaaatcctatgaagatagatagctcaaatttatgtgtcacgctttaaagatagctctgctcaaaccaggactggtagaaaatgagactgcaagattcgccattgagtctgcagtgtagataactaacgaatgattcatggaatatgtccaagcaagtagtaacagttcgtaaatatttctggtatcgtgctctgactaatgccatcaccgtataatttcggtatgcagaaggttcattacaatttgatttctttacttagcaacaccacataggagatctacaaaagggtggaatttccaacacatcagcaagcacaacaactgaggcacacatatcataatcctatattaccaaagaattaatggaactacgctttgcggtatgtacagcgctgcagagtagacatcaaaaaattgtgtcacaaggccagggccccatttcatcttcccagctccttggtttgctagtttacttgaagaagaacttccaaatttcccggtcagctaactcggttaaaaagtggccaccaaggacaccctcctcctccatcaaagctctgagttgccttgcgccgccattggaaccaaccaagttcttctttgaaaccacatacagtactccgtatgggggtcgcaggcactgcaagaatagcagaaacgacgccgtattagcacttgtggatctttatagttgagtgcatcaattaaaaattactctagcaatattgtcctactcaaagaaagaggtttagaagcttcaactcatttattccatcacaaatcacagcttgatctagatgcatgatacatgaaaagccaaaacagcgataacaagtgaggaactgacctttgtgataagggcatagagcttcttcaaagagttcaccgcataggggacctcagaaatcaaaattacatcatagcctccatcagcttggtctgtctcactggccctctcccatgcacggctaccagaaagtttccttgatcgcctggggcaattgtcgacaccaattatgctgctcccatcatggctactgcagccatccataaagtcgtcctctgagaagctaaggtttgttggtgctgcaggtgggtgtacacctgagagaatagtaggagctcctccagtcccagcaaaaatgacatcggggctaacagttgtcgtgatggtgtaacagggctctctgatggtctgttctgcctgtcccgagcctgctcaaggtttgcaagcacattgggtattgctctgcatcttattgtttctgcatttgtgtcctgaaaatgaactgtggatgcaccctgaggaagcatcgaagcattcagtcaatcagtattctgggtaaagataactgaaagcaaagatatagtaaattgataatcatcagaagcaatggaaagatgaaaataccttcaaacaggcaaaaatcccagccagaccagatccacaaccaagctgcatcaattttcaaaaggaagtgagttatgcatgagtccaaattatcaagttgattctgattcgatgaaagcaaatgcaagcacaaagcatctactaaataactaaatgaagaatctgtaacagctagccaacgatgccagttttctcatgggaagttacctctagaacccgcttgcccctgaagctcaactgcccatcacggatctcatttttaataatgttgacgagagtaatggaactctcccaatatttcagagatcctgagaagaagtgatgaataagactccatggtatggaggaaagaaaatataagatgtgcttattcgttatgcccttaccatcatatttggatgcgactacttcagaaggggagaaggctatcatatccgctacactgaccttcccctgaagcataaggagaacacattaaaacattagtgtttgatgtttatatttgataacttgatggtagcaagggaaagaaactagccaacttgaaaattaacaaaataaggaatatgcatgtgctgcttaccttgaaaatgtcaagaccttgaacatcaaccttctcgccagcatatttgtaaggatgagcactctgagataaaaaggatcaagacatacttattaaattgtttacccacgaaaacaatcccaaaaagaacaccaatcgacagtacaacagacagctgcaaaacatttgaagtatttcttttggagttttatatacaaatgacagccaaatcagaaaaaataaatgtacctttgatgggattatctcgacagctggtgatggtagctgtagatccctttctgatacaattggcacacaactcgtagccttgctgggaagcaagccagggaaacactgaacaagcagtgatggcgtcttcatcgtgccacctgttaacttcagttattaacaacagttgaaattaattttgtattgaaggaagaaaaaattagatgattggactgtaccaaacatgagaatcacaaattttcaatatgaacaccatcttaaactaatatacaaaagagaaaaatggagtcactacaacagactcaattttcctcttttgtaattttcatattttgtattttaaaataaagtacaaggttctgggtgggaactggcattccctaacccttgtgtacatggctgatttctgaagaaaacttatatcatttgaacataagtctaataacctacatacatactgatgagtaaaaaacccaacatcacaagctgtgactaagaaccagaagattgctaagcacaattcgctattgtaaaatcaataatgttaactatatgcctgaatgtggacaggatatggagactctgctacttccaaatccataaaggtgcctttaaaaagtacacaattaagaaagccactcctattgtttttcgaacttagtagaatctaaaccccacacatccatagaacacccgaaaaatactcctagcctgtgcaaatctgtcgccttctatcacctcccagtaggaaatatggcagaaataagatgaaaaagattgcctaaacacatggatttgcaggtgtgaaatcaagaacgcacggagcaaagctacctccttttcaccagcccccatccacacgctgcagttatacaacatctgaactaaatccaccagaaattcaggctaccgacacagctaaatcacaactttgatccctaaacccccatgaaagagctggattctccacgctgcctctccccatgccacatgaagcagtggatgcaacatgaagaaagccaaaaagctgttctacaatttcttttccggctagaagacacacatgacacatcacatgccatgagaacttactcatgaggcagtagccgcctgaatccacaacctatccagacgatttccttcagatcaacccgtaaaactaaacaaggcgacgactgacgacagctaatcaaaccaaagcacccgacgaaaatctcaagaaaaacttcctccttttattttcccccaccctgtccctctgcaaaaaatctccccccgtgaaaccgaatctaccacgaaccgaagcagagaaagccgagattacctcctcgacgggagccccaagagggatcagaaccccaacggcaagacgcctcctctcctcccctccttccctcgcccgcaacgcaacaacacccccttcttattctccagcaagctggaccgaccgacccacagaccaatggagctctccgaatcctcctccaacggaattcttcttggacaaatctccctcccaaagtcagaaagtcaaacccgccacacgcctaggaggagtaaaggtcggcaaggcgcgggcttgggggtggggatatataggcggagacccgtggaagcttcgccgcttctgccatggcagccagagagagtccccccgtccgtgtgcagcagcagcagcggtgggagtgcgagtaaagaatcggtctcccgcgggatggcgtaattaccggattgcccccgtgggcgtgggtgagcgtggaatataccccgtgcggcgccgcgccgtgcgggagatgtggactgtgagaggggtgtgaaatgtgaatcccgaggccgccttttccgaggataggcaggaacctttttttttttcctttctttggccaattttagttccaaacttttttaaaaaaaacttccaacttttccatcacatcaaaacttttctacacacacaaatttccaactccgtcacatcgttccaatttcaaccaaactttcaattttagcgtgaactaaacactttcacaaacttcatcacgaaatattttaacctagcatgtgtttaatctggggtaaagttttagcgtgtcacattggatattatggtcttgtttagtttcaaaacaaaaaaaattcatgttgtcatatcgaatgtttggacacatgcatggagtattaaatgtataaaaaaatacacatattgtgtgtaaattgtgatacgaagcttttaagcctaatggtgacatgatttgacgttgtggtactacagtaaacatttgataatgatggattaattaggcttaataaattcgtctcgtaatttcttggcgaaatctgtaatttattttattattagattacgtttaatattttaaatgtgtctgtatatccgatgtgataaccaaacccaaaatttttccccaaccaaacaaatcctatataaggtgccgcatggggtgttcgggcactaataaaagaactaattacaatatccatcagtaaaccgcgagacaatttattaagcctaattaatccgtcattagcaaatgtttactgtagcaccacattgtcaaatcatggagcaattaggcttaaaagattcgtctcacaaaagtagttgtaatctgtgcaattagttattttttaacctatatttaatacaccatgtatgtgtccaaacattccatgtgatatggtgtaaagttttagggtgggttctaaacaggccccctaatatatttcttctgtcccataaaaaactaacattgtgccggatatgacacatgtctaaatttaaaatactagaatacgccacattatatcctagattcgttttttttggaactgaggaagcatgtcatatataagttaaaacattttggaacgaacgaagtagtccctttgtttttgtttcgttacacggcagatgcataagcacatatacataactacacatgtcaaaccacactcacatttctcggaatgtgtcctctaacacgtgctttaaggctaagtttttttcacttcacaagtcacctttctggttttccgtgtacatgttttacaaactaataaacagtgtctattttttaaaaagttttctctacgaaagttgttttaagaaatcatattaatctattttcaagttattttttctagtacttaattaattatacattaataaatcatcatgttttccgtgcgggacccaaacacagcctaaagagacggaaaccatagcaaatctttcatcttaggccatgtttagttcccacataaaaactttttaccctgtcacatcgaatgtttggatacatgcatagagtattaaatatgaaaaaaaactaattacacatattgcgcgtaaattgcgagacgaatcttttaagcctaattgctccatggtttgacaatgtggcactaaaacatttgctaataacggattaattaggcttaataaattcgtctcgcggtttacaggcgaaatatgtaatttgttttgttattagtctatgtttaatacttcaaatgtttgtccgtatatctgatgtgacacgctaaaacttttcaccccttaattgcacactccctccaacccattttaagtgcaaccataagttttcgtgcccaactgatcgtctatcttatttgaaaaaaattataattagtatttttattgttatgagataataaaatatgaatagtactttactcgtgacttatgtttttattttttttaaaaaaaataaataagacagacagttaaagttaaacgtaaaaaactatagttgtaattaaaatgggacggagggattagagccttactataatcatgttaaagatctacttatatattcgtggtcgtttgaaccatagtgacaccacatcgctggtgtttatctttatcttttctctttttttagtcgtctccgctgttgcgtccggcaacccggcaaaccggccgggcggccgccgttggctcgcggtacggtcaactgcttggttttgccgggcagcggcacatccgaggaccttaatttgtagccaggccaacgacaacctgacacgccaaagaaattattcaaatctcgcagaaaaagtagtcctaaattgctgacgatcgattctgtattagaataaatttataaaatggtagtatagttcttttaggcaaatctatgtatatcaatccctttgcttttaaactggtcgtttgagaaaaatagggacagtgggaattttcaaagttcgatagaatattaaggccctctttgtttaggcttagacttattggcttagatttttaagtcagcttattggcttataggatttataagtcgatggatttaatgtcctaagtttagtgatggagtcatacatctacctcatataagccaaaaaagctcctccaatctagcttttggcttaatagtgttagagtggcttatgacttcaaaaaccaaacgaaaaaagctgcttgtttgtttagtcatagattttttggtttataagttggcttataagcctaaacaaagaggacctaattatcctcatatcaaatattttgtttcctgcaaaataaaatatcagaatattttgtacaagacggagtactagatagaaataacacagcctagtattcactgtatatatatatattttttggaacgccgactgtatatatatttggtatatatatttgagatataacgaattgtgagatttttcatgaaattctcctcgctcaccaattcacacagtgaatttttctactctgcaaaagtgtaacgctacacacgaactattacgtcagcttgctaggatacctgaagctctgaaagtccacatgttacgcgtggcaaatccatatggagtacgattgcaaggttttcatactgttgaaacagataagcagctttcattgctcgtgaatcttgtgggctgtggctgatttaatttgcaggtatatacctgttgcagatgcagctataaatctataatcacacgtgacacagctatatactccgtatatgtgtggacgggagcaactggcaaagtaacattatgcagtcaccctcgtgtcagcatcgccctctcgagcctcacgaaacattcatgaacggtacagtattacagttacatgcatagtaaaaataatactccaggtgacatgtctttaactttactcatatgcatgtaatgaactcctttatactcctatttcacttgcaattagtagtagtagcttgatt

SEQ ID NO: 65997 - DNA, 5108 bp, Oryza sativa
ctggatgatgcaatgcatttttattgtacaattcaaaggctcaaacttcatgcagaccagactgtcctgtttaattgataactaaatgaggagatgagcaccataaatttgtaccaattaacgctcatatgaacagtgcaacagatggcacagttcatcgaggacattttgcatttctcaatagccaacaaacaatccccaactgtttgcgaaaatggccacagtgaaccaagaatgaggcaatttcttgttgccattcagccattctacctttaatatttcttcctgtaaattctagtgttgagttgctcatcactacaaatacaaggtgaaaactcacttactgcctacaacatcaaaatcctaccacgctatctaaaagtattgtgtcatcaacaaaattcgtctgtttcagcagaagcaacagtatcacgtctaaaagttgtactgttggctagcaaagttaaagaccatctctgatttagcctggtctcaagcatccaccagggagcaagaatctgaacttgtctgcgttcttgatcaaataggaaggcagatgaacagcagatcctgactttggtatgggtcccatcttcttgaagagatccttgaatgtgtactcttcaggcagcatgtcaaacaggtcctccccattacatatgaccctctggattctgtctggatttaggaagctgtcctgcttcacccggtctgcgtggctatatgccttcatcttgaaagcaaactccttgatgtccttgaagcagaagctacaatgccagcctgcatcagccagcagaaggttgctctgacgggagtggcggtacaatgtatgctcagtgaacacatgtgctgtggccctccagctgttgtagtctataggaaattcaaaggagtacatatagttcttcagctcgagatgcatgacttgcggtattccatcacaccacttgagcaactgcaccgtctcagggctagggatctcatcagcatcagccatgatcaatacatcccccacagcaatgcctgatcttcgcagcagcatattaagcgcacgacggtggccggcctcaacatggaagggctgacggtgagaaccgggatccatttccatgacaggaagcatgtcatacacaatcttggagccagcgaatgcaaagcgattgatattttccaagaaagagagtgacttcgggatgccagtgaatgtggcattagcttcaaggatgacaaacctgtcaacatacggaaggagctcaccgtagcgaatttctagaatatcaagttcattactgaagaggacggcgtcaaagacacggcgaggggtggggaggataccccaaccatggagctgacagagctgcggcatggagatgttgggggcatagtagtgtgggatgcggataaatggcttaggtggtgtgtcccacagtggccgcagaaggtaagagatattatggaaatactgcgtaacaacaataacagccactgaaagaactagaacacatggtatcagcaacttgagggaagcgattttccgtctagttagaggtggaaaaggagaggttctagccatgagaatatctgtctatgacaaagacaggaaatagatgagactctgataagcatagatgagaggtgtctcggatattctctactcctgggaagtgtagcaaacttcggaatgtgaaagtaaatctgtattatgcaagagacagaagaaagtaagcaaacagaaaaaataagtggcagaacaagcaatgtgatgcaagtatcaattagagaaagtactaatttcaaaataagaagaaagagatgaattgcaggtacaccctttatcttctaaatttgtaatgcaacagccatggatagaaatgttagtaggacagatatactattattgaatcatttcaataaaaaagggtcttaaacatcatgttcacgtattcatgtgttactgaaggaagcaacttctatcagcacctcatttctaacaatccccaacatgaaacattttctattttagaggacaacaaacaattaaagatgatacagtcattactaatttcagaattcagacctgtgtagaccacacaaatcagcattcaggcctagttcgttggatcgcaacattggaagaccataacaaatcagccttctctacaaatgaagatctaatctctatgcccagttcgttgaatgtatgcccaaaaatgcaattccatttcagcaacacaaacaaaataagaaagcccctatttgccccccaaaatcaaatcaaaacagcacctctactacccttttattcatttgttcatcaatactaacaaactgcagtctgcaggctaagcattacaacattcctaaagattagaaactgccgccaaccctaaagatattggcatcaaacataaccaatcagacaagcaccgccaatagtagatccatccaagatttgcatagcgagatgtttggagcactgggatggccaaagaacaagaatcacctcaccgcgaggacgaagaagaagaagaagatgaagatgaagccttcgccgtctctgctccaccaccaccgccaccaccgccgccgccgccgccgccgcggcctcctctacatcgcccggccggtgccccgccacctccttcttcttcctcctgctcgcatgtaaaccacctctcccacttctcctccgacaatctctccctatcctccgcctattcctgtcgccccgccatccgccatgggaggggaatccgagctttgctgctgctaaaattaggcgctaacaaatctcctcctctcttcttttttgcttgcagtgctctcactcttttccgtactggaagaagtggaggtgaagaaaaagaaactcacaaaaaggaaaagaactgtggatgcggcaatcaatcgaatcaatcacactcgcgccaccaggagcagcagcagcagatttcgctttgggtttgggaggggatcgtggtgggatatgcgatgattgctcagctttgggcggcgcggcacactggagactggactactgctagtgttgattctgattctctgcatggatcatctgtgtaggtaagagcagttacaatagcaggctatgagccagctacaaacatattttaaatagatggataacagcgggctacagatttatagtcagctgtagcacgaactcaaagacacactgtgtgtatgataagtgggaccaggtattaatagtgtagtatgtaactattgtatgaatgagctattaggttggttataaatgaattgtagctagtagttggctatactattaaacttgctctaagtgcaaggataatagtaaaactcactatctattattagcccgtcttagagccaatacatataatagattaggtataaggttggctataattttcttcttctatctctatctctcacttacacatttattatttctgtcttggagcttgtgttaagctaactcttgcatgagagccaacatctttgatgtttcgctacatctctcctccacataagcttataagcttatatagctcactattatacttgctctaagagcaggttcaatagtatcggagcaggttcaatagtatcgccggctgctggctccatccatctttgcagctattactagagccaacttatacaatagagtagctcctgtgttgatcatatatcactaatcaataattaattctgtacatatattaatgtacatgatccaagctgaagtcaattcctgtggccgtgtctgtgctaaattaacgagtcacgacaatcacgggccttagcaactcattgccagcatgtcggccacccgcatcaccatgaaggcatttcaacagaggagaacaagaaaaagggaaaaagggaagagtcgaatagattagacgatgacaaactcaaattagtttttaaaagaaaacaactcaaattaaacaaagctgcatagcatatcgcatgctctcgtcggtgattagaccaggagagcgagcgaacggtgctcaccacgcgctcaacgatggtgattgagcttttgcttccgcagaaccccctgctcgcgacactcgacaggtctcggccaattcgaacttcatttgcagctgcgcaatttgcagatccatctgcgggcgcccggcagcgggacgtacaaccgccggcgtctataaaatgttaggaggatatttggttgggggaagacgaagacgaggcgacaaagatgcaactagatgggccgcgctgaagaggaaaaccacataagatccgatgggcacgtcagtggacccacaaaaattgtttttaatcgctaacaacagctcccccgcgttgaaagaagcgttagcacccggcgatacatttgtcgcgcccgtttgtttctctttcctcacttctctctcctctcctatataatgatataaacacacgtgatggcctaggtttgcgagccaaaaacaaactgctcgcgagtcagctcggctcggctcatttcaggcttgggcttggctcgagcttagttagccaagcccaagctgagctcccaagctctagcttttccacccttaaatatggccgcccaaaattttaaggtgtttggatgatatggctaccacttaggctctgttcggtagcgagggttaggaaccctcactccccgacacacaaaacgaaacagcgttttagtgcgtgattaattaagttttagctattttttttcaaaaatagattaatatgatttttttaagcaactttcgtatagaaactttttgcaaaaaaacccaccgtttagcagtttgaaaagcgtgcgcgtggaaaacgagaaggaggagttggaaactcaaatggagccttagagcaggtacaatagcaggctataagccagctgcaaacatattttaaggagataaatgagaagagagaagggcagcgggctacatatttgtagccagctgtagcacggactccaagacacagtgtatgtatgacaggtgggaccatgtattaatagtgtagtatataattattgtatgaatgaattattagattgactatagataaattagataaattggagttagtaggggtgcagg

SEQ ID NO: 65998 - DNA, 18518 bp, Oryza sativa
gatgatggaaatcatgtaaaaaaagaatgatggaaatagaaaagctcatgtgggtgactaaaaaatgcgttgaaacatgctggcaaacaacgagttcgtgtgatgttttggtccacgcaacgagtacgttaccggctacacggtgcgagccgtctggtggtgccatgccaagcgtgtgatgatgaacttaatttgcaaagttctttttctttattttctccttctttgttgaccttgtgcatgtactgttccagatggcatctactactactacacgcgcgcaatcagttaaattgcgtgagaacttacgccattgattgcgtaattaagaagaaaagatcatcaagagagaatgtcaaaggtgtaggtaaggattatggagagagaaggcactgcactagagttgttgggtgatttgattaggagtaactagctcgccaggataatccttcactgatagtccaacaactataacctaaaaataaaaatttatgaattcctgcagaaaaaaagagattaatcaaaagcacacgactacactaccaatagtaatttatttactcgagccaagggaataaagacaggttgtgccatgagctatatagctcgaactcgcctttgtatccggatcttgtcgtctgcacgcattcatgcatattgtcaaattaagtactagtttatttatccacacgatcgatcaatgaacctagacgatcgaataatcaaagttttggatgatatgcaccgtacgtacgagtcgccactattgtttgtttacgcacgcacgagcactagagtcaaaatggtgcgttactgtgcactggctgtttcgagtggctagctagcttatcaggttaggtgcccacgggttcaagcgtgtcagttactattaaaaaatatacgagatcaaatatgttggactatggcctttttatttagtccatcttggatatgttctgacttatgacatgggtagtgccataggatctgttcgagatgtacaaatttcgtggaaacggttcaatttttagcggaaacatcggcagttttcggaattccaacttccaaccgggtactaagcatcaccaacaatctacctatatgatttccaagactaattttgagggattttagtccaaaaatcagctccagcagatccctactctcctacccgagttttggagttccctccccccggttcctcgctccgtttatatgcgggcgcgaaagtcgctcccaatcacgcaatcccgcctctctccttcgttcccgtgcgtgggagatagcgatctttctgcgcgtgaaagaaaaaaaacataattttctcttggtagtttaaccgaagggcccacttttaagttttggggattgaatttagtctatctgttggagggaggagttttttcacttcctattttcagtttaggaaacccaaaaacaaattgttaggaaaaaattatagataatctattggtaatatcaacagattacctaatctcccccaaaaaaatatttttgggttttctaaactaaaaatagtaagtcaaaaaacttctccctctaacaaatatcctgcattcaatcccaaaacttaaaagtagatccttttgttaaaataccaacagaaattccgttttttttcttccacgcgcaaaaagatcactacctcctacacgtgggaatgggaggagagaggcaggagtacgagattgggagcgacttttgcgagaacacgcgtccgcatataaacagagcaaggaatcgggagaaaggaactccaaaactcggctcgggtaggagagtaggggaactgttggagctgtttttttttttactaaaattcctcaaaatcaattttgggaatcaaataggtagactgttggtgatatgtttagtttgatgcaaaaaataatccctaccaaattttgacaccatcaaaatcaaaatttggccaataccaaacaatgtaaggtagaggtaaatgggtgttgtttggtttgatgcgttactaattctttttgtgtggagctatgtgaagaagaatctagaaaattaccaaattttgacatggtatggtatttgagatatgtttagactaatatgttattaaaatttgatagtaacaaaacttgataagattaaaaatggtactaaagtgaacaagctcttattgttgtgcaattgccatgcaataggtaagagcaaatgttaagcagcagtgactatatttgtcttcattgcattggcgcatggagtttgtgacaattttaccaactacaacctccgttctaaaaataagcaaacataatgcgaaatatgatatattctaatactactattctagacatagcactagaatatatcatataaagtattatgttcgtttattttagaacggatgcttacattgcatgggagggttgggtgctcatttgtttgaagttattcaatccagctatataggagtacgtgttacattaacatggatatgaaaaagaacctgtcatgtagttcccgacttcccgtactcaaatctggtcatccctatttagattttttgggtgtccagatattttatttttctgagtctatgctagattttttgggggagtgtccagatatttctctgatcaaaatgatactgcagtatatcgaaccagaaaacatggatcacctagcaggacgagtgagctactgtgtgtgacagaggcgaggggaaaaaaatcttcgctcttttcatcgctagagttaccctcctatgtactgtactgattgtcgtttagaaagctccaaacttcacaactgacagagaaaaaacgtcggaaaaagacgcatccaactgacttatgtgggttctacatgtcattaagataccgatggcatatcttaaactttacaaaattataatggtatggttccaaattaccctccggaaaacgcacatttcgtatcggttctcacttttcaagatggcttcttcctcatcctctcctcttaatttcggcgacatgtcattacgtcaaacaaaaggaaccagggtcctttactgacgggtcatgtatgtcggcgtctgacgaaagaagaatcagaaaatgtatattccggactctcatccatcgtaccaaccctcgtttcctcctccctgatgtgaatcggtcaggagcgtagtacattcgcagcaatttgcagagcatatgcagttgcattctgcatatgctattccgtcggtcagacaaaggaagaaacgacgacgaagtcgtgcgagatcttgacagatcggggaggaatggaggggagagtaggtgaggatgcagcaccgatctcacacgacacgccgaccgacccgtggagtgagagtaacaagttaacaaaagcgatcaacataccttctagatgagctccttgatctctttccttactttccaggcgatcttctcttgttggtgcatgacggcagcagcagcattagcagatcaaatgtgttgttgacaggtgagagctaggaggaaatcagaaaaaaaaataaaaataagcggttgtctatggagtgacagctacgctcgctctgaagacacaggagaaacggaagaaccaaaagagagacgtgatatttactttgttctgctcaagcttttgacattagaccagggaccattttttccttctttagaaaagttcaatgagcgggcccaattctaatcaaactgtggcacactgcacctagctagtatatgtttgaactttaaactaatcctgctctggaaacagaataaacctgggggattgaaaccaaaataagctgaaacatacggtggactatcagaaaaaagggagttttgccccaatgctacctcagcagtgcatacttgcctcaaattacagttgccgtagctgccctgctatatgatgcttatacatgcttatacatccaacccctctatatatctgtacagaattccagcttcagacaaattaagctggttctaggcttctagcttgtatcacgccaatattggatcaggctgatatttaaattcaggcaaatggtcaagcctgcaaggaaaaaagggtattatcagtaaaacgtgaggtttgtctggttgatccagaagttctaacaatgttactgccggtgaagctgtaatttcgccatgtctgatgtaagtagtacagtggctcaggaaagacaagtttgccatcatagtatgctatagcacaatcaaagggtgcaagctaatcattcgtacctttgtctgactttgagaataccagtgccaagttgcatgggtatacccatgataatgcattcactaactccctctatctgatcctcacgaccactgtatgatgcattaaagagatgctccgctgttttctcaaacgaagccagcatcagcacactacttttcatttttgcaataccatatctagtaatgccaagaatttcaccctgctcggagaataagaaccagcagtatgtaagttactgttgaagggtacacaacatagattaaaaatatagcataataaaatgaaggtaggtgttaattattgtaccttgtatgtcatcaaatctgccagaagcatcatatgtctcgaatcaatgttcatcccatgacttttcattgtatactgaatttcatcaataatagatctcctcgcagcttcaattccgagtgttcggttcacttccatgatgtggttactttttgttttcatagcatcaactcctggagtacccattactgccaagagatttgttctgcaattacagaactatttgattaatattctagaaaaataatgcagaagttggagtaagtcagaaactaagccattccaagagacaagaccctggaactctagtgatctacaaaaataggtcaataaaattctaacaagggtcagcaaatctacaaacggaactttagttcatgctgctaaaactgtgaatgatatgattatatgaactcatacccctcaaccaacaacttgtatcttttgtcattttcttcaccagtttcgctgatcacagctctttcaacagttggaataccctgaattgattagtaggaaggtcagagacagccaaaatggcacatctaacactgcacatcttgataaatgctaaccttcacgatcacttttggaagcatggatttgagatgatgtaactcatatagaagtttggacttatctattccagctggataaattctcaacttggatttatcaataacacgaacatgctgcaaagatgacgtacaataaataatattaacagaaaaaactgatggtcaggcgtatcaaagagctttgttgatacctcagattttagctttatttttggatgattcaatattgacagctgcacagagtcagcagagatgcccatgtgcagggcttctatacgttgcatatcgagtttaacaaccaagtttggttgacttgatttcaacacaatctttatggcttcagccacctgctcaacacaaagaccatccatacatccaaaagttaagggcaaagtaacaccgtgaaattcctaaatttgagttctctccttcataaaatttataaattgtgggcagagcttttcatttctgtaaattgaataacctggtaaatatgatgccactagcttgatgcgtagacaaatatcaaatggctaatatctttgaagtgtattaaatgcatgtcatgattttaatgtatttaagaaacatagatgaagatgtaaagcagactgacttcttgtaagttttaagtgcgtgtaatgatgtaaaatacaagaggatacaattatcaacatcgaaagcaagtttgggggcaacatacctcacccagcactgccttttccatagagcctttcacaatgcgtgcagacaacacatccttctcagaaagtaactcagcagtgataataggtgtgcttatctttttagcagcattgataatttccttgatgcgaggaacaccaagagtaacatctttttacttgttaaggaaagatgatttgaacagcagtgtccaagaatagcatgtatgcattactctacatcaagatatcaaatgctgtagtattgtgcaaatcaattcagattgatgaaagcttatatcttttagcgcatattattgacaatttcatccgctttatcttagatactacattccaatgcccctctaaagtaaataaattataggaaataggccaaaacgacctgctagtaattcttaaaattaaaagcagactttcacgaaccatatagtatataggatactcatgctagctactcctgcaaaatggaaagttttcaatgtcatctgagttccaggctctccaatactttgagccccaattgccccaattgatgctccggcttcaattttcttcaagtggtaacgagataaacatgtgtccaagaaaacctgagccatatggagaaaaggaaaaccattacagaatgacgacacaaggataaaatgcataagcaaaccaataaaaataatacttgaaatcagtttaacatttactgcagaaaattagcatgaccacgcaattagtaagagaccaaaaaattgatcagaaatagactgtgcttgatatttcaggtttttcgcaaaacagagatgaattggtatgtgaaaaatatgaatagacacacctgtagttgcttcacagatataccagaaatattagcagcaatggattcttcaaagctggagtgcctctctccaacatgatcttcatctaggagaagcgctctccttgtgctcttcagcaattttatacgatcctcaagaaaatacgttaacagttgcttgaacttttcgctacaaccatcatcagaggaggcatcatgttcagagagcttgtcatttaaaatttgtaagatttcacctggagataatgtattctgtcccctttgaggacaagtggcctacaacagtaaaatggttagcacacgaggcgcatctcacttgatcaagtaaacaaactgtttttacatgttaaaactgaccatgactttcataaacaattgatccaaatttaagggctttccatctttcccttccatctttgcaggatccatgccatcatctccatagaggaactgtacaataccaccactagcattgcggaccgtctgatcatagaaaactgagagatcttccaatcccttcattaatctgcgggacatatatcctgtttcagctgttttaacctacgatcacaagttcacaaccaaggaaacaagcagaaattatattccaaatttccaacaattcccaaatgtttttgagaagccagaaggcacaatgagtatgctggaaatgcccaatgggttgcaccttggtccagctgaatgcacaagataccagtatagttcacctaacagacctctacatagaactggcatagtgctgtgaaggttttcatgcagcgaactacagtgcctgagataaaacactcaactgcaaggaccaaagcctaaaaggcagagtcaaacggaaacgccagattcaactctggtatgcaagcaagttgatttagtgcccaaacaacgaacaaggaaacatcttccccaatcattgctgtgctcaaaatataaaggagaagtgggcttaattctataagaatgtgatgaatgaacttatcatttgtttctagttgatgatgtgctcttctataatagctgctaagtttcctaatcctatccctgccaggcacaaggagctaattcagactattcctctcacataatatcatcattgtactactattaattcaattgagtagtatgtactgcggtgtaagtctatgtgagcaaatttaagaaatttttgtgctgaaatacagatagagtgcaaatatcaacttatgcaaacaatagatggttttatacatagacataccgctgtatcaacaagaccttctcgcccacccatcgtatggaagaagaattcggtggcagtcaagccagtatagaaagaattagcgacaaagcctttggcctggaaatggaatacaaaacatatttgtatgtgaatataccaaaatgtgctgatttcgtgacctttaattcaaacaaaattgcagtcagaacaagttgaataaaaaaatgttttctctaacaaagctaggtggaggactacgagtcaacgaaatccccactctgaaaaggaccaatttttctacatgataacttccaatagaatcccacgatcctttaatgaaaaataaataattaattagccatttaggataccacatatatatacatcaaagggaagtaatgtcaattcagaactttctataacataagagatattgtgtttaaaataaaacattacatatattttcaatttccagcctctatctctatgtatagtgccccataaaatttgaagagtacttatttgaacagaactagaaatatccagcaccagaaatggatacacaaataagcaagtcatatttctagtactgatgttcttactgcaggagtctttgaatttataggaaagtggggaagagttcgatctatgaagccattcggggcacgacgccctccaactgattgttggccaacacatgcaaccatctgactaatgttgattggagaacctttagatccacactgagacatgatcaatgggctgttcctccagtgaagtgtattcatacagacctgataaataagtttaagtgcattcaataaaaaaagtgcaaaatcaaatttgaataattttgttttgagtcaacaaaataattgcatcgggtctccagtagaagtcaaaatcacgctaaaaatcagactcatgatgagaatatccatgcaacaaaatttggttcaggaaaattcaaagatttgctcactggaaaataatatgaaatgcaaggctaaaaatatttttctatctgtaaagaatatgcaaaagtacaacaatggattaaattaacaaaatattgacaggcttactggctaaggaaattcagaaagacaataaaattggatgaaacatacttttccagcttcttctctgatttcattcagtacacgagttatactttgctccaatgtttgggctgcgttgcaaccgggctgcaaacggagtgcacctttggaataggaagcaataagatcatggcaatctttgtaccctccatctattttcattttcttctcttggtttaaatgttctcccggttggacatcgtccacaccaattgagaaaccatggttccctataaatcttgcactgcaggaaaagatgaatgcaattcaaatcagaaaaaaaaatgtgcactaaattatgtaacaatctaacaccaacaatacaaatgagaaactcagcaaaatggtaataatagagagataaaattgaacgagtgtacaccaactaagctccctgacttaattagtgtcaaatggcaaagtggtttgcgtacaaataaaaaagatggcagattcacgtaaaataaaataaaaagaaggcagagtgtttgacttattagtgatttctattaaccctctcgcattctttaatggaacaaagacagaacaaaaaaataattgcatagcatttgttagttaatatttaggaaagaatgggtccattacgcaattttgtagctcacctaaattttgccaagcggttcatacagcttgccgcagcatgagaattataatctcttacaagagtggagaacatgccatccttattcccattacctggaaacaaaagattaaagattgttttggtttgcttccaaatttaacaagcaggatgaaaataacaaggacaactaactagcacaagtgaacaatacattttccaaacctgattaaaggaacatttattgtatgtggtgattcataagagggtaaaccatgccaggactattgtttatagtccatgcctataaactaatgttctcctaaagagaatatagcatactcctccatcccaaaatatagctgcctttctagctcagattagagaggtacctatatttttgggacagagtgagtacttaggattatcaggttggcagtcgttttagctatgaatcagtactgggtgggattctcacctaaagtggccttcccaacttgcccagatagaagttcactgtttcggaagtagacaaaaccatcattgggacacattgcttcaggttccagagttgaacccttaggagtcttataaattttctctttaacagtaagattcagaaacacctttgtacatgcgttaggacgtactaacacactgaagagttgtttaccagtccaaagctcaataggctgtacaaggagaacataatcactgaatcagtatacagagaaatcaggaatttgatgagaaagctaagatgcacaaaggcgcagctggaaaagagacaaggtactgcctcttgttatgcataataatgctgaaattcactacaaaaattactaaaacttatatgacaaagtaatccagtttgataatactgtcgaagtcaaataaaagtgatggcatgctgtcccccatgcccaaataatatctcctattaatgacaaacattggttgaagcattaagaaatagcatgtcttcaatctgatacttgcaaagtgcgttcctatgaaaaagccttaccttaatcagagcaggtgttggcaaatcaatgttttccattgcatcaccaagatatgaacataagagagaaaatgacgacctgtcataaaagttatcttttcttgtaaccagaaaagaggaagtcaaaaagtcttgcgtggatgcaaccagtatttccccattctttggggtacataaattgttctgaacctgcaaaagtattaatgattttgaatattagctacagaatagtggtagaacatcaaaaaaaaaaaaagatggtcaactgtaaaaagaaagagttagcaaatgctacccccatgagcataagcgcttcagtgcgggcttcctcagtctgaggaacatgcaaattcatctcatcgccatcaaaatcagcattatatgggttacagacagactcgttaaaccttagtgttctccagggcataatcctagcctgtgattaaatacaaagagcaagggaccaatatgaggtaacattttcatgtagcgggtgcagtgtaatgaagagcaatttataccctgtgagacataattgacattctatgcaagctcggttgtctattgaagaggacaatgtctccatcttctaaatgcctttcgactacacagccatacttcaaatctcgagcagcaattcttctatcgcaatactttaagtgcctaaaaatgtaggataattgagtatatacgctgaacttataactaatttcagtgcatttactgatatgacttacagctttgttccatcaggttgtatgatgaaatttgcccctggatgtttgtgtggaccattccgtatacactgacgcagcttctctatgttatagtatgaaactctttcaggataagtcaaaactcgagccatcaggatgggaatagccacctgaagtgttaattaatgatgacgttaaacatcaacaaggaagtgaacataaaaaacttctatattgccatgtacctctgttattctcaagtttggatcaggagaaatgacagtccttccagtgtactcggtacgttttccagacaagttaccacgaaatcggcctgtcttccctttgagtcgctgaacaaggcctcgatgttgtgactcgggaagagagggtgcgtcactgttgatatattcaacaacttgaagttgaaggtgttgccagcaatccttcaaagattgaaaagaagtagatgtaatcatttaaagtaatatcaaattgttagaatgcatatcgtacagtcagaatattttgatagcatagcaccagaggaactcttgtgaaagagtcataaaaaacacaattttgaatgatctaaatggttgttttccttcatagagacgagtgcatttttctcttgaaacagtagttactgacttagtaatttagttagctaaataggaataagcattttgtcacacttaagtcggattttcaaaactgtaatactttgaacctgtcatgctgataagacaccagcccccacatgaattctgcatatcaaaggaaagtcacaatctgacttactacagaataatcaatcctgttagaatatgatttctggctttcatattttctacttgtgtaaatcatcaagtttcctaaatattttgccttgtaggttccatacagacaaattgagattaaccctaaactagattatgggtctatcaagctgtgtgtttcatgaagatacagagacaaggtgatttctgagtttctagcaaactatccgaaaggaattctaaacatacagaagttgcactgcactaagagaaaaaaatgggagaaaataaacaaacgaagagctgtgagtgtcttacaaagcacttcatgaactgaccaccagtttgaaggttctccttaaggatggaattagtattagcaatactcttcaatatgacggtaatgctatcttcattgctgtgggaagcaagacaattcaatgcattaaaaggaaaatgtggttatgctgaatcaccatttgacatataggtactaaaaaactgaagagcaaacctcattcttccaccagccacgaaaacagaaggacgtataggtacaggtggcactgcaatctctgtcacaataagtttctcaggcctatcaccgaggtttagcaactcacaatcctgtagagtgcataatatcaaagtgagagaaaacatacataaaactaatcgaacaaatctgtagtctgtacaatacaaattgtggtactctcataaaatagtaatcttgaaagacaaaaaaataggatctacctcatcggtcattcttttgaaaagagatagaacaattgcagggtctagcatgcgaacagcactaatagatagtttctctttcttatgtgatagtgcgtcccgaagctcttctgtgcttccatccaatgttttgctacaatcatgaagaataatcaaccctgctctgccctttttagcaacacctgtactaccaaccaaagaaacgcaaaagtgagaaatgttctgtaaaatgttgacagcagtcaggtgaccattagtaagccatcctaaggaaaatttaagtggcgaggagccgaggataaaaaggagtatcagaaagtagcttgccatttatgaatccacaccaggggcaacgggatagtttgcatttgtccctcacttttttcatgatagcacttttctgtagcggatctgctttgggatttctcattttcttcaaaaactctagccgatctttctccataagaagaaccctgctgcagctctttaaataaattatggaacaagtataagaataatcacatttggtggatttagacaaaacatctaatcttattcgtgcagtgataccttgcagatgcacttcaatacatccaaaatacagttaaagaatccaacattaaaaactggaagggcgagcttcaagtaaccaaaatgacccgggcattcagcaaatgaaccatggcaagtactgcactccccaagcttgtttgccgcaccctgaaattatatgaaatgttgtataaaaaagaacaacaatgaaccatgaaacaggatccggaaagcatagcccagctgccttcctatgatgaagcaaatgaaaccacatttgctcaaacatctgcaatcaatgagaaactcgaagggcaacacgcatttaccatccgcgtgtcgagcaatccattgggcaccggcttcatctcatggttgtagatccggctgttccaaacctgcacctccgcggattggcgcacctcgttccccgagaacatgctgaaccggatgctctttctgaaccggattggttcaaatcgaatcagaaaacaaaaccaaaagtcagtaaacacaaccgcagcgcgacgacgacgacgacgatgaaaacacgccggaccgacggggccttacatcctccgcgtgccgacatcctcgatgaagggctccttcgtgcaccgcagcttctcctccggccgcgccatctcccctcccgactgggctccgctcgacgccgccgttcgcgagccggagccgcttcggatcgtgaaaacctggcggaggaggcagagtaggaaggggagagggagaggtgacggtagcaatggggaatggagctggggttttgtaggggcttagggcgagggagagggagagagagaggaggctagggcgaggtggagaaggagaggaaaccgtacacaacgcacctacgggccttctcgccggcggcgcgggagaggaggcgaggcgaggcgaacctccgacagccgccgcccgccggctcgccgctcgcgcggaaaggggaggaacgggggagagttggcagcggcgcgggaccctagatgacttcgcttttttcggcttggaggaaataaataggtagggcgagtatctacattgtttaattaattttattcccgtatcttagccgtatgttggggatcgacgggttggcttgttccgttttatgtaacagaggagtcgcgggttcgattcttcttcatatcatcaccttttttttcccctaaaaaatattttttttcctttttccctaaaaaaatcccctaaaaatttttttcccttttttccctaaaaaaaatcttcaacagttaaaggcatgtttaaatatacagcccccacacagagttatacaagagactctcacagtacctaagccaatcatgactctaaccattaaaaaaattggtatttttctttcgtttacacccttatacaacaaaagtgtttattttatatatgctaaagatcgttgttgaaccatttaaccgtagcaacaatttattttctcatatcttgtatatatctttaaaaaatatatttatctgtgttctttcctgggtgattgtgtgtgagtttgtttcgttttccgcgcgcacgcttcccaaactactaaacggtgtgtgttttgcaaaaaaaaaattatagaaagctgcttaaaaaatcatattaatccatttttcaagtttaaaatagttaataatcaattaatcatgcgataatggctcacctcattttgcgtatcttcccaatcttctctatctccttctcctcaaacacagccctgttcggatatggggagttgggaactaaactccccgcacagaaaacagaccagtccattagcgcgtgattaattaagtatttattattttttttcaaaaatagatcaatatggtttttttaagcaacttttgtataaaaacttttttgcaaaaaaacacatcgtttagtagtttgaaaaacgtgcacgcggaaaaagagaggggtgaattgggaactctgggttccgaacacacccttagtatcaacaagtattctctttatcatcatatatggcaaagtgctttttattttactggtgccaagagtcgttttgaggcattgttaaccggccaacaatgtttctctcctataatctttgtcttctatatgaacgaatagttccaattagtaaggctaaaagctccttattgatgaccattgtactggtatttcgtttatggccttgtttggctctcttgcagttacaaaccagcacaaaacagttttttgtgccttcggttgctatagcgcagtcgcaatcctgttacaagaatatctcctgaacaagccttataagattaagggtttgtatcactcttttttgttatttatgttgataaccaaatttggaacagacaaatttgacaagaacaagccttagtatttttcaaattatactaagccttgaaaaatactaatgcttgttccggagatatggctattgctctgttttctgtaacagggcagcaagaacggccaaatttgaaaaacactaagactttcccatgaaggccagttttaaccgtcactgtgtaatcagtcagaccaaacaaatatgatgtggtcaggccttcagcatagagtccgagtccaagtaaggaatttcttgcgtttccttattttataccgagatttcttgagtttgatttctttagcctaattggatcctggaaagcaaatccacctttctataaatatgaggacgaaggttgattagaaaaacaacaaatcaattgtcaaaatcaatttatcacctaaaacctttattctacatcttcctcctgtttgctatttatcccaacgtctattctcctcaaatcccacaattgtgcatcattttttttgtctttacattgttataggacgtcctggctagcctatcaaggctaggacaaactgacgcgtgttcatcttgagggggtccctcccaggtgttcattcagcggcatatacctctccatgtgacgcgcgtctttggttgttgttgcgaattgcacgtaatatgctcaaagtgtggtagcgcgattcaacgtctaacaatttcctctggtagcttttttgttgcacgtgttcgttgttgttgtctatccaagtattgattcttattttacataacagatagtgtataatataattctagagaatacataacgtgaaaaactaatttcacatgataaatataagaatgaggtttgaatcagtcatatgataaatcccgaattgatggtttttaaatatgtttaaaggtaaaagctcgatatgagcttctagttcatttcatttaaaatctatcccctcatgacaaattttagactaactttttactactttcgtttcattttcgttactctcgttcaacaaaaatctcctcttttctatttttcatatcagcaaatctggtttagcttttttaaaatcctttcttaatctaaatttgcatttgttggcaaggctatgaacgtgctatttgtaggtcttgtacatgcgcttgttttttttcccctttgtatcgcctgacgccgggtggactgttccaatttccaaacaaaagcccacaggtcaatacgtcctatgttagattcaggcccaaaaaggcctatattcgaatgcaatgtgtaccacacatcttggatcgaacgtctcacagagtacatcctggaacgggattgccgagtaaatccagaattccaaggaaggtgagggccctttcgtgaaaactgcctgcctgacatgcgggtccggctcgaaggtgggcccaacattcaacgaggaagagaaggcatctccatttccctccacggcgtcgccgccggcagccggacgccgcagaccgtcggttctcacctctcgtcattctcgcagacctataatcgccagtataataatatattattaaattttatatcgacctaaaacatgacaaaatattagcatttccattacgtgtttatacgttgttaatggattcaagataatcactagtggctactgattactatttgatgaaaacaaaaaaaagattcaagataattaccgcaaaatccacactaatggcttctgaatactatttgatgataacatgaaacgcattcgacataatcatctcaataaaaacttgcaaccatgcgtgagaatttattacaaagctggcaaaccatctaattaactttaggcttctaaagaagcagcgcgacagccgtcacggcgaggacaccggctccaccggcgaaggcaacggcggcggacgaactctcctgcgccggagccggcgcaggcgaagggtagtgcccgtagtagctaggtgcttgagcgccttcgtcagcgctaggcggggacggcggcggcggcggcgactgatggcggccgtcaccgggagtaggagcaggggaatactgaacatgcgacgacggcgccggcgccggcgccaggtggctgttcgtcccgtggatcaccgctggcgctggcgccggcgcgtgggccggccacggccagctggagtgcaccggcgccggagcatggcgatcatgatgcgaactcggggcgtgcgccggggcagtagcagtagcatgacggtggtgatgatggccatggtgatgatgatgatgcgaggggcttggcttgtcgtcacggaccggagccggggctggagcgtggtgatgccactctggggcttgcgctggctggtccgcgtggactggcgccggcgctggtgcgtggtggccgtgagcgccgtggtcgggagcgctcggcgactgagcccgcgccggccacggggcgtggtggtgagggtaaggcgcgtaggccggcgagtggtggtcggcgcgcgcggccgacgccgcagccaggagcgaggaggccagcagcattgacatcaccaaggccattggcgagatggaggtggccatggagagaagctgtgaggttcagagaatgcgagctacctcgtgttgccgtcgaaggcgagcgcgcatatatatagtcacaattcaaagatttgtttccaaagattaaaacttgggaaacgttgctgattatttgtcgggtatacttggcaag

SEQ ID NO: 65999 - DNA, 2455 bp, Oryza sativa
tatttctttcattactttagatatggtttgctgatgtagcatcaggactaaactagtgtttgtcttttaatcacaagataactaaaagtgggaatttgtaatacaactttcgatgatactagaaaacactcgagctagtcagtgttagaatatcaatcctggatagaacccatctaaaacaagtgcagccgacaatgacaactttgagagcataacataagttacttagcggtggagattgagcaatagcagaacataggctagtgttatgggttagggttcataggggataaacaccgtcgggaggatagccgggtggcgacgactgctagggatgagagggggacttaggttggggaagactaattctgattcattgcttaattagaatgacgatacaatccatccttatatagatggggggaggacccaatctaatcctatccaaccgactctatccttatccctagggcctcgacccctcggcccactacctatgacacctagattgatttggacatagaaaagaaaaagacttacctcacaatagtaatttttgagagattaatcattttagaccaaagaaagattagagatttaaactaggtttgagggttagagtttggctagactagtaatttagggtgtttactgtttagggagagtatttgatctccctaaaataaaagctctcatattcagagcgaagggtcttaagcgtagaaattcatcatcacctctttcagctactgatgttagtacactaaaatcataaatatctcggagctccttttatattggatgtatagtggtacccaaaaaccaaaggtagttttgtgtagcaagaaaagatttttcatattattggcacaaccagctctctattgtttttcttcaaattcagtttgtttgagtctctcgctctactatttaatactgtataatgtaattaggggtggacagaaagctcgtggctcgttagctcgctcggctcgtgacaagctcggcttggctcggctcggctcgtttcatttttctaacgagccgagctaggatttgagctcgttagagataacgagccggctcgagctggctcgcgagccgctcacgagccttaacgagctaagccttggtaagttagcaggttgcagcccacaaccgaaggccacagcccattaggcccacaacatgaaaaccctagcttcctagcctcccacaggacagcatcttctttcttcacgcgtgcgcgtctctccactctccacgccgctccgccgtcactcgccaagtcgtcgtccatcgctcgcatcgatgttccccctcgcaggctagccgctcacgtcactcgccacccgccgccgcctctatggcagcgccgtgcgtcctcgtccgcgtcggcagtgggctccaagcatgatgtcgtctgcatcggcagcggcaatggcacaatccgcacgagcaggagcatgcaaatccactgttggcgccacgagatccaaatcgagagcaaaagttcaagcttgtcctcatcgccgtcagcaagttgatatgtttaattttggttggtcctaattcactaggaatctaggtctgcttggtttttggtttggttccaatgaaacgaggctttcagatctacgagcttggttctgttgatgggtacaatatttcaaattgatgtgtacaaaaattttgtgcaagactttgtgatttgtcgaatgtttgtgttgaatagtcacacattggttgtggaagtgcaaaggacctaagatataagtgggggagcccctcacctcaatggctagcttttggggtgggaaaggccctttacgatcctacagtttgatctgttatgcaattgaaaaattattgttggcagccacaatcttcgatttttctttgaagcgaaagatttttgatgggtcactggtgtattgactcgcgagctaaacgagctagctcgagctgccaaccgagccgagctagctcggtatccacccctaaatgtcataggcagagtaggaaattgacggatgtaagtaagcaaacagacggatgtaaagcagtaagcaagcatcagatccataataataaactttggcccacaccatacatgagaatgagatgtagaaatctccaaaagatagataacgatgagcaagtctctagatgagtttacctttggcgtggaggagggagagctgttaggggggtgcgtggcgatggcggatgagtctggagtagaggaggaagaaggatcaacgtcctctgttcctcccactcccactcctagtgggccaacgtcaccaataggccgtgctgggctagactcaactgtaagccggcccgatgaacaagggcgatgaggaatcttctggaaggtgtggtgccactccggcagtcgcagcctcctcaacatgggaatggcgacagttgggttgaggaggctagaggt

SEQ ID NO: 66000 - DNA, 2219 bp, Oryza sativa
agcctcctcaactcaattgccgacattcccatgttgaggaggctgccactgccggagtggcaccgcaccttccaaaagattcctcatcgcccttgttcatcgggccggcttacagttgagcccagcatggcccattggtgacgttggcccactaggagtgggagtggtagtgggaggaacagaggacgctgatccttcttcctccacggcggcgagggccgaggaggcgaggatggacggccatcgatgaagaacaaaaacctccagcctcctcaattcaactgccgccattcccatgttgaggaggctgcgactgccggagtggcaccgcaccttccagaagattcctcatcgcccttgttcatcgggccggcttacagttgagtctagcccagcatagcccattggtgacgttggctcactaggagtgggagtgggaggaacagaggacgctgatccttcttcctccttcactccagactcctccaccaccgccgcgcaccccccaacaactctccctccacgccaaaggtaaacttatctggagacttgctcatcgttatctatcttttggagatttctacatctcattctcattctcatgtatggtgtgagctaaagtttattattatggatctgatgtttgcttactgctttgcatccgtcaatttcctactctgcctattatattatacaatattagacagtagagcgagagactcaaaccaactctgaatctaaagaaaaacaatagagagctggttgtgtcaataatatgaaaaatcttttcttgctacatagaactacctttggtttttgggtaccactgtacatctagtataaaaggagctctgagatatttatgattttagtgtactaacatcagtaactaaaagaggtgatgatgaatttctacgcttaaggcccttcgctctgaatatgagagcttttattttagggagattaaatactctccctaaacagtaaaccctcaaacctagtttaaatctctaatctttctttggtctaaaatgattaatctctcaaaaattactgctgtgaggtaagtcttttccttttccatgtccaaatcaatctaggctatgttctgctattgttcaatctccactgctaagtaacctatgttatgctctcaaagtggattgatattctaacactgactagctagtatcatcgaaagttgtattacaaattctcacttttagttatgctgtgatttaaaagacaaacactagtttagtcctgaggctacatcagcaaaccatatatatcttcagttcaaattcgtatatcccatatagctctgtgccttggctaaggtcaactgacatcagtgtggcaccacttcttcctgttgctgtaacattctcttcttcagtttctgcagcaaccggtgcaaactaaagatggcgggattcggcagcctggcacccaagaccaagaacatagtggtggctggaggactctctgctttcgtccttggcgtgtattactacaccatgagagcggtgggaggcacagatgagctgcaggtcgccattgataagtttgaaggcatgaagaaaaaggatgctgggaactcatccgccgcgggatcctaagaacagggtttagaattggctccatatccgcctctatactgaactgtggttttgtacaataatggctcaatactaggttgtgcttatgctttgacgttaagctggaataatttttgactgaatcgactatattaaaacctccccggagttgctgggctgagagcgttttggactggtgctcgcacgcggcgctatccatttttattcacatgacattaagaaagagctttctgtgattgaactttaactaggttttttttgccttttgtatttagtattgtttcaatggtagttatcctctggaaatagctgtttcaagtatatttagctatgcctttttcttcacggtgttgatttggtgagtagagaatctgctatgtttgctactaatattatagttctgcccttcaatgaaatgtaaacaatgtgaattgaggttaatgtacgatagttggcatgtgactaggtgagattttctttgtgtatcctgagatatctacaatacatcaataaattgtgcattgtacacatggtcttcagattgacattatatttttaaactacattatggttacttttatgttgttggggtgcagg

SEQ ID NO: 66001 - DNA, 570 bp, Oryza sativa
ttctcaagagatgcatcatgcaagaactgggttgtttcttgatgataaataagaacaacgttctgaaggccagagggacaaggcttaggtttcatcgagggtgatgaggatcgttcagtttcatgaagatgggcaataggttctgaaaaaatgaacgaagatacaaacatcacctcctcgaacggctcatgcttgggatgagccttgattttgctggaataattcagggtgtttccataatctttataaagatcatccctgaattgtaatggaatttccggaggatgaatttcttcttcttccggctgcagcaactggaatgaggattcggcagttgagtcgggttccgactccatgtgcagaggttcctcatggataatctcgacctccgggatggcttcgctttggccgaaagaatcgttctctaagatcaaatctaagagttctcttccttcggcagttgtcttgtgtgcgaacgattctccagcagaaatatcgagatttgcggcagactccttgtctaacgcgtaccgaaaatgttgtaacaacacatggtcgggtaatgagaag

SEQ ID NO: 66002 - DNA, 14792 bp, Oryza sativa
tctatattaagtataaaaaggaggagttctccgatttcaatcctaccggtgaaatcaacagttgaaatcttaccgtccatccgcggcactttcagcctccctaccgtccaccgcaaagacagaagtggctggctaagtctttgcgatgcgacggtgaaatcaccgaatccccatccgtaccaagtggacgcacgattccatcgcaataacaccgtgcgcttacctcgccgccgcaagctccgctccgccataagagcaatggtctttattagcggtctctcttcattgtcatgcaagtatatttggtgacgtggaagagagagaaagaaggaaagagaaagatagttgctatggagacgtggaagagagagaaagaaggaaatgtctctctttattgtcatgtaagtatatttggtgacgtggaagagagagaaagaaggaaagagaaagataattgctatggtgacgtggaagagagagattgaaggaaagagaaagatagttgctacgcatgacaacgacatagagtcgactcttagcatttattaggaaattttttgttgcattgagtctaataaaggaaagatgactagtaagaaagtattttggcacattaatggttagagactgtattgtcttaactattgtaacgcgatagtctctaattaacgtatcggtctctacctttgtacttgccgtaacgccgctgccgcgacctcccggatgatgcctctagagtgcagctgcgagcaaatcgactccccggccaccgcttgaacaccgggacatctcctcacagcacccttgttgacccgtcgtccatatcctctctagcggcctcctccaacaagcccaggtgtgcttgatctgcgtgttaacactctgggattttggtgtattgtttgatattgttcaactcaggaacacctacgctttctcaagcaaccaattataattcagctttgttactgcttccagtatcattcattgcaagcagttgtccaccaataatcccaaagtaggttgtccttctcccattgtgccatcctcgatttctgtttccatcggccgccctgcgatatgtaccggaggtgtacttgctatagcagtgtgctggtgtccagttgatgcacccaaggaggctcaaatccaagttgtgatgtggcgatgatgagcaagtcagacaagaacctatatcaggttagtcttctcgagaatttgcatatcaacttttaacattttgcttcaccttgtgaatttgatgtgtgattgagcttccagggtcatcagctgatatactacggctcccatcggttgccattttacctaaaatggcttatttggcttattagaaaattaaaattagtttataagtaaaacttttgtagatttattcgtagcgacttaaaagccaaaattaacaaaaattacgttaaaagcatttcaaaatcaacttcaaaattaaattcaaaaattcaaattttggcttattctttggctgtttaggccaaacgatagggctgtacataatgatattctgcggactaaagacatgatattctttcatcatacaattttttgagcttcatgtatttggctaatatttcttatggaacacacatgttgatttcagtctttcaaatttgttctgccctttttggtatggaatttctgttaccttggaacacctggtatgttctttcctatatactatatggcaccttaaagtgctacttattaaacagcgcgtgataaacactgcacgtccccacccatagtgtaactgcactccacccacactgatcccggctcaacacatccccaaattttggcagtcaaaattttactacttagacaaacacaaaaactcaccatataagacagcgtcgtttagtatttttttaactaatcatatatacatgcagttaacaaatcttgaacaacgggatatgttagggcagtaattttttaaccgaaagcaagttaggttcctttttttttcatcgaatgatgacatgatctagagttatttttttttactagacatgccattaaattattaatttttgattctttgtttccagttttttgaaataattgttttagaataattctaggaactatcatttttgtacataatgctgaacgagtaattttttaactgacagtaatatagcttctcactcacccaacggtgtcagtatatagagttatttttttactcgatacgtcatgaattttatttttttgttgaccgatgcaattagtaatttatttactcatagaaccatatgtatatatacagatgcggtccaaccttaccgtgtgtatgaaccacacacttttccatctctctccgtttcttcaggatctgagcagaccgggcgtccacccgatgattgtgttatgtatcgagttactgtagttgccaattgttgtcatttctcttttgtggtctcactgagtcaagtgtatgtctagacctggtgagtgtgagtcgcgacgtgccgtgctggtctggcggacgcgtcgggtgtgtgtttgacttgtacatataaaaagggaactctcctgtctgagagggcatcgaaattgaaatagaaaaatcactaccaactccttcccaaattgctctgttctctctctcaatcccaaatccttctgagaactctagatcaaatcctggcgagacgccacggaaaacctcggttcgtgacaatttggtatcagagcctaggtctcgctagcgaggaagaagggtcccaatctcatggagaggatggccgcggcggaaactgagctgggggatctgaaccagagggtggtggatctcacaagcaacctcaacaacatccttggatcgctcaccaagctggagacatggatttcgacggttgatgcgggaatccaaggcttgaacaaggtggtggaggagatcttggcaagggtgacgaagctggagagctcaccagcgacggcgacgttcgtggcgacctaaatgcctgtagggcccgacaatgtcgaggagcaccaaggtgatgcatccaaagcccttgcggctcaggagcgacccctggtcaagggtaagtcccgattgccgattttccccattaatttcgaattgggtgaaacctctgtgcagagttaatttagcagtcggtccaatagccctagattgccaaaaacagatttcccaaagtttgatggagataacccaaaattgtggaagaagaactctgaaaagtactttgatatgtaccaagttccctatgaaagttgggcaaattttgctactctgcatattgtggggaatgctgctctgtggctgcaaaccttgaggctctgcatagcgttgagacttggccagaactttgtgtagtagttcatagtaaatttgggaaggataaatactaggagcatttagaggagttagagagtcttaggcaaaccagtggagttaaggattactatagcaaatttgaggaatttatgcatttgaggataaataccaggagcattattgatgtgaattatttgctctatacttctaaaaatacaggctcaaacaatgttcttctagtacattgcctagacaaacttatactacattccgctacatttctccctctgcacacatgagtagctgattcgacctattttcttttgatgtgtatttgtatccgaccatatcatgcaagtcaggctattccagcgcagctatgaggtgagtttgactcgagcttgttcttaggctatttcccaactctaggttgggtgaaagacttgtttggtgcgagatggaagtaacactaatctttggctaagaataagattgagttggacttatcacatggtcacgctagatgagcttggtctagcttgggaataggcagttttcaatgtgacaatgttgtgtaggttgtttttttttataataaaaatgggttatgaggtagaacctcaaaacaaggatgacaagttgaggcagtttatgtaattttgcgataaataaaaagaacatgggagggactaaaaaaacgtagtggcagagtcgtaaataaattgagaatagagggaacagagaaaatgggtattatactgtctacatgggaaaccgaattatactactacaagtccaacaagaggtgaccgtctctgatgagaataatgagagattgagatctccccttcgcctcccttcccccgttaataagtagtaggagtaattttcatattttattctattagggaagtagtagtacgaaaataaactcgatcgagaggttttaatctgtcctccctctcaccgacctcgtctcctcttcccccgtcgttgccactgccgcctctagattaaagcagagctatagccgggaggaacgcgcgccaccatgtgcttggcaacgtcgccatcctcatcgaacacgtcataagacggtggcggtcttcgcatcttgatcgtcggaagatgagttattatatttgtcttattggattttgcagcggctggttttcttcaataaaatcaagatgagaaagatgagcttggtgcaaaactgtgtcgctgagaaaggtatgagcttgtaaccagatgagcttggttgtatgagcgtggtcaaagtttaatttttcaaccttttcttttaaatcgctaagaacacgtacataaaagttttattcataaattattcttcgtttgcaaatatgttgcttcgaaacaatggggccgtacatcatgtgttattaacaacttaacatacaaaaacgagctgggaatagtttgcttgcccccagatttcaggagcaacagaaaagctgagattaagaatagggggggggggggggggggatgctgcacattcaatgtacaagtatcatcactcagtttctggaccttgaatgtccatctgaacaactggtccatgtaagaatttttttatccactaccagcccatttcgttgaggaaaaagtccactttgactctcttaaaagtcatccgaatctaatccgtgaccctcaaccgtaaaaccggataggatgactccctgaactattcaaactagtgcaatttgactccctcaacggttttggatgacggttttactgacgtggcggtgttgacccggtcttcatcccacgtggcgcttatgtggcattacaattaaaaatattttgtggaacccacgtgtcatcctttctctctccaacccttcttcctcccctctctctcccttctctctcttttctcctgcagccgcacccgctgaacatgccggtgcagttgaacccgtacgccacctcgccggtgccggacaccgcgatgagcccgatgaacccttcgtccagccgttccttgacgcagtagtcgatggcctcctgcagcccggcggcgacgtcgcgcgccagcgtggagcgtatgatggcgttgccttccccgatccgatcaacggcgagtcgccaatgcgcccggtcatcttgttcgtcagcccgcccgtggacatggccgccgcggtgtggccgtttgagtccaccactgcgcaacccaccgtctccggcgcgggatacggcaatcaaactgcttgtaccaattaatcacaggatgtcacggttagatgttagcaattttcataggcgaattggtaacatgagtcaatgcgctgatcgatgaaccaagatgctgttggcctccttggctcctcggtgatgaagtagctattggctccctctcgttcgtcccaccctggcgcggcaccatcgtgggggacgcccctgccttctccggtgagctgaggccgtcgccgccgaagccgccgctcgacccgctcaagttccttcctctgcgccggccctcaccctgccgccgccgccgctccagattccgcaccgaatctggaggaagagaaacatacagagaagggagagggggggggggttaagaggatagatagaggatgacatgtgggcctcgtaatttttttttcatgtgaatgacgaatggagcccatatagttttttattttaatgcatataagcgtcacatcaacaatacagatcaggtcaacatcgtcacgtcagcaaaaccgctgagggagtcaaattgcactggtttgaatagttcggagagtcatcctatccggttttacggttgagggttacggattagattcgggtcacttttaagggaatcaaagtggacttattcctttcgttgatctctctacttcgaccaagaacattgggcctggcccatcaagaacaattttagtaggccctgaaaaattgatagcaaatccattcccctgccaatctggcatcgcagtgctatcaaacaaatagtactactttatcctcctcatttcagtttgtcaagctaaatcatacactgtcactaacacactgacattaagttgggcgctccttgaaaagtgaacctttattattttcccttatttcagtaacaactcatgctgcagaatttcttgcagttgtttcttgtgaggtgtagcagtaatgtcactcttctgaagaatgacagtttgtaactacagaaagtaattaatcagatgctgcagaatttcctgcattgtttcttgtggtgtgtaggagtagtatcaattttctgaagattggcagtttgcaagttcagatttcagaagttaaccgatgctagtagtactccctgtggttgccaacaagttcacagctgctactcaccatcctgacactgcaattcaacttcaatactactccctccatctaaaaaaaagacaaaacctggtttccgtacccaatgtttgaccgttcgtcttatttgaaaaaattatgaaaaaaattaaaaagacaagtcacgcacaaagtattaatcatgttttatcatctaacaataataaacatacgaattataaaaaaatttcatataagacgaacagtcaaagttggacacgcaaacccagagtttgccttttttgggatggagggagtacaattcaagtactgagatttagatagatgttccatggacataaatatatgctccaacctgagagtcatttctgatcaactgtctgtctcgctctcacctcccacacagacaggaacatgaaatgaatgcaatgcagcatgacatccttttctcacatcatcacacccctaaccaccaaaacatcaagatcaaaggacaacaaaattacacaaagaccctgcatgccctcttttgcagatgactactcctagatgagacagatagtaaagccaattaaccatatactagtacttctgtatttctgttgtcctttctgtatttctgtatttttgttgtcctttgatcttgatgtcttggtttttttttgtatttaatcctagaagaaattgtgagcgtgttgaaaattaaacacgggacctcagagttagaaaccacataccccttaccatttcactatcaagtgaatctcagtactaatataaatcacagaagggttttgtctcaggtggctcctacctaagtgatcatctggttgtgcatctcaccattcacatgtctctagctttgcatagaaaagggtttgattttttggggatccacaataattggttgcctagagacattctaccaaacaatgcatacatacccctatatcctccttccacctcagttagtgggagggacatggagatcatcacaaatattataatcaaaattgcaccattaattagtgtgtgagtgctactaaaagactactactacctaagtgtgtacagatgtgggctcaggaattatgaggattatgaccagcattagggagacatatataatcaactacatatgtaccttgatagggtataattcatgaggtatagctgaaattttatacatttgtttgtacatgcacatcatggacaagtatgtgtacttaatgaggattgaatattatgatatagactgaaaatgaagccatatctacatattgtacaaagaaaaatcagcaacatcaactcgcccacatataactacataataaatcaaagattctagacaaatataaatacataagatggatgggaagcaacaattattgagctgcatgaaaattaagccaaacattattcaaatctatccgtggaagttgaccgtttgatatgactttttgaaacaagctagggaatttcatgcatgactagggatcaaactcatcatatgtaaaaaagaaaggacgagagaaaacaagtaaactatagtaaacgtcccatgtctaaaaaggataagcattattttttctcatggtctactgaccataagtccatgatatggtaacaaaattcaatcgattaccaggaatttgttgttatccgtctctttaaacatgtgttgagcttggagcacattcataggtgtgtgtgctgtgtatatgtatgcacttgtggagattatgggtaccccatacccacacggcatagttatccgactagttataggggataacttatatatatggaatatgtaacagattatgacttgggtattacgtttccttgtatattacggaacggcctaaagtcctggtttgataagattgtaaagtagatctaggaaaccgatactgtattggataaggtttctatcttgtaatcctgccccccatcctatataaggtgggcaggaggccctctagaaggcatgagacaactagatcgtcagatctataattcacccggcggattcaaatccccaaacaggagtagggtattacctctcattgagagggcctgaacctgtctaaatcctttgtctccgcatccatccacttttaggtctcgtgtgctacccccttttattattgccgaattcatgtttcgacagttggcgcgccagataggggtgcgctgagttttctattgacaagtgtgatggaatatatcatcgccgctgttggcgccatcttctgatcaaatcaatcttcgaccccacgagtttgtcgctccaatctgcttttattatttggttgattcctaattgctgattgatgtacgtgttgttatttctgattttcatgttccaacgatatggctggatctcgcaatgcgaattcgtcgagatgctacggcgcggctgctcattgtgcatgcagagccgcatgttgggacaccgtgctacagatcgcgtcgtgcaccctcccggcagcccttaaaccacgtctgcaaatcacctgatctggatcattggtgttaaccatgattttgtttgcatacgtactactcccggagctgcacagtccaaacatgggaccgatcttcatgcatacatacgtgcatcaattaatatccataatcatctacacttttttatttgtttctgctactaatctctattcgatctgtggtttcttattttgcatgtacctggctgccccgagtctgattctctccgacttggattcgacccggactcggacctgcgatctatgtgcaggaccacggatcagtctaacgatgtgcatgtgtgaatgcatctaccacgggagattaattggctaattaacaatatatgcatgtggcatatatgcgttggtatgtgcagacatatatccgcaagattagttttcttgattctaattagagatttcttctgtctctttacatgtaccgccggccgccttcgtcgctgctgactggtttcttcgcctccacggtcggtgtgtgccgctaccattgctgatggagataacatcttcaccgactggcctgctccgtgctgctgactagtgtctcgtctatacggttggttggtcacaccaccgttcatgggagtcatcgtcttcaccgaccggttggccttcgccgccgccgactggtggttccgcctgcacggctggcctattatgccgccgctgttgggagtctacgacttcaccgccggcctgcctccgtcgccgccgactggtgtcctcgcctatacggttggttggtcacaccaccgttcatgggcgtccacgtcttcaccgaccggctggccttcgccaccgccgactggtgttttcgcctgcacggctggcctattatgccgccgctgttgggcatctacgacttcaccaccggcctgccttcgccgtcgccgactggtgtctccgcctacacggctggcctattatgccgccgttgttgggcatccacgtcttcaccgaccggcttgccttcgttgccgccgactggtgtttccgcctgcacggctggcctattatatgctgccgttgttgggcgtccttcgactattgtcctcacctatacggttggttggtcacaccaccgtacatgggcgtctacgtcttcaccgaccggctggccttcgccgccgccgactggtgtttctgcttgcacggctggcctattatgccgccgttgttgggcgtctacgactttatcaccggcctgcctctgccgccactgactggtgttttcgcctatacggttggcggacttcgccaccgttaatgggcttcatcgtctacaccactggcttggttccactggcgccgactggtgtttttgtcaccattgatggactacttcgttcccacatcggctacttttgctgtcaccgagggaatacgacaaagctaagtcatcatttattttattctttatataatattttgccttttcctttgcctcactacatcaactggttcgccgttgactagtgagtcgagggctacagatgttatatcatattttttaaacaattttcataatatttatcttgattgcttgcgacatattctgagtacaaaagtgcctatcgagttatggagttccatcttcctatgctttccgtttggtttgccaatggatagttgcctttgggccgattcctagcacccgggggcttgttggatggaccgaataatgcaaggtgctaagtattattcggaataaatcaaaagcatagagataagataatttattttctgctcttaataattgcaaaagtacccgagtagtaaactccgacccgtgaaactttgttccattaatgacgaactcatgtcactcatatgcatgtttgggaagtgcttaggccgactcccggtgcttggtggctatgactagtcgggcagagtgtttaaacgtaatgagtcatctgctcggggaaatcaaaattgacaagagaaaaaatacatatttataaatattttaaaatacttgaatttttctcgagtattatatttatatcagatactactcatcctatatatttgttctgcaggatccagatccatatatgcataaaagggattcatggctttaagcttatctcttacgctctaggaatggatcagtcagaacatcaccaccggcttgcctcgtccgccgccgactggtgtttccgcctgcacggctggcctattatgtcaccgttgttgggcgtctacgtcttcaccgaccggccgcctcatccgccgccaactagtgttgattggccttatcgtcttcatcgccggtcgtctcgtttgctgctgactagtgccctcgcctctacgtctggtttatacagctaccactactgatggacatcatcgtctttcgtcgccgactggttatgccgccgccgaccggtgcttttatcttcacaactacgcgtcttcactaccggtttgcttctgttgccaccgactcgtgttcacttcatcacggctatgcaattttgtcaccatggtggagcaacttcatttttattatcttcggcatcgacaaactctattgcctctacttcaccaaccatgacgactacaagagtttcgacacctcggcatacgtcaccaaatatgatgccgtgttattttattacaacaagtggtgttccaatcttcaatatttatcttcactcaagcaatgactactcgacgacaagaagttacagttctcgactctatattcagttgtttcccaactaaccaaagagtcgggggctacacaaatacaagactcttaaaattcgacaagctgaagcaatcaattaatcagccaacgagtcaattccaggagtcattatcttcgtctttgctttagagcagagttatcaaccaatcagctcagtttcgacgagttggacaacatcatctactttcctccaagtgaagcatctgcaacagatataacaccaatttgatggattattgtcactgacatcatcaccagcacctctgcttcatcggccttgacatcaactctgttgctaatggatgactatgtcttcgccgacttattatttcactttcacggttgctatcgactggatcaccgacatcgttatcttcatcaacatcctgtcaagcctcttcaacatagcccactctactgctattgatgggcaacttcgtcattatatttgatcatctatgattgctgcttatcatcattactgtcggttgcgtttgtcgtcgccgattattttcttcatcttcatgattggtggatttcgtcatcgcttttgatgcgtgtctacatcttcaccgtcggcttgctttcgtcaccaccgaccggtatcctcgccttcatggatggcttattatgtcgccactaatgggcatcttcatcttcttcaccagctgcatcgtctgtcaccgactaattatttcgctgccatggctacacaactttatcgctgggcgccttcatattcattgctggctgacctgactgttgccgactggtttcttcgcctccacggctatgcaacttcatcacttttgattggtatcactatcttcactactaacaatatttttgccacctctggtgggcaatattatctctatattggtcgtcttgtctctatgccaactgcgtcagctaccatcaatggacaattgtgactacgacagaaggacaagctatatactcagaggcttactacctcaaacaccagtatcataccttcaatttggacttgttccggatacatgcaacatgaatttgataatcatgggtctattttctatgctcaaagactggactatttattattccccgtatgggttatcaactgaatacttgcgccagtcggaattcaattgttatatctattttggagtatcccataaaggataatcactcagatcagaagctattcatatgagctacacttggtctatatcacccgaaagatttattactcgggagcatgttacatgcgtcatcctttaaagggtgtcgaatgcatattttttggcctaggcctaatatgtctgcagcccatattttcaggtgtggcctgtcacgttcttttagggacttaggcatctttttgcttaggcaaaagtgcgcgtgattatgtgcccaataccttaaaattcttttataccgcagttacttaactttttaggagttggtacaatacattttaaaaggtgccaaacagtaatgctttatatagctccccgctgacttttttatataagtcaaggcgttgtttgggttcataaagcaattgattggatacaatatcattgctttttgccacgtaagtgtgcacttttattgaccaatattatggcttaggctgattatatattttggtcattttccacgcggttggtaaatcctttatgagtttatttactcggattttataccacatatgccatatatttccaggtgtggtggaaccatgtgtcttctagggacttaagcacatctgttaaaacagtgtgcgcatgatgtatgcccaatactttggaaatttctttattcacaacatacaagcttctttatagctggtttgctatgtgaattttcaatgatgtagtcaactttaggttacactcatcatattttacaaagcagtcggtatatcactcggatcatgttattcagggattcacaccgcatatgctacatattaatatcaagtcacttggttgactataattatcgaagccactcggttggttggattatttattccttgactatatgcttagtttgttcaattaaccacatagtcgagggctacacctattaggtgcatctagtcgatgcacctgactttatttttcagccctccatagtctttagatttggtaaaagtactcgggagaccatggcaaagatgattgaagcactcggctgtggagtaatctagttcgaaagaagattatcttttcgactgtgaaggtctcaggggctactgtggagattatgggtaccccatacccacacggcatggttatccgactagttataggggataacttatatatatggaatatgtaacagattatgacttgggtattatgtttccttgtatattacagaacggcctaaagtcctggtttgataagattgtaaagtagatttaggaaaccaataccgtattggataaggtttctatcttgtaatcctgccccccatcctatataaggtaggcaggaggccctctagggtgcatgagacaactagatcgtcagatctataattcacccggctgattcaaatccccaaacaggagtagggtattacctctcattgagagggtctgaacctgtctaaatcctttgtctccgcatccatccacttttaggtctcgtgcgctaccctcttttattattgccgaattcatgtttcgacagcactgttcgtgtaaaaaaaaataaataaagaaataaagattttctgttctgaaagtatgtactacaattaaaagattctacaattaagtagtacaacattattgctggtcgcatacatattgatcccattcacgcatgtggcgatatctaactagaggcaggtagac

SEQ ID NO: 66003 - DNA, 14253 bp, Oryza sativa
agtacgatttttctgttagctcatatgatgcaaaggcctcctccagcttttggaaataagagatttccatgagatgacctaaaaactgttggaaagtcgtctgtctttagggacaaataatcattttggtatattttcataaaaacaacatacttcaggaaccaatagcaactttcacacaaaacattccttataactgaacagaaagatcaactagagaaggccataaaaaattctttgacaaataaactggtcggcagtgagcaggatatagtgggatagtccacataagacattaagacataactcaatggatagtatgtctaactcattgttggatggagacctcggcaagtcggcatcagtttatttggctagcttaggtgacaagaaagcaagaaataagaggtgtacttgtgcagatggaacaaggaatagaaacaagcgggaaccacaaaagctaagttaggaaggatattaattaaggaggcttctagacagcgtaccaacaaaaaacctattatccacaagtaataactaataaccgcagtgctttcaaaatggaatcaagcacccatacaataatcaatatcttatctagaaataaattcaatcatctacaaccagttagaactaaatctgggtaaaaatatgcaagttatagcattttgtacctaattagttgaagggtacgccacagaaaacattgtgctcagttcctatataaacataatagaaaccaagtaccaacaccgtatgactgattggctattttactagtgagtcctacttcatgaagacaatttataacctgcatttccaattgaggatcagattttggagttacctcatcctcatgagatcgcgaccctttgcgaataatggcggttgtttcagtatggtaaggatatggatatatccacaattcatttacagttatgccatagcctatttcctgtagactatctttatcccatgaatttctcgatttgtcatggcatgcttgtattaaattaccatgaccagaccaaatatcgtcaatccaaaggtacaaagaactacagactgaactactaactactacctatcatgagcttactacctccacaccaaatgaccatgtgccaatacatgaaaaagaaaggaaaacattcagagaaacagatgaaggaaggtttgaacatgcagttcatcatctcatttgttaggacatcacaaattcttcagaactacaaggagctccagtcaactatggttttttggtacatacagaacattttttttgctgccacattattaatggctacgtacttgaataggcctagcatgagctattgtaagtttcttcctttggttgttctcccttcatttagcgcatctgccagtggataatcgaaaatctacacattacatatccccgctccccaccctcccaaacaatacacccatagaattcccattgtttttctgaaaaaaaaaacataaaactcccattgtgaattgcaaaatccactaatcttgtgattagtttacatttgtcctatggaacatgatgtagttgttgatgacagagtataagacgcctactgccccacatgtattttattcgtcaacactattgcccacaccaccaaaaatctcggatccccacacttcctgtaagaaaaataaatgcaaaaatgtataaatgtttcagagaggtcctagctagcatcgacgcattgattatggatggcagccaatgcaatatcattctcccggactacatcaaaatccaccaaccaacgaagcatatacgtgcagcatggcagcaaaccttcccatcgatcgcctagattcacgatcctgcaatttccgggcattcccaccccgtgacagatcgaaccacgagctacgcccccaccacccccacgccattccaaagcactcatcgcccacagggcgcgcgcgaacccgggatcacctgctgccggtgcgagaggagctccgcggaatcgtcggagtcgtggtcggcgaagtcgtagtcggcgtccccgtcgtcgctcccgccgagcccggcctccccgccgctgtagaagtcgtcgtcggcggagtcgttcgcgtcgagcatgtcgtcctcggagtccatcgccgcccctcccccgccgccgccgccgacgccgcccccgctcgccgcgcgccggagccccaggagcagcgcggatcgggcggatcggagcggcgcccaccacgaggaggaagcaatcgggcccgggtggtgaggcgcccgagcggattcgggccgggggggcgaggcgagaggagggggtgggatgcgaggcgaggcgaggcgagaaaagggagaggaaggaatagggtggaaatggggagaggatcgatggattagtaggtcggattcgcttgctcggggctgcacaggaaggaagctagacacgaatgcaagctatttccctctcctttttccctctcgtctctttgcaccttttttttcgtccccttgtaatagtgttttcgtgtgtttttgttaaaaaagcttttctggcttgttttgtttagtactagctgcttttgctttcctacaaccgatggtttcctaccagctttgagtgtaagctagctggttagcctaggcttcagattcaaaagcatcgtgcacacagtatcaacgacgaaaccagctaactcgatgcgtgctaacttggctgacatatgggtcacatgactaggggggccacgtatcagccattcacaccagaagacagtatgtcagtggagtcttgatcattaaaaatctggtatgagttgagtttaatgaatatgatagaaatcacaaaatgtatactcgtagtgacaaacctaataaatttatcttaagtacactatgcataggatggatatgactattatcatatacacttgtaatacgagacatttaaagagtccttaatataatatcatatgtagttacggggctggaaatttttccaataaaccaaacaaaatgtatatgggtgatcgaagatgttattgaatgttttagtaacactaggcaccttgcaccttgtgcgcaagcacgaccacctgtctaagggcaccaatcctttgggccatcaatgatcatgcatgtgcggaatgaaacaaaatgttccatgttgcttgtaaagttgcaccaatgtacacgtagacatcaataattacgcacaaatgtgtttccaattaatgaaatactattaattatttgagtaaatacatatcttgtattaaagaaaataactcttacattattgatatggtgatgctatcctatcctatgtatattactatatagttggagcatacttaatatagttattactataaatttaacatgcattgagccatatcatccataaacaagagttgttggatcatgcacatacctttttttgtgagaaagagagtacttcattgatagttaacaaaaccttgtagtaggtaggaacatgctcccgccataacgcacaatgcttcgttctgctagccaattgtgctaactcatatgctaccttgttgcatcctctttcggtacgaggaatcttcacctttgatagcaactcctttgtacattgcacatcaacgataatatggcaccatctggatcggttctcttgatgagactttggttcattaactataaataagcaatttgtttctagcactattgacctatgaacccatttggtggctagagcttaaccttcacgacatgccaatagttccaattcttccgccacactccatgttgcatgtacttccaagatgatatataacaagaatgaatcggagctatcacagataattacgccaatacctgcattgcctaaacttacacaaaaaaacaccatcaacattaatcttagccgaaccatgttatggtaattcccaggagttgcaaccattgcccgatgtcctacttatctttgggttagaggtagtgatttgtattgcacccaaaactcctttgctttattggtcaggttcttgtcccacggtttgcacgaaagggagtcatggtagacttgtaccttgtaaaaacgttgtagacctagccatcacctcttcacctttgccatggacaacatcattacataaataccaagctctacaaaacaataaaaggatatgagttcttgagttagttggaacataacttagaagcataagcagccaatttgtcctggaaaaattaaaagaactttctcatgggatatattatttcctgcgcattgcatgtcacaaagctttcgcctttgtgcatctaaccactgcatgaaaactattcttagatttagatcacatattgtacacttactagatgccactagttgtctgttggtatttcttacgatcacagataaaatctgtaagcgcacggatataccgctgtagcacttcccctacggagtattccaagggtatcgaatccaagggaacatgtatggtcatatcttcctccggttcatccaaggacaccaagcagatgataggccaggatagagaggatttactagtgagaaatagtgtctagggaaagcttaactttaatcataatgcaatacttcatgcactggcaacccgcggttcccagatgtcgctctactacatacccgaacaggagggacttaatgatttcgagggctgtcaccacctctacacctacctcaaacatactgtgggatacgcagcaattactggataacaattacctaaacaccacgtctaagcaattaatatctactttagtgtttataactcaccaaagcaatcactatattttaacaataatcccatatgctatttaggaactaaccaagagataattctcacaagataaatctaaattactcaagcagaatattatattgaattcagagtaataaacagaataaaagaaataggagaagattaccgacaactctggaattctttcgacttcttctactctactctcttcctattctagtatataatatagtaaaatagagcttctcataattcagctcaagcttggaggtgtgtgagtaaagtgagggagtgatgtctttatatagaggtaggtataacggttggcaaagggaaaatgtccgaagtgccctccaaccgtcatcagggatgcatctgggacgtccacgccaaaccccacatccaacggtggaggtggtggttcggccgaaccagggggttcgcccgaacctgggctgggtcctcctggccaggctcttggcccatcttccccctggacctcctctatctattcttcggtgttttgggctgattctctggtatttctatgaagttcacaacccatccttgtatgaatacatatcccttctcactttagtatgattttccttccaactttaggtttcatcacccgcatacaaatacacaccaacacttgtggaatatgtgagattaagcccctttcactatgttggatgttctattatctgaactttatgtaggtgttggcggtatagaatcgacatttaatagccgccaacattgtatttgaaatttattagcttgagtaggaagattgtctcgtattaagtgccaagtgaacactggggcacatttgttgtccatatcatggactaacaatgtctactcctatcacttgcgttgttagaaggacttatctcttttagatctctttcagctagatatcatttttctcatagcgccaggcaaaaaaatctttgtaggcattgcgcaccgaaagataccatttttctcatagtgtcaggcaacaaaatcttcagacatttagggtaagcttgattttttggatttcatcagcatcgagagtgaaaattatgtgccgaatcaaagcttcatcccattccttttatctgcagccatgagttgatatacccactttaatcttgatatcttctttcttgcctgtcacctcaatccaacacccttgggattcactgatctcaccaaatccacaccttggcaccatcacttatcctccatattagtcatttttttcaataactcaaagccatatttaatgctcttccaagtaactggagatgttgaattaaaaactgtatcaatgatgtcaccagaaggatataaaaatttgagtgcaaagactcttaggaaaaactaataggcgccaggactgctgttctaataacgcttggttgaatagtttcatatcatgaaaacccattccaccttaatttttagggagcatcatgtggctccaatatcataagttcacaaccatacatatgttgaccatccattcattattaattgatagaacaaataatctacatcgaccatttcattgtctcaacttaacctagctcttcaagtgttcttaggatgatttctacgttaccgcaacaactcacaaaggtatgcactggtatgttataagattccttctataaaatatcttatgttgtatgtgcttttatggaaagaaattatatattactcatcgaagaaccctcaagtttatcctactttgccattaggcttctctcatgcggctggtcaatttttcttcatgtgttagtacatcacttatgcaattgtttttattgtcgacttacttaccttggccattatatgtcatacctacaatggcattgtggcaaatgagttatccttatgtaagcattaaacactttcaatacatcgagaacaccataggctcatagccgacgaggtcgaagattcattctttgctacacaccaaacttgttagacgccttgtctgcatggatggcctcaactaattgtcagacttataaaacagttgtgggcaaatagtgtgacagagactttcgacgtggagactgcttgaaggaagaactagagaataacaacatgagttaaaatagactagttgcattggttttttttataggtaacatatgtttggagactgatatgatacaggtgctcgggctatgttttccaagcgtttcgagcacgaagactacttgattgttccagagtattggcaagtgatttaactagatttaacaaattactagtatgtacttatgtatccacaataactttgtaactcaccacacaaatagcatgggcaaattttcaagactggtaaatagctaacaacacatatcttatatgatcacaacaaaaagaatcgtaatgagtggtgaaaaagagaaactacctccgtcctaaaatatagcaacttttagctatgaatctggacacactgttgtccagattcatagctaaaaatgcttacattttgggaccggagggagtattgaacaaatgtgaagacatgcgtttacttccaacttccaaggacaaacgcaaattgcaaaaatgggttattcaatggctctctgaaatgattggttctctagccatacctggtcatcaacaataagagatgatccaagggtattttaaaatatttcaaaaggatgtttttttttgctgcctagtgggtcctcctatcggtgcgacccgatgagcgatggtcacgagcttgcgactcggtgaggaggcatgctttgcagtgaagcccatagccactgaagctcaccagtgatgaaaaacatgagcttaaagatgattttgcatatctttgttaatggtacctctagtctctctctctctctctctctctcccttagttgtcctccagtggtaccggtagacggcaatgcgctagtactccacgaccaatggatagtgctctagggagagtgcaatgtcagaggggcataaatttgggcatggtcaccactgtgagctccatatctttgcatgcctcgaatctaataggctttgtgtcgtgggcttcgacaacttatagcaaccttgaaaacacactaggtggaaaatccaggtaagcaggttatgtagacatgttcagataagctgcaagttattaggctcataaaaagcagaaccccaaaaaaatggctatgagggcaatatttggattggtgctaatttggattctattaatattttgataacttcgacaatactttggtggaatttggattaagaccgattttttcctaggtggtagcaaatctactctgtcaaatttggtagtgcctaggttttgacactatcaacgttttggtagggcttcaaaccaaaccaacattgaatttgttactttatgccttggcctattgaatcgttcttgttgaattcatcccttcaaaattgggccttgttggatggatgaataatgtattatatgattttgtgataatatttaaatttacaaatggataaattaactactctaaagttaaaaggttgttttaggaaaaaaatattctaagcaatttttatatattttttttcaaaaaatttaccatctaggagaacataagccaattatattaagatcgtggaggaattttacataaccttacaaagccaacaagttgcaagcatgcagcctgatgggagccgagcaagacacacctgcaaaatttgttgtgactttattaggggaaagctacaattttacctaagggttgcccccgtcagtcccgtagcacgccatgtccaccagtttttttgtgatggctaacccacttagcgatctgctaacaccatcgaaggtgtttcgctatctgcaaattatcgaagtgactaggctgatggtcgtgtcgagcactgctctactttgttttgccatggcttgccatgcttgggaccaccaattattgatgatatgctatacctatggcccaattgagaaattcagttgtttaatattctcctgaacccgttgggtgtatggatattgggtgaacaagtgtgcacaaatctggcaatgcgacagtcgacacataagggatggtatggacaacttggctagacacaaggttgtgtttgtccgatgttaggtgactgccccttgttgctaagaacacgaagaactttgcatctacgtgggatttttgcttttccgaatgaatttgccacatggagccaatgtttttcccaaggaaaactatccgataagcagatgtaaatgaacactattcattcgaattggacttccgacttagttcgttggtggcattcgatttcaggtcgatatttaccgagaccaccaacaaattggggtactccaacaatgtctgcttagagagaagccgcgggtgtcggcgtgtcgcgcatccattgattattgtgcatcgttgcacccctaatctcctatcccttggaacaaaagagaatatggcagggttgtgcccaaggtaatctataattcacagggggtctaagatcaaattcaatggctctctatgaatgtctgcaactcaaagaatcaataaacatgctgcactatcattctatgatctatcagcacttcattatcagaacatgtcaacacctgttgagcttctattaactaaataatacttactcaaagaatgttccgtggtgcatagatctcgagggtctaatatcgagcacgttaggacacatcctaactccacaaatgaatgcaaatggtgagttggtgaccggaacaaggagtgggaaacgacggtgatgaagatacaagctgtgctcgagcttgacgtgtgcgctaaggctgctagggcgctggatgctgccaaccctgctcgctcgcggagtcacgagcacggccaccgcagtatgaaaagcgccgaagacgcgggcttaagcctgacgagcatggtggccaattgacgaggtgtactggaacgtggtgttttggcttggccggatgctcgatgctgcatacccaacaaatcactaatcaggccccgttcgaatctccaacaaaagttggataaacttttagataaacgtggcacgtttttcaaactattaaacggtgcgttttgtgcgaaaactttctatatgtaagttgttctaaaatatcatattaatttattttttaagtttgtaataattaaaactcaattaatcatatgttattaccatctcaattcatttttcaagtttataataattaaaactcaattaatcacacgtcattaccatctcattttacataaaacatttaattttatttcatcttcatgactcaaacaccacctcagtgttcacccgtgcagcgtgcccagctagggcaaagcagtggaactgaccgcccaggagaatgacgtacgacttcaccagcgccggtggcacgtgcaaaaggcgcaacaagcgcaacaagcgagaggccttccttcgcagccgtggcgcgggggccctgcgacgacaacgacgcggccggtttccgcagccacgagccgctcacccatccgccacgagcgcatctccgtcaacctcccacagggcaatcacagccgcggtgacgtgactcgtgagaggcggcagttgggctggatggccccccgggccacccggtcccaggcggcggcgacacctcaccgcgctgatccacacccaacggacgcggatgcttctctgacgccaacgcgcgcggccggacggaataaacagatcggataatggcggagatgtgttcatccgagcatctgaccgtccgagcccgagccacgtttcctggctctccaaggaccaaggggctttcggcgatgcggttcagcagaaacggccttcctctcgtcggtttcgaagcgcgggcggtgggcccaccactggcccacgcacatctctcccgttgcgtctagacgcttttttttttcatgtgacgaaaaatgaactaataccggataaaatgatacggctacaactcattttgcagcctatctttgttcgtcgattaatgatttctccatttgcaattatagccttttctttttttctctcgttatcagcgacttcgtaagattacggaaatacattacaactttcagtaatttatttccattaaacttcttttgccttttgaatcgagagcacaagatctactttcttttgtggaggaatttcatcgatgtcatctgtgaagtgttgctgtatggattaccatcagctttgagtccgtgtttagttccaaaataattctttaaacttctaacttttttatcacatcaaaacttttctacacacataaacttttaatttcaactagaggtgaaagtggttcggatagtttccgtccgtctggaccatttttcggattcggatagtttcggtcggaactatccggaaattcccggattcggaaacgaattcggatttttttctcggaacgaaaacgaatacagtaagggtactatctgtcggaatcgaaaaacggtcggaactatccggatttttatctgttggaatcggaatacggtcggaactatccggattttttttatatccgcagacattgagcaaatttaaaaaaaaaacgtatatatacataactttttcatacggaatcagatggagacaaactttatatcaacattgtagagctcgatgagatctacaactttcttattgattattttattatttgaggtcatttaaggagtctaaatattcattataatataccatattaatttttacaagatctcagaactgcaattcaaacaacaacatctgatggagatgtgttccatatcaaagttgtagaactcaacgggatctaccactttgtagtttataacagttgtatttgaaagcatttaaagtataaaacaaacattacaagtttcgaagatgtgaagtaaaataaataacatctccaatttatacaatggtaagtaagttatacatctagtaaaaggtcttgagaatagaaaatgataatcatatttgcatatggatctctaagagcaatagccatgaaaatcgattttcacatagggttgtgggatcgtctataaaattgacgatataaatgttggagatgttgaactaaaataataagcgatatcttttccttaatcaagaaactcaatttgaggggttttttatatactggtaaatattcgctatcgtattcgttccgtctcgtattcgctccgtatctgtattcgataatattcgatttcatttccgtatccgagttttcgattccgatttcaattcaaaaaaaataaaaacaaatatgataattccatccgttttcgatccgatttcattcctaatttcaaccaaacacgacctgagttcaggtccgtggtccgtctctcgccgtctcgcggtctcgctcggtttccccctccgaattccgaatttccgatccccacggtggcgtctccctatatctttcgtcaaccaatcaaaaggaaactcgaagcgtatcggcttcatcgccaatcgatgatgcgacgatgctgatctgatcatctgaacccaacaaaatttctccttcaaaacctgcaagctcaccttcttctcccccagctctctcctccgatcatttgcccaaccaccacccagcccgccagccgtgcgagcgcagctttcctatttaagccgcgcctcgctggctcgctgccgctgcccctgcctcttccccgaatgctggtctctcgtcgccccgtcccctggaatctctccctttctaccttggtccgggaccgcggctcctgaaatctctctctgtccctagaaatttctgcgcgcgtcttccgttcttctccccggtttggttggttcccgagcctgtgacctcgggggcggccgaaaggttggattttgtagagcaggctttacttgcatctgggcaaagattggattttttttgtggagcgattttggggtcgttgttttttggtgcttgtttgctgaagtttggattttgggaggagtttggggggggggggggggggtccggtcagatttggtgggagcgaagggcatgacgatcgatttgtccatgcccggaagctccgggctcctggacgacgtaggggggaagaagcacatgaatttcttcagcaaccgctacgtgctcgcgctcacgggcgccgcaggaatcggcgggttcctctttggctacgacacaggtatatggttgcatgtgtgccatttaccttccaacttttgcctgaacgtttcatcaagtgtagctgttctcgatgaatttcccctcgcagtaataagcgacatgtttttggttgctttggacttgttgggttacttcattttcatatgatgaaacattcagatggtgtttggtccaatttgatatttgacagtatgttcaggaagcctatggttagatatcattgatacaaacaaacaaagtttgaagtggaagtctgaaatgagatttatgaatagtggacttattttgttgagttcgtgctatgatctctacagtactgcataaagatagatattaattttagcagcgggatgaaatcaatgcttgcatcattcttattaatttctagcaaaatcttcgagtgtgtgtaacttcacagaattactgtactgtatacttttgccaaaaaaaaaaaagaaaagaagagaagccagtatgataaatttgtgctcttagctaagaaatttattctatcaggtgtcatatctggagcccttttgtatattcgggatgactttccagcagtcagagacaattatttcttacaggttcaatctaatctagtacaaattactggtcattaaccatatggcacgcctgcaccaactgattttggttcttccgtaggagacaatcgttagcatggcattggtaggagccatcattggagcagctggcggcggctggatcaatgatacatacggccgtaggaagtctactcttgtggctgacatgctgtttgcacttggctcacttgttatgtgtgctgctggtggtccttacattctgattcttggaaggcttcttgttggcttgggtgtgggtatagcatcagtcacagcgccagtttacattgctgaagctgctccttcggaaattaggggaggtttggtgtcaactaatgtactcatgattactggtggtcaattcttctcctacctcatcaatcttggctttactgaggtagacattcaacctccatttaattagcatattttattccattattcctacacattagcagttttcagtttaagttcttttaacattcaactataaacggaacaagttcaagctgaaaacattgcagttgaaatttttttattgagcttccacaaaccaggtcttgcactgccatggggaacttaactgttaactgcaactaagtatatatatgagctcgcatcatatctttaatgaaaaaataa

SEQ ID NO: 66004 - DNA, 1161 bp, Oryza sativa
acgagcaaagactaatacataccatgacttcaatgatgccactttgactagaatctgcagaaacttttaatggttcaaacaatcccatccactgctccttgggagcattaaagatcatattagttcctgacatgatccgaatggtacgctcatcaagcaagtacgacaaacactttgctttccattgcttccacaggataaacttgtcgatgatttgtgttttcctgtgttaataatagttttgagtgagttcaaactggagcctgctatggtctcaaaaaaaggacacagatatatatggattaacaattgtaacaatatagaaatttgggggattaagggattacatactgagcagttgctgaggtgcacaatgtacttcctgcactatcaaagctgtcctttttcatgctttttagaagtgtgttcagttctctctcagccaaagaaatacacgatcctgaatccagcttcttctgtagttctttaagtagaatctgtgaattacccgtaaacaaggattcttcacaaaattcatcagagctagtggaatgtccaacatcacgggcattcttggttcgcatcaaactaggtaaattcatatctaaaatcgattgcacatactcttggcacacattgcattcaccactagcagaaatgccatccatatccatctcaacaactgcttgaagtacagcacctaaattctccgcattcgttgttttcagaaaatgcttcacaaccaactctcttgccatcgcaagtgtttttgatcggatatcctcaataccctgcatgacacagggtagaacatcactacatgcaaaatcagaatggatgcagccaagaagcatcttttcagaagcaccttggggaaattcgggcttgaagcgagttgaacgagtgcagcatcgagctcacttgcagactcatcgtactgaccatcgtcacgcaggttcttgaaaacctgaacacaatgcaggaacatgtgttaacatttcagttcttcacaacaacagaaattcttcatgtggtcagtgtctgtccattaaagtaggaaaacccccctcctaagcagcattgagaacgatgaacttccaatctacacggccttcccccgagatgctgagagaatcatggcgtcggagggggcacgacgca

SEQ ID NO: 66005 - DNA, 75109 bp, Oryza sativa
cctagagtgatggtgtcattctctaggcatgtacggaacattatgttagatagggcttctacaactgaacaatggaaagtaatatttgcttcactcgtttcttttctctcctatttttcctttccccatcatactctttctcctaattttctattttatgttcaaatgaaaagttgaaaacaataattttaagatagaatttgggtgttatagcgtaattacctctctatatatatagaatggggaaattatagtataacacataagacttctccaattcagtctaatctagcagctcgatctgtcattatctcctcaagaactagagagaatatcaacttcaattccgtccaaaaccttgggaattccacaataattggcataaattcagatacttttcactctgtattatgctctagataattgttgtgtatgaatgtttggaagtgtgtaggactgcaaactgtaatcctactgtgtatgtatgttgatctgaaagtgtacatgtatggtactgcaaaatgatgctctgcatcacaaaaataaatgtgtgttccacctggcatgtgtttgtgtttgtattaggtaagtgcttatgtgtttatagtaagcaactgcttatctttagcaccgtttaatttgggattaactcaggaaccttcatccacatgatgcaccactcagcaatcctaacaaatcttcatcccttgccaactgggaaagtagctagaaggtatcatgacaccctcacttcttacatttactatttggacaataattgaggttgagtaggagagaccaaataatggtgctcagcaccaaaaaataagtgtcttccacttcccgggtgtttgtgtgtatatcataagtaagaacctatgtttgtgaatattacgtaagagtttcaaaattaaagaattgccttccgttgtacttgatgcgcaacaaaaccaaactaggagtacatatgctatgatcattgagaagagagcgctcaatcatatccaaattgtgtagtgaacttgatgaaaattgttacacctccatcaaaaagtctaccagtagtagagtttgcaaaatgtggcatcctttgcttgttagatcaaatacgatctcatctagagtagtaactgtaagcttatcatgacgccctcgctgcttatgtctaccattgggacaatggttgaggttgtataggagagaacaaaatggtcctcaacaccaaacaaaaaaatgtgtcttccatttttgggtgcttgtgtgcttatcataagtgtctatctttgcgaatgttaggtaagtgtctcaaaatgaagaattgtccttccattgatccttgatgcatgacaatatgtagtggagagaatatgacgatcatcttgtccaatccccgatccatatggaaccttctagaaatttccattatgctgtttccattctattgaaggcaacaataatttttgatcttggttacatgctcaaaattagactactgaagcatagttcttgcccaaatcagaaaaatacaatcccaatttcttatatcaacaaacaaaaatagcagtcgcacgtacctcgtaagtactaattctgcacatcggcacactgcacaaaatcataagctagctagctagccatatgtatccatggagctatttagatctagactaatttttatatatgggatgaaatctcgcatctgatgtcctcttacactcacacagataaaccgatatagagaattaatcataaacccatcagaaccatcaaacaattaacaatcgaaaattaaacatgcatacgagcaaagctagatatcttgaagtattattattgcagaaaaatattgctgcaataatgactagatcatggacataaggtagtagaacctcatccttcacttgagtcccgagcacctcctgctcatcatattatacctcctcatcacggagatacttggtggaaatggacacagcttgcaccatggccggcagggcattcacttatcaattttatttatagcattactgccagtttgtaataaaaactagcagtgatattgctgccggttttatttgtgagtggataaaaggatttgtcgagtcggtgtggatgtgtgattaagtattgatccctcaggctcttcctctagcatgtttctccctttcactgtcagccttccaccattgtcgtgtgttagatgtgtattagataggttgtatttattgttttatgtcttttggctttccatgttcctgtcttttggttttccctgtatctgtatatatatttgggctattgccctctgatgtatacaagtcgtattcataacatggtatcagagcatggtttagacttctcatcttcttagatttttctctctcggcttctccatgatttgatttgaggattatcggcctcttcatcttgaagccatgatgttcctcttgatctagtatggtgtcgctgagaatcatccatctctgctccccaacatcatcaatttcttcagaacagtgtagagggttggtggttgtcctcatcaccggctatcgtcgcttctcatcgccggccgccgtcgctcgtcgcgggcccccggccgccgtcgcccctcgtcgccggcctctggtggcgggactccggccgccgtcgcccctcgtcgcgggcctccagccgccgcccctcgtcaccggcctccggtcgtcgccgctcgtcgcggccgccgtcgcccctcgtcgcgggcgcctccgcctgggttgtagggcgccgtcgcttggcgtctgtttccccgatccggatctggatcgggaggtttaaaaaaaagaaaaagaaaaaaaagaaagaaagaaagaaaaaggcttctctggctctgctactgttgtgctctgatcgcacgtggtggctctatattttgggctgaggcattagaaaaaaaaacttgctgccgcttgttctgtttgctctctcgccgtcgcttcttccttcttgatgatgtcgtctttatccggcactgtgtctgttcctcattgcccagttctttttgatggttgcaactacagccattgggctcagcacatgcgtcttcatatgcgtggtcagcgtctttgggatgttttatctagtgagctaccctgtcctccttgccctattgctccaactatgccttcacttgcaagtcaagctactgatgacgatagagaaaaggctaaagagcagtttgatgatgccatggaaaattatcagagtcagtttgctttatacaaggcttggttggatgaggatgctcgagcttctgctattcttgtagctagtatggagattcatcttactggtgaggtggttactcttacttcagcccatctcatgtggacacacctacatgatcgttatgctcctactagtgatgctctttatcttgctatggtgcgtcaggagcagtctttgcagcagggggatagtacggtagatgagttctatacacagttatcctctatttggcgtcagcttgattctttgggaccgactatttgtcatacctatccgtgttgtcagcgtcagcgttctcacatggatcttcgtcggatctacgattttctcacacgtctccgatccgagtatgagtccactcgtgcacagttactttctcggcatccgcgtgttactatcatggaagctcttacggagattcgttctgaggagattcgtcttcgagaggcgggtattctaccacttccttcttcagtgttagctgttcgtactgtggcttcttcggcttcttcgacaccggctgttcattctacagtttcttcctcttcttcatcggcgcgtcctcctaccacagttgtaccatctactaggggtcaccttcactgcacctattgtgataaagatggacatgtggagtcattttgcttcaggaagaagaaggatttacgtcgtggcaattcttcgaagggtactagtggttcttctcagaagagttctggaggttcagattcacaggaaattcttatgttacttcgtcgccttactgcttctgctgcgacaggttctgttggttctgtggctctaccttctgcacagtctggttctgctgttcttggttcttcatcttctactgagggatcatcttctgcttcaggtactattccatggattctagattctggtgcttccttccatatgactcatgatagatctagtctttcatctatatgttctcctttagttcctactactgttcatactgccgatggtactcctcttgctattgttggtcgtgggactctttctatttcttcctttagtgtccctgctgtttcttacgttcccaaattggccatgcaactcatgtcagccggccaacttacggatcatggctgtcgtgtaattcttgattctgactcttgttgtgtccaggatcatcgcacgggtctcctggttggtactggccctcgccgccgtgattctcagcgtctttgggagcttgactggcttcgtcttccttccgctgcgcctgctagtcttcttgcttccactgcttcctctacggtgtcttttgctcagtggcatcatcggttgggacatctttgtggttctcgtctgtcggctttagttcgccgtggtcttttagggtctgtgtcaggagctgtctctttaaatcaatgtcaaggttgtaagcttggaaagcaaatacaacttccctatcattctagtgagtctgtatctaagcgtccttttgatcttgttcattctgatgtgtggggcccagccccttttgtttccaaaggaggtcatcgctattatatcatatttatagatgacttttctcgtcatacttggatttacttcatgactcatcgctctgaagttttggctatttataaatcttttgctcgcatgattcgcactcactttgattctcccatccgcgtgtttcgtgctgattctgctggtgagtacctttctagagagttgcgtgtttttctttccgagcagggtactctttctcaattttcttgtccgggtgctcatgctcagaatggtgtagcggaacgtaaacatcgtcatcttcttgagactgctcgtgctcttatgattgcttcttctgttcctcctcatttttgggctgaggttgtttccactgctaattacttgatcaacatccaaccttcctctgctctacagggtgggattcctattgagcatctttgtggccagcctcctgattattctaatctgcgtcttttcggttgtgcttgctatgtgcttcttgcaccacgtgagcgtacaaagttgacggcttagtctgttgagtgtgtttttctgggtatagtgctgaacataagggttatcgttgttgggatcctgtaggacggcggatgcggatttcacgggatgttacttttgatgagtcccagctccacatcctctcccgatgactctcttctgtttctcacttttcctgatactcctgttcgtgctagcattccttctcctgtctcttcctctcagctggcaccttcttctgagaattctgcatcttcttatgtgcctcctcttacccaggtttatagtcgtaaacctcgtatccaggagccttctctggatgcttctccggttgctcctcctcgatacaattttcgtgatcgtaatttagttacgattcgtccagaggatcgctatggttatgttgctacagttcttgctgaaccttgttcttatcgtgatgctgttgtccatcaggaatggcaacatgcgatggcagaggagcttgctgcacttgagcgtactggtacttgggatcttgttcccttaccttctcatgctcgtcccatcactggtaagtggatctataaggtcaagactcgctctgatggaactcttgaacgctataaggctcgccttgtggcgcgtggtttccaacaagaacatggtcgtgactatgatgaaacttttgctcctgtggctcacatgactactgttcgaacacttcttgcaatagcttctgctcgtcattgcaatatatcgcaacttgatgtcaagaatgcttttctcaatggggaattgcatgaagaggtttacatgcggccacctcaaggctatttagttccagagggtatggtttgtcgtcttcgacgctctctttatggcctcaagcaggctcctcgtgcttggtttcaacggttttcctctgttgtcctggatgctggtttctcagctagtgctcatgatcctgctctctttgttcacacttcaccccgcagtcgcacaattctacttctctatgtggatgatatgctaatcacaggtgacgatgcggagtttattacttttgttaaagcacgtctcagtgagcagtttcttatgactgatcttggtcctctttgttattttcttggcattgagatttcctctactcctgaaggatttcatttctctcaagccaagtatattcaggatcttctggatagggcctctctcactgatcaacgcacagttgaaactcccatggagcttaatcttcatctttctgccactgatggtgaaccgttagctgatcccactcgctatcgtcatattgtagggagtcttgtttatcttggtgtcactcgtcctgatatttcatactctgtgcacattctgagccaatttgtttctgcccccacacaaattcactatagtcatcttcttcgtgtcctccgttatcttcgtggaactatctcgcgttgtcttttctttccacgctccacatctttacaacttcagggtaattctgatgctacttgggccagtgattcctccgatcgtcgctctctttctgctttttgtgtttttcttggtggttccctcattgcttggaagactaagaaacaaacagcagtttctcgttctagtgcagaggctgagttaagagctatggcccttttgacagcagaggttacttggctacgatggttacttgaggattttagtgtttctgtgacttcaccgacttctttattgtcggacagtacaggtgctattagtattgctcgtgatcctatcaaacatgagcttactaagcatattggtgtggatgcctcgtatacccgcacacaggtacaggatcaggtggttgctctttagtacgtgccttccgagttgcagttagctaatttctttaccaaggcacaaactagagctcaacacaggttctatctctccaaactcagtgttgttgatccaccctgagtttgagggggggtgttagatgtgtattagataggttgtatttattgttttatgtcttttggctttccatgttcctgtcttttggttctccttgtatctatatatatatttgggctattgccctctgatgtatacaagtcgtattcataacatcgtgcacctccccttcccatcactgtctttggccctctcgttagcctattgttgcatctccttctccctagatcagttatcgttgcctctccctctcccctgatatgtcgccttcgcctctctctctctctctatctcttctcagattcgccaccatcaccctccctctctctctagatctgccactcctctccctttctcaatccctaatgactccatcaacctcggtgcttgtggttagggtcatcagatctggcggcagggccactagatctagatgttgtgccacctcttccattgccgacaggaaggaggccatgggcggaaaagggaggggagcatggtgacttggcaatggcgagaagagggagagtaggcgagacggaaaggggagggtggtgggtcggtgacaatgaggaagctagggaggagggagagcggactacgtgggggcctacaccatgctgccgcagctcaaggcccctgctccgcctaggggcctgcaccgtgctgcccagcacctcattgccagcacaagctgcaacttgcaaggagaactgctgctatggccaccacctcatcaccagcaaaaaaaatacgtgcacaaggtcagtttactatcatgtgctgctcgtttcataatttttactgtgattttggagaaagatgacttttcctgaaatataggttaaaatgatggtgccattgtgtaggaaaatatggaacattatattagatagggcttctccaagtaaagcatttaaagtaaattttcctttctcttatggttctttaccatcataccttttctcctatttctctattttggaccaaaatggtgcccacaaaaagaaaaacaaagtgtcttccacatcctacatgttcgtgagtttatcatcactaggtgtctacctttgcgaatgttaggtagtagtttcaaaattaatgaattgccctttcattgatccttggtatgcaacaagaccaagttaggagtacaaatgctaaaggtccttgagaagagagcggtcaatcatgtccaaatcatgtagtgagcttggtgaaatttcttgcacctccatcaaacaaagtatatcagtagaaaactttgcaaagctgggcatgcgatattcgatagatcaaataccatcatctagactaacaatagtttaggttgaaacaaaaaatgtgtcttccacttctcaggtgattgtgtgcatatcataagcatgtgtctacctttgcaaatgttaggtaagtctttcaaattaaagaatttcccatgcatcttttgttcctcgatacatgacaatatatcacaagcgactatgatgatcagtttgtccaatccctattccattttgaaccttctagagtcctctatattcctatctacattttattgaacgcaacaagaagttcttaccataatgatctcaattgcattcccaaaattagactattgaagcatagttctggctcataccagataaatacaatccaaaattcttccagcaacaaacaaaaatagcactcgcatgtgcctcataattactaattccgcatatcagcacaccgcacaaaatccaaaattttatatatggggactataatctcccttctaatcccctctcacactcacacagatcagctaatgtagagaattttagccataaatccatcagaaccatgaaacaattaaccatcagaaattaaacatgcatgcatgattatctacaagcaaacctagatatcccaaagtattattgttgcaaagaaaatattgctgttgatctggttcaagatcacaacatgatctcctagaggaatacaacactgcagacaatggtagctgacatatatgtgttatcctccctaaggattgctggttggcctccatacatctgtcacatacttacataccgggttgaaaattccggaatgaaaatttggaaatttccgaaacttcgggtctattggtgggtcccgatagacagtgagctccggtcaaaaatttcggcaaacactgttcatggcaaaatccccaattttctggtaaaaatccccagtgtccgatcccctcctcactcacctttatccgccgtcctcccccaacagctcctcccatcattccagcacaagcgagcagcaccagcggcggttgctcgaaccagaggcagacgggtggctggagtggctggcggtggctccgcggctctccggtgtgacgacgacaacacaagccacacggcagcgcgggcctcgcatcctcatgctggagtgccagcgacggctccgcggcttcggctcgacggcgacacaagccgcagacctcgcatccttgtgtttggttggagtggccggcggcggcgcggctgtcgggcgccgccgcgacgacgacagaaggcacgcaagccgcagaggacgcgacgatacaatccttgcgtttcattctccgatcctgtccaaattctgtaattttggattggatggactcaatgcatgtttatattctgatatatgtcaaatttcagtaatttttgttgttcaaattcaaattttgtttggaaattttgttcgaaatttccgaaatatttctgaaatcttgttatttcgctgacccccgaaaaatttccctttcccgatagattgaaccctgcttacataccatccgtatcgagaaagtagagaggaaaagttaagcccaacaaagaaaggagaagctgcaaaagagagacagagatagagggcagaggggaatgtaaattaagagagaatatttaatgttggatccatagttggataaaatggattgcaatatatactagtttctatttaaagtatccattttttatgtgccaagtatagacactcttaacagtgtctataattgggaatgctcttatgttgttagatgtttgtgtccttgtatatatcattatttggtcactagtagaaacttagaatacctagagtattatgctctgcactgcaaaaaaatatatatatgttccacctagcatgtgtttgtgtttatggtaagcatgtgcttatgtgtttatggtaagcaactgtgtgtatttgccacatttagttttatttttggattaactcggaaaccacaattcacaggattcaaccacccatcaatcgtgacatatcttcatcccttgtcaaccaggaaagtaaccaaaatgtatcatcctactctcacaggtcgctgcttatgtttaccactggggtggtgcttgaggtgaattagatagcaaagcagtgtccagcacaaagcaagggcccctttgaatcaaaggatttatgtaggaatttcataggattcaaatcctataggaaattttcctatttggccctttgattcaaaggattgaagctttccaaatcctatgaaattcctatggaatgacacattgcatgtagattttggaggaaatttagcaagagctccaacctcttggaaaatttcctttgagtctatctctctcatccgattcctgcgtttttcttgcgctccaatcaaacgaccattcctgtgtttttcctgtgttttgcaatcctctgttttacacttcaattcctgtcagaatcctatgtttttcctattcctccgttttttctaccctgcgattcaaatgggccctaaatgtgtcttctacttcctgactatttgtgtgtttatcataagttagtgcctatcttcgtgaatgttagataagagtttccaaataaagaattgcccttcaattgtttttttttttactggggaaaactaccagggctttgcctagtagtgtaattttatcagagagaaaatatgtacaaggttacatggaaaacactaaaaaattacaaagttttcattgagaagaatgtgatcaatcatatccaaattttctagcgagcatgatgaaatttcttccacatccatcaaacagactatcaatagtagattttgcaagactaggcatgcattgttcagtagatcaagcactattgtgtctagggcaacactagtaagctccaaagtttttaggtacatgatatgtgtgactgaggaacagaacttgttgctgccgatgacactatgcttagtcatggtgttacatgatacatgctatgtctaacttagtagccatatatgcaatagatgtatgttgtagtgaaagggcatagcttagagaggtgtagaatactgtagtctttgttatcattcacttcttcctcttcttcattttcatcacctggtagatctcctacatgaggcagtagagcctcttcattcaccaagtactgagcacctcctactagtcatattccggctcctcgttgccgagatacttggtaggaaggggaccaactctattggggcatccacgtaggagcctaagggcatgcaaatggtggagtgggcgccactggacgatgatatgttgttccagctaaggaggtcaagccacttggatgcagcgagctcacgcaccatgaaggctcctaccatggccatcatcggcaccttcagcttgtttgtcaccatcacctagcaacagcataccgtagggttttcccgggtagtgatggatgtggcaaggacaaattttttcctttttttctttggctctcaattttcacttattctaatatactttttagtctttatttttgttttttctacaagcagatggcaatggcacggtgaccaattccaacccaaagctgagctagtttactccgattactatgcttgtactcacttatatagtgttgcccgcattttcctagcgttgtccatccctccacctaggttgagtctagtctggcttagaggttaggcatccagctgtttggttgtttgcgtgagcttagcctggctagcattaaattttgtttggttgattgtgtgagagagacggtttagaacatatttcattttgttcgatgcataatgtgtgagtgcagttacctatttagttggatgataaggttactgctaccatttataggccaaaatactttggaaaatattaaaatcaccttcttcaaattcaatcactatatatcatacaaaaacataaactgtagcttccatacatagtactaatcctcttggttactagatatttgaagcaatcaaactagtgacaaaaaaaagagagaaaaggacaactaaaaaagagaaggaaaaagaggaggcttcgttgagttcaccaccattgcctcccgctgtgctctggcccaccgctcgccgccatcgccatcacgacagccagatctggtggtcatgagctcgtgcctgcttgattcggctgtcctgctactggagagggtagctggaggtgttggagggctctagcagggacaacgacgtgaggaccagatggagggcgacagtgtggaactgatgaagggcaatgatggcaaactaacggcaaggttatgtcgacaatgacagcaatgccccttgagcctccagatctatgatcctctcaagccctccttcctctcgccatcctcctttctccatgatctagatgaactagagatcttgggcgccagattttcagcagtggagctcttcgcccctaatccagctcgtcgcagctaacgaaggtggcaggagggaactggttggtgacttcattgcaaaaccagcaaaccctagttttatattttgggggacaaattactaggcggacaatgtggtgactggtgacccaatgtcagcccctggtacgcggtggtgaaactcatggacacacggatgcagggtgggctgtgctactacacgcgtcaggccaggatgagcagtgaagcttgatccggccattcctgatcagtctagctgcgggcattttgaatctgttgggactgtcttggacatgtgcaggcaaccaaacaagtagccagttgcatgcaaagatgcaagtcaggccgatacaaccaaccgaacatgtcctatattcatgtgttttaatccttctttttttgacatgaatttctttcctattccctcgattttcctgtactatatttttccaatcctgtgttccaaacaagcactaaaacctttaagaagagagcagtcaattatatccaaattgtgtagtgaacttgatgaaatttgttgcacctccatgaaactgtctatcagtagctgattttgtaaagttggttatgtgttattcagtagatcaaatgccgtcccatcttgagtaacaatagtaagctctaaattttcaggtattatggtgcctctcgctgctaccattgaaataatacttgaggttgaatagaagagaataaaatggtgctcagcaccaaaaaaaatgtgtcttccacttctagggtgcttgtgtgaataccataagcaagtgtctatctttgtgaatgctaggtaagtctttcaaacaaaacagttgcccttctgttgatccttgatgcatggcaatatatgatggagcgactatgatgatcggccttctagattcttctatattcctgtttccattagactattgaaattagaatatttcttacaataataatgtcaattacatgcccgaaattagactattaaagcatagttcttgctaagaccagataaatacaatccaaaattcttttagcaaccaacaaaaatagcacttgcatgtgcctcataattactaattctgcatattggcacaccgcacaaaatacaattttttttatataacgggattataatcacccttgtaatcccctctaacactcacacagatcagctaatacaaagaattgcccataaatccatctgaaccatggaacaattaaccatgagaaattaaacatgcatgcatgattaactacaagcaaagctagataacccaaagtattattattgcagagaaaaaattgctgttgatctggctcaagatcacaacaagatctcctagaggaatacaacactgcaagcacaaaaagaaaacacaagcaggtccgcctcttttgtacttcgttctcatctttgtcttctttgcgttgttctgtcctcatgtatttgttgccactggtttcttcttcttctttggcttcatcgcctagtagcttattcttctccatcaccccgcagccatgcaccttacggttttatccaagtagatgtggatgtagccattgctgattttttttttccttgtatctctgctctctttctttggctctcaggtttcccatcttttatctactttttaggcttgtttttccattttttctaggatcagctagcaaaactccaacctaaagccgacctggcttgtgccgctcgttgtactcatactcactttatatatggcagtattggcaaataaaaatgtttggaaggcagatagtagtgactaaagatatcgtaattaaaaaataaaatgtctcttaaaaactaatctgatggaagatgaatgttgtggtcctttcgatatactcacacttgtttaccggttttcatcctgtatacatgtataccaactatactgcattaataaataataaagtatgatgaatgtcagtaatcggaataatatatactagttgaatgcccgtgcgttgctacgggaaaaattatttgtatcataagtataaatcacaccatgtcacctactaccttagggccaggattgttttcgtctgccaagacctccgcctaatctctcatcactaccaggaagtgtaagccaaagaggcgtcgtgcttacacattattctacaacaatattatgctcaccctcctgagcatgtgcagtgcacatttgcacaacatatatacactagagaatattataagcacttgtaaaatttggaaatattgtcatatacaaattcatggcccattgccaaaagactcgaaaataaaaacccaacaaaaatatttataaattctatacaatcactttgatgtataaagatctttgcaagtagtacatttgctatttccttaatataaccattggcatgacaaaactttcaattccctataaaaataatttacttcaactatgatggttccacactattctgtcaaggagaacagagaggagagagcagagagatgaagagagggaagatggggagagagaggaggaagaagaggatgggagatcaccggcaccctcaccggggacgagctccctccgcagcctctgctcctcatggcatgtggcggcaggtgggacgtcggccgtctctacacatccccacacgacgcacgcgacaggtaggatgaggaagaaaggagaggggagagaggaggaatgagagaggatgacatgtggggcctacgtgggccccacatttattattattttgtgtgctgctcacatgtgggcccactgtttttattatttttctaggatcgaattaccacctaagcgccacaccaatgcacgtgtcacgaagacctagtcaaaccaaccaagtaggcgccacgttagccaaaaccaccgagaaatcatgtttacactgattttgatagtgaccagttatatctggttttgggttaaagatgaaaatgggattcggtctaaagttaacactggtagagaaaccatctttggtcggtcgacccaaatccataatagtcccggttccattaaaaaccgggactcatttttagtcccgattaataagaggaagatctttagtcccagttgttgttaccaaccgggactaaaaatcatctttagtcccggttggtaactccaacccggactaaaattcatttttagtcccggttgatttcatgtcaggccgtgtcagggctctaggatctttaatcccggttagtaacaccaatcgggactaaaaacgttccgattggtgttactaaccgggaataaaaatcaaaacacactatataatctatagtaccgatcatcttttcccgtccacataacaaactccttcctctatctcttttttttcctctctaacttcttatctctttccttatctctaactcccctcctctccttccttttttccttcaccacacagtgaagaagcgtgcaggaagccggcgcggcggctgcggcgggcggccagcgcggcggcgccgagggccatgcggaggcggcctgcacggcggcgcggggggccgcacggtggcgcggaggggaggaggggaggcggcagtggctgctggccgaattgttttttctttttttttttgagatgtgaatctgtgatgtatttttgtgtgagatgtgaatctgtgacgaattttttagaaccctgtgatgtaatttttttaagagtttgtgatgtatttagagatgatatatttttttaagagtttgtgatgtatttggagatgatttatttgagaatttgaggatttggagatgttctgtgatatgtgatgatttggatatgggaggggatgatgtgaaatcaatattcaatattaaaaacagaaaaaaagaaaaaatatctttagttccggttgatgttactaaccgggactaaagatgctccccacatcaaccgggactaaagatggggattttagtcccggttggtaacatcaaccgggactaaagatcgatttttagtcccagttatttgaactgggactaaagatagcgatctttagtcccggattcgtagtcccggttagaaaaccggtactacaagggggttataaaccgggactaaacaacacttctccataccaaatgaacttattcctttctcctgttcacatcgaagtcgcgcctgtgcatcgcgagctcatgagtcatgcacgagtagttcacgaccggctgaattccaagactcggattcctcgtctcccctctttaacctgaaactaagatgtgtttcctgcgacccttctcagaacctgattagttcccacgcagaaactttttattccgtcatattaaatgtttagacacatgcatagagtattaaatatagaaaaaaactaatcacgctgattgcgtgtaaattgcgagacgaatcttttaagcctaattgctccatgatttgataatgtggtgctacaataaatatttgctaatgacggattaattaggcttaataaattcatctcgcagtttacagacggaatatgtaatttgttttgttattagtctatgtttaatacttcaaatgtgtgtctgtatatctgatgtgacacgccaaaacttttcgttcgcaaactaaagaaggcctcattctcttatccatccaaatgatgctctctcctcttccaccaacaacagcagtctgcagctcatagctgccattcaacaatggagatctttctatcctcttatgtttacttactgctggtcagtcaggatataggtatatcaatgcatctgcttctttcgggctccatcctttttattcgctggctgatttggtttcttgcacactacccaatttcaatccacaaagaaggctctggtagctaatgaatttctttcttttattatagacacttgcctgacaagattgcaagactccagtgtataaacatgtgcaggtcattgcagtagcactcaaagatgagttttatataggaacaaacatgatcaaggtgagtatatatttttctaaaatcatctcagaatgtcaatttcaaggagaataatattcttcagttttctgtccagtatctaagcatctccctaaaattcgtcatgaatgaattggctacagcagtggcaaaagggttcgaccatgaaaattgttcttcttattttattaattgtttttataacctacctttctctaggatattttcatttttcactttgtaatgtgaagcaaagtcaggtagcggtctcaatagcacaaatctatttatctataatagctgaaaaatatcatctgtaatgacttaggcgtccgttatagtacaataggtacataatgtgacatgtcatctgtaacggttggtcgaccattacagatgtgtgtcatatgtaacggctcggaaccatgagtcgttatagatgtaaaaataattaggcaaaaaaaattacggttcacatcttgtgaaccgtcatagatagcccgttacagttgtgagaatctgctagtgtctattggtggtctttttttttattaatgttctcaatctgtcaatatagtcggcactagcgggcatgattcgccagcaagcgtgattattcaatgtacagaacgcaccaactgaagaagagaatgagctgtttggtccagtcagtctcatgctcccattgacacaaagtttattgcattgtataattatttaccgctttcatccaaatgttctctgaaaagaagatctaagtgcatgctatctttatctgttgtccaattacatatatgtacacatgaatatctacaaatctccgtttaatgcgtggtatatcgtctaattcttttataaggataacgaccctccaaaatttcttatttttctttcaatccaaaggaggcacaaaagggcagaaagagcttttggtgtcattggaaaaaaaaactatttcaataggtttgacgaccccacttagattttaattgaaaggagtcatacatagacccattttggaagcttaattaatattctaataagcaactggttggtatttagcttttaagagtttcaaaacactaggtatcccaaattttaacttctagtctatttcatagattttgtagctacgtattttgagaagctaggtaaaaatcggaagtgttgaagccgaagaatttgaggtgttatgttttttcttaagcttatgtttcccagccaaaatttgaacatatatataaaagttttattcacaaattatttttcgtttgcaaatatgtcgtaccacgaataaacccaaggcatgggggctttgagacaagttgctaaaagctgccttaaacaggtccataagtcatatagaagaccaatatgtaggatttgggggggtgcctgcaaatcaggcgcccgattttttttccaaaatcggatgctgtttcaccaagtagataaaaaatgtttcactaaataggttaaaaatgtttcagtcttttaaaaagcaaaaacacaaccaaatcaccttatgaaacattttgctacagcgtatgaaataacggtttccaaaaaaatcggatgttgtttcaccctatataaaaataatgtttcaagtttcaacaaataacgaaacgatgtttcaaatcttaaaaaaatgtgaaacacggtcagatcgttagatgaaaaaatttggttcaacatatacaacaaacgatttaaagccattgcaacacttaaacccatgtatattaacaaaccacgtgtccatcaagatgaaattattaaacattatcaaaaatctgctgtaacatttgatccatacatagtgaaacatcataagaacactagctgaaacattgttggtaaaaaaatgaaacagatcctccttaatagggcgtttccgttatatctggatggctgttgcaaaagacgcgtggtggggcatgcgagcgtgggctgcgcggggcgcccaatctttttgggcacccgagcactggcaatttcgaagatttggtgagtggttattcattcaaaatcctaaggatcttgcaataacgaaatcatgtggaatagaaccctccaaaatctcataaatgtactccaattaacaataatagtacatcacagagtcaatcagtggtgctagtacagtaacattttcaataataaaaataatacaagaaaactcctgtaataaagcacacctatatcactacatgtaaccacttaagcaagcaggtgagcactgcaaaatcgccaatcccaaccgcgccactgtcggtgtcggcatcggcgctggaggacctcgagctcgaaatcttgcctcccatggcctccacctcgaggcggtggtggtggtggccgtgggcgacgccgccgcccttctcctcctccgcctcgcggcaccacaagggggaggggtgggggctgggcgggcccgcgctggtgaaggccgtcgggtggctcctcctcgccggcctcctcttccgtgtgctctgctccttcccctcctccacctcttcgccggagatcagcgaaggtgcgagctctctcgtttcctgatcttgaatgcggatgcagtgggaaaggggattgggagggtttaatgctgtcggtgggtttggggggcctgcgagattcggtgcatttcgacatattttgctgttgttggagcgaacattagtggttttcttgggtgtcttcggttccatgcctccacgagttagagattttgatgccacttgaatcttgctgcgggttggaccaaatgattagtctgaatttgttttgttccgttcatcctatctcgtggaatggcgtgcaaattttgttttgctgtgttagtaggaaaacatttcgaattggtgaacgcttttttcttttttgtttctcaaattctgggtagcgctttttccggcgggtttggtggggaaagctccgaataaactttctctgatggagcagtttggcagttacagatctcatgcttgtgcaattgcgattggacttttcttttttcttatcctccaagtggaaatatttaatctcttctctatggaagactagagattcagttctttttattctttaagaaccagaaatctcgaaaacaatatttcctttatatacgtttgcttcgtatggggaagacaaataagaaagctgtctgttttgatcttgtcaaccactgcttagtaaatatctgtgcaaagaatataaatatgcccttcaaatgtagccagtaaattagttcttcagctaaaacatgaaacaaaattaactcttctgttcatctgtcatatgcaaatgttgtctcactacttttagttcctatcctgtacttattcacattatttgatttgttatattgtcctaagtgggcttctgcaattttaaattgtactgtctatttttatgagaatgatactattcgtagtaatcttgaaatttttttagttcttgttgcatattattcccattagaaatcacttggtaggatctcagtaacacgtagaatgcccatccacagtcaaccatgcatttactcacggcatgttgacttttgacatatgtgagtggtaatttgtaaacaattggctgtagcagaatttgcttatcttgacaagctggagcaactaaagtactggtcgttaaggaaggattgtggctatggtgccaagcatgtgttgcttctccaagttttcttttggttgtgactgaatagttaggatgtaatatttatggaaatagttttgatggcaaatttgtatgaatgaacacttgaagcacaaatgacaaacttcttaaactctttcactagttcgaatgggtaaatgagaaaagtggctgatctatatatccacaatttcctgaaacctaaaatgtagtagtattttgtgaacattgtgagtcctcaactattcaagtattcattcacaagttcaagacctgctattgtaccaacctaattcctgtgataaagatctgccttcccacttttgttccaacaacaaacagatattttgttgaactggaaatagttgatgttttatgaatctattactgcttgtgtatctaaaagaagattttagggctactttccaccacagtacgtttaggatacttgacataagaaacaacgtataaattgtgatgtttctttccgtagtgctcttgtcttgcatctcatataggatatttcttttgtagggaaatgtaacctttttgatggtgaatggataccaaatccctctggcccagcctataccaacaaaacttgtcgatttattgatggtcaccagaactgtatgttgaatggtagacctgacatgtcatatttacactggaggtggaaaccatatgagtgtgaactgccacaatttgatgaagtgagatttctaagtgctatgaggaacaaatcctggggtctgattggtgactccattcttcgtaatcaagttcagtcactgctttgccttttgtctaaggtaaaagttatgaacattacatattttcactaattcactttcccaaccctgttatgaagcaatgttcatgctttccttgaataatcatgttcctctgtgcacctttcctaattcttaaatataacttaataagggatgatatatgatagcaagcaagaataccagataagtttcatgttaccttccatgcatactgaacattatccccattagtgttatacagataaccatcctgagcagacctgcttgctgttttatttaggctgaagaacctattgaagtgtaccatgacaaggaatacagaaacaggagatggcacttccaatcatacaacttcaccgtgtcactcgtctggagtcccttcctcaccaaatctgaggtatttgaaaatgagaatgggcaatccacctctgaaatccagcttcaccttgacatacttgacccaatctggacaagtcagtatgagaccttcgactatgttgttattgccggtggacaatggtttctcaaggtcgcggtctactgggagaatgatagggtgataggctgccattactgtcaggacaagaagttacgtgaacttggatttgaacacctctatcgcaggactctgcaacaaatcttcagattcattgcatcttcaaaccacaaaccagctgttctcttcaggacttgggcacccgatcacttcgagaacgcggaatggttcaacgggggaacttgtagccgggttttgccttacaagaagggagagtacagcggaaaagacatggatcgtatcatgagaccaattgaacttgaggagttcaggaatgccatggcggcactaggtggttcgcggaactctgcgaatctgaagctcttggatacctacagcatttcgtccatgagacctgatggccatgttgggccttacaggtatccattcctgaaaggtgacaaggatgccaaatcagttcagaatgattgcctgcattggtgtgtaccaggccctatcgacgcttggaatgatctcgttatgaagatggtattgggctgatgaagcctctgagataatactgaaagagtaaaatgcaccagcggtccttaaacttgtcaagaggtttcacttaggtccacgaacttgcaaagcgcacatcgaggtccctaaacttggtttattatatcatcctggtctaaagccacgtttgaccgtggtcttgtctacgtggcatgccacgtggacgatgacatggattttttgaaattttttctccctccttccttcttttttttctcttttatgaaaagacgatgacatggatgacgtgtacaaggcattttcgtcttttcgacaaggaagaaagagaaaaaaagaattaagaagggagaaaaaaataaaaaaattccatgtcatcatccacatggcgtgccacgtaagcaagatcgcggttaaacgcggctttggaccgggatgatacaataaaccaagtttagggacctcgatgtgcgctttgcaagttcgtggacctaagtgaaacctcctgacaagtttaaggaccgccggtgcattttactcatactgaaaatgcagggtttgtttcaagcacattctgcaaatctcgaatcagggtcagtttcctgtgctcggtcgtgtactggtttaaccgaaatttgtaactagtaaaacctaaattttgtggttgtaaatcatatttcggttttgggccgggaagtggcttattgtttaatgtgtgcggctgtaacttttggaagtcaaatctgtttgcctgctctcatctttatgtgaaaattcagggcatgcagtaggagaaagttctttttgataataacatatatctggtcaaaggttattacagcattgcaacattaagttgctaagttgaaacaattaagttcagatgtcttgaatcgtccgcgatcgctaatcggcgcgccaccagcgcgcgtttcaggcccataaggcccagcaccggcgcgcgcctccttccacgctttttttttcgtttttctttagcgatttttttcgttttcttttccacttttttctgattatttttttaatctttagcatgttttgagtttgaaagtttttaaattttgagttaaaaagtttcaaatctaaacttgaaagtttttaaatcttgacttgaaagttttcaaatctcgatttgaaagttttcaaatttttcaaatctggacttgaaagttttcgaatctcaaagttgaaagttttcgaatctcgagttgaaagttttcaaatctcaaattgaaagttttcaaatttttcaaatctggacttaaaagtttttgaatctaagttgacagttttgaaaatttgactttaaagtttaaaatttaaatcgaaaattttcaaatctaacttaaaaaattttcaatctattagtaaaaaaatcttcagaatctttcctaattactatcattagtgttaagtatattaactaatagaggtagttaaatatattaactaatagtgttaatagaggtagttaataggggagaagtgctcgctagcggcgcgcacgcgctagcttggtgccccctgaatcatctgcctcggccctcggcaatgtcagattctcaaaaaggcttgtaatctgttcatagcagtgctggtcacgtgcttgttgggcctaggcatgcccttggaaggataatgccctactatttttaatgggtcccaccagtattattctactcactttttatttcctctctcttctctgcctttcccgctagtggaggaagctgaggctccgggctgaatgccggcccaagcagtgatagcgtcctcaagcacaagcgtcgggcaaagtagaagtatataggtagtacgtggtcgtcctcaccaccagcctaccaccaccaactccatcgattcttctccgctgccaccaccttcccatccccatccatggaatagatcgggcgctacaacctctcttcatcagggccagaagatgaggacgatggtgccgccgagcttgctagatccggcatggggctcggcggatctggccttgagggtggtggagtaagaaaaagctggatgacggcatcaccgagctcgccagttccgccgagagcaccgacttcatttcccgccaccatcttcccttctcctcacatgtgtctctccccaggttgccaccaacgccccgtcgagctcgtggtggtgaccttgcttacaacggccactcgttggatgcctgtcaccgcctacatgtgttgtggaggcgtcgcatggggccacaccctctcccaacgcactgctcgagtcgtgcctcgtcgcgccctaacaaatccctgacaaggaacataggtctcgacttgtttctgcagtcttcacatggtaataggagaggcaaacatggcatgaaatctcttacatgagaggctggggctgaacgacagttaggcacactgtaaaagccctaatgaacacgtaacaaatccccaaagtagtcatttataccaaagctataaggattcgcttaggccataacagaacaaccttagtggaaattcataacttagctacactccaaaattcataaatttagtaagagaaaaaacatcgacacgattacaaatcgagcatttgaatttcctaaaaattgagtgttgtttcactactcgtaaagaaaatatttcacccaatagattagacagtaaacacatttaaactatgattgaaacattttggtgtaacatatgaaacatcgagtttcacgctattaaaacaccaacaaatccatatgaatcaatgacaatgttatgagacaccgtcaaaattttcataacaacattttaatccaatacaaagtgaaacatcaaaagttcatagcgcatccatgctaccggcggtgaggcatcggtgtccatgccgacctcctggaagaagagaaaagaagggacgcaccacctatattcgcaagcttgacacgaaagtcactgcatgctgccgcatccacatcatatttttcgacgccggtcactacgctgctgtcgagcgacgcccacgggaccagacctccctttcccctagcttccagcaacacaacaaccatagatgttcatttggctaagttgtcatgacagaagaagagagagggagggagagagtgagagagatgggatgaaactagtggataggaatgaatagattaccgttcatcgactaaaacaaatctgagccatcggattgaatcggaggcctggatgaccaggatgtgtgtgggtgtgggcatctgatttttgcctagcataggatgcccgggcgggagcattctaaaaaaagaaaagaaaaaaaaagtatctaaagaactttcgtaattttttttgggtcaaaaactttcagacgtaactaaagtataattaaaatgtaattatattttaactgcattgtaactataagtgtaactacgatattactatgtgtagatagcattgggtttttatgtgtaacatgtataaaaatttctttctagcaattttctctcttaatgcatagaataaatctcgaggtgatccgatgtttataaatctgaaagttctagggacataaaactttcataagttttctaccaaatctgaaaaaaaaaatggtataacaacaaaaatcaacaaaaaagatgtagtcagtccaagtcaatctcggatgcactcctcgcacaaagttgatttttcggacaagtttgatacatcgattcggatttaggagcacgtcacgtagcgagaaaatttcgatcgaaataataatccctaaaactttcatagaaaaacaaaagattattttgtgcttcaactcaggcatataatcgctttgtgcttgtctgcttagccacctgtatttagtcagattggcagcagcttaatccgtcggctaaattagtaccagcgaaacttgctggtcatattgttgacggcctgaatctgcagctccaggtcacggatctgcctgcgcttcgccgccgcgagcacgagctcctcggcgcgcgcgtccttctcctcctccgccgcgagcagccgcgcctcggcgtcgtcggcccgggcctcggcatcccgcctccgcgcctccaccgccgcccgctccgccacggccacggccagcgcgcgctccagggtgcccacctcctcctccaggttcgccgccgcctcccccaccagcagcctccgccgcagcagcgccgccgtgccctcctcgccggcgtcgtcctccgccgccgccgccgccgacgccgcgccgcccctgagcgaggccagcaccgacgagaagcatgacagcggcatgtttttgagtcgcgttgagaaaacgaaaatccaaagacggcggcacgtagagaaattaattacgttgggaaaaagtgatgagcccatgggcttttgataggccgattattacgaaggaatacgagtccgattacgatgggaagtaagacgaggtgtcccggtctgaatcgaattacaccggtctgaatcgaatacgttgtttatacgcccgaacaaagtgagcgaaagtggttccgagtcggatagtatcgcggagaaaaaaagagttccgctatacatacgattattttttatacgatgtttgtacgatgaaacgtctctcctaacatttgtagtgacgaaacagatccctccttcactgcaaagcccatatccaaagcccaggctcctcctgacgacctggcctgctttctcgttggtctggttgcacatccaaccaaagcaatcttctttctaatcatatcttaagcaatattcttcctaataatatgttatatagtaattgtactcagcactcatttatcatgtggcaggttaagcaaattactcatacatatatgttccttgcaccttgcactatcaaatagaattcccttctttggttcttgtaacatagcttcctctgttgattgctcatttgaaacaaacttctcaatttcttggtcatctgattcattttggacctcctcaataataaaatcatctttgtctgatatggcaatatcatcttctacttcattggtagataaattggtctccattactgaaacatgtaaattgaaacaatggcatgttttgcaaagcaaaaattcagattcattctataataaaaaagaagcatttcatggccatggacattacccaggaccaaaaaagaaagagagggagactagtgtaccaaaaaagatgattgcgaagctaaaggaattcaggcaaataagatggcatacctatgtcttcgtatgccgtatgctctctggattaaatgcagaattgcagatgcgctgataacatggaatagggaaagtcaggtttagggtttaacaaaggaagatgtaaagttagatgcaaagaggctaattgggctttagggcccatgacgctcttgactgccgtgtgcgcatgcgccgtgcgcttgagttaggttccctgccgtcggcgttgttacgtttgatggtaccaatatcgtacaaaaaattcgtatgcgtagcattttccagaaaaaaattgaaaatattttttagtttggacgcggataggcgcggctgccatgcttgggccgggcggctgggccgagagggaaagagggagggaggcccgggagagagagaggagaggaagaagagagggagggaagagagacttgggccgcgggccgagggagaggagggggactttgggccggactgggcccaaaggaggaaggagggtttatttttagtttttctttttaataaactctaataattgttttttttcttaataactattttccgtgctctgaaaatacaagtaaaatttgagggcaccttttagaccaaggaggatttaacggaaattctccgggcaacacgaatttttcttgtatgtattttagtgtttgtcaatttcttttcgaattttaattaattctattattccttttagagaatgatttttaattcgggatgaatttatcaggacgtgacattggtgataaggtggaggagagaagttaggagagagagagaatgagccacccccttatggcatagcttgtgtgcttcaattgtgcatattgatatgacagaagaaagtgatagttttagatggaactttcatcaaaatggtcaattcacagtttgatctatgtatttagctttaataataatggttatattgagaggaataagattaattggaaacttaagatgcctctcaagattaagatttttacgtggtatctacttaaaggaattgtgttaactaaggataatttggctaggaggaattgaaatggtagtttaagatgtttttttataaaaaatgaaaccatctaccatctattcttcgattgctatttttcgagatttctttggagttactttggtttacatcctccacaaagtatatctcatatgtttgggaattggcttgttggtgttgataaaaaaattaagaatcttattcttgttggagcatccgctttatgttgggttctttggcttagtaggaatgacatggtttttgatatatcaccatcaaaattttatttgcaggtacttttcagggcaacgtaattgctccattgttgggcttaattataaaggtgtgaagaagatatcagcttaattaatgatggcatgtcgtaaacttgagtcaacgattatgcaactctttgttaactttggatggaggttctcaaatagaattaaatagttgtgggatctttatcttgtgtcagtatatattagttgtgcttgtttgaaattttcattggactcactatgtgagtttgctattgtgtgaactatgtaataattggttgtagctcgtttgagcaaatgccgggatattttattccattatcaaaaaaagggggcaatctctatataatctctaagaaaagtgcaatatgttgcacttgctatcttttaattaatgagaagatgacatgacttaaattagatgtggtatttacatctactacaaaacttgtcctaagtactgcacatgaaccaacccggggtattgaagtaataaaatttattgttttgcagacaggtggtaggcattgatggtaggcaagaaggtagaagttggtttattttgggacaaacttcaatctctataagttgttttatttcgggatagagggagtagcaccgtacaagatgacctgggtatgcagacttattaattaacaaagtaaaacacgttagtgtgggcatgtcggatcgtcgcgcgcacacgcgtaaatttatgataacatgatagccggcaggtagatccaaaatataggaaggagcatgtctaaaataattagccatggatggcgcgcaaggtagctgcttcattaattcagttgcgcacccagatcatgtcgtcctgaggcaggaagtggcagatggccacgctcccgggcgccacgccgagcctcttgtatgcctccgccaccgcgccgtgcccgtccacgtccccgtggcacgcggccaccgcctgcgcccttgagcccgtgcaacccgaacacggcgtacgcgtacggcatcccgtggcatgccaccatgtcgccgccgggcaccgccacgggcctcacggcctccaccctgtacgcctgcctcggcgtcggcgtcaacgtgctgatcacctccgtggacacggcgtggacgtcgcgggtgccgaggctggacgcgacgaactcgaccatggactcgagcgacgtggcgcagtagtgcttgtgcttggtcgtctcgccggcgagccgcgcggcctcgcactcggcgagcgtggaccacatggcgtcggcggtcggcgagacggccgggatggagagctgggagaggatctccgggagcctttcggaggcgaacgggacggactcggcgcggccgcgggggagcagcgcggcgccggcggtggcgcgggtgaagtggagcgtcatcttggagcccgggaagaggtccttctcgaggaagaacacgttgcccaccgtgtcctccttcgaagctgagcccactgagctcgctgggctgatgaggtcgcgaatggcgccgggcatcggcgaggtcgggagcgcgatcttccagtacatctccgccggcgacgcggcatggctggctcccgcggcggcgacctaaattgcagtcagaaacaagttgaattgaaaacaatcagagccaaaagttgcaactagaataagtaaaaattgtattatgttcaatctctaaataatatatctctctctcccaacttaatttatctctgttctagctcaaaactactaaaccatacaaagagcgatatatatgtgcttctgctcaccaaaaggagtaggacagcagcgagtgacctagccatgctaattaacgagctatcaaggacacaagtatatgatctaattcactgataagagtgaaactgagcacaagcagttcatagcttttgggagctatttatggagggatgctggaagaatacgaacaaataatacattgcattggccccactggattatgcagaacaaaacaaatatgtcatgtaggaaagatgctatatcgcattcacgatcatgccggatacctctattattgagcaactaagaagttagcccgcatgcatcctaggctgcatttgagacatttataagtaataggttgattgtgttaaaatgtcgtatttgttactatatagcaaaatataggtatatggattttatatcatcggtttgattataaacagagcaatagttagattagaaatcagacctggagcttataattgtaaactatttctcttttagtaatacaaaatagcaacggaagaggaatgaaaagcgtagagctcgagccaaagagggaaggagtaggtgtgtagtgatgggcacaggtgagggtaatgtggaggggattttttctttgtaatttttccaagtgattgaagtgaaagacaattattagatgctattttcctaggatttgtaagattttttttaaagatgtgatacaaatcctagaaaagtaacatctaataattggttttcacttaaatcacttagaaaaattacaaaaaatgaatcccctccacatcacgctcgcatgcgtctatcactacacaccggcctactccttcatttcctctctagctcgcgagctctacgcttctcatttctctccccttcctattttatactccctccatcccataatataaggcatggtcaaacttggcacagtctttaaaagattaaatctttgacttaaatttctcatatactataaggtttattgcaacaaaattataaccatcttaaagtaaatttaaatatcaatctaatgatattaatttcaacaaacaaaacttaatttatattgtaatagttgttggtcaaatgtttttaaagttgaatattggaatgtgtgcatgccttatattatgggatagagggagtataactaaaagaaaaataatctatattataagctccatgtctgatttttaatctaactattgctctgtttataatcaaatcaacgatataagatacatatgtctatattttgctatataacaaatacaaaatttaacacaatcttttcgggagtattgtgtacagccgtgcaacatcgtcgtagtttatatatttcaccggacaagatgcatggatgaatcttacatgcagacttattaacatgctgccacacgtatagtggcatgtcgatcgatcgggccgtcgcacacacatatatgcatgataagacatgatacgcacatagctccaaattgtaggaaggagctagctttgagatcacacaatttttatcccctttcacgcgcgcgcgctcagttgcgcacccagagcatgtcgtcctgtggcaggaagtggcacaccggcacgctcccgggcgccacgccgagcctcttgtacgcctccgccaccctgggcgccgcgtcggtgtggcacgccgcgagcgcctccgccttggtcccgtcggcgccggccagcgtcaccgtgtacgccgccgccgtggtcgtgtggcacccgaacacggcgtacgcgtaggccatgccgtggcacgccaccatgtcgccgccggacaccggcacgggcctcacggcctccaccctgtacgcctgcctcggcgtcggccctgccctgtcgacctccgtggacacggcgtgcacgtcgcgggtgccgaggctggacgcggcgaactccaccatggactcgagcgacgtcgcgcagcgcttggcctcaccggcctgcggcgcggcctcgcactcggcgagggtggacctcatggcgtcggcggccggggagccggcggggacggagagctgggagaggatctccgggagcttttcggaggcgaacgggacggagtcggcgcggccgcggggcaacagcgcggcgccggcggtggcgcgggtgaagtggagcgtcatcttggagcccgggaagaggtccttctcgaggaagaacacgttgttcaccgtgtcctccttcgaagctgaggccgctgagctcactgggttgatgaggtcgcgaatggcgccgggcatcggcaaggtcgggagcgcgatcttccagtacagctccgccggcgacgcggcatgtcggatgcctcatgcctctattattgagcagaggctgatagtgtaacaacaataatcatagtgtggcctggggttacccgactccctatcggtattctttgaatgatccaacatgcatgtctatttctagtaaatttatggattcgccaatagagcaattttagtttggctcagttctatcgatggatgagtccatgagaagttagttttttttacaagctgttcaaatagttatgaatgttttttttttcaaaaaattacagaagtatgttattaattgtatcgcatgtttattgaaaaacacgcatgatcaaattcaatatatgcatggtgtaaaaaaaacaaatcaaatagtaaaagttaccatatatagttccacaattcaatttttttctcgatatagatattgaatttgaacttgtattaaaagacatatataacaggctgccataggcaacaaattaaatgaatcacaaggaacactcgacgaatacaatccctgtcagtatttgttatggccacagataaatccgcaagcacacaaaccgatatagcatttcatctcagagtattgcaagtgtattgaatcacaggaaacgtatgtttataatccaacaaatatgatttttctaaggacaacaattaaatgataggcttaagagagataggatttgatgaggacatcccagctacacttgacgtaaacaagggtgatggtttacgtcatacatcacattaagaaaatgaagatgacataaaccaagttgatagattacgtctcagcaagaatgatcaagcttatcatgatctaattacgcacagccgtgctaggaaaatacaacaagaggtgaactcgctctttgctcaacttaacccaaattttagtgagaattttatactacctaaatgctctacctttgtattgctaaggtttacacccgaggacatcatcactacaccaaggaagatgggttacgttgaggacgacaaggattacgccgaggaggattcagcccattcccaaccagcagctttttacaccaacaagaagatggtttacgctgcaacggctcaacttccaaggcttatgcgacccagccaatcaagagacgggaagcatggaatacatgattggaaagagggacaagtatagtttcgaacgcatcaaaccccacctcaatatcattctccaatcaaaagttatggcatttttactgaaggctgcgcaggagctgtagggctgtgtgcaaacccgagaaaactctttgcattctcatttttgttagccttgaccaccagaacgtggcttcttatgttcacaccttagctaggagggatgttcctagtataaatacccctctactccatccattagacaacttttgttcaattgaaaacctcatatatgagagattcctgaagactgcataagtgtcttacccctttgttcttgtgagttcttttggacttgcgagaaggctcctctggtgccccctagttcgtgctctacggcttctagttcagctgcaccatattgtgtggattagtcccggattgtggttctgtgattgctcggtttgacgggtcggagtccagggggcttcggatcattctcaccctcaccacttggtcgcatccaaccttggtaggtataaagctagttattccggatcgtggttctatgattgctcggtgtgacggatcggagtccgggaggcttcggattgttctcaccctcaccacttcatcgcatccgaccttggtaggtataaagatagttatcctcttgctgctcgtagctagttaccctcttgtgtttcggtttacgccggcactctgtcttgaacctactgctgtgaagatcgggccacccctcgcgagtgtgttcgtatcaggattcctatatgtaaataatcttagttaagttaaggtaaaactctattagtttcttcgagcaacggttcactcctggtctaccaagggactccagcatgtatctctatgatgtacccgaacgtgaaggattaagaaagacggacatgattgtcaccacatgttggctgttgcctacgtttgcattccatggagcacacaataaatgaaggtaacttctaacctagacaacacctctacaacattgattacaactcggccaagaactttcttctttatctacaatcttagtactagagcacttagtataaatactaagcgatgaacctgtcgcaaagataaaaatatatcatacttaaataagaaaagtaaataccaaagaaaatcatgaatacttacttatataaaagacaaaatcgtcgaggtacaagataggagagagtgccgacatctccggcaatcctccagtacaccccatggagagaatgtcgacatctccagcactcctccaaaactcggagagaactccgatattttgggcacttctttcggagcttcccctcattctcttcctatattctaactctactatagagtaggctaaatataaaagtgagttgtactcaactttctggtgttttgagagtgggaacttctcctccttatgtagcctgggaatcaagcataaccgccataggggaggcctgaggaagcgacatgtggaagctgtggcagtgatcagtcacactcttggttcgaccgaaccatggttcagagggaatcactttcaccgcctttcttcctcattttcgccttagtcattgtcctatgggtcctcatgacggtgcatagtaaattggcttcaattatgttagcttcatatgattagttggcccatggatcttctgctagcgtttgagtggccggaggtggttttcttcgcatggcaggtggttttcttccataattacatgcatacaaatattcaccaacactcgtgaaaatggttaataataaatcctatcactaggtttaatatttcattgatttgcttttatacaggaattgatagttatatttggtattaaaggactatcaacaattccgaaacatgagaaggtattacctctcatcgagagggcctaaacctgtctaaacctttgtcccgataatcaatccacgtttagatcttgtatttgtatactacccattttagcattgttgatatacgacaccgacagttggcgcgccaggtaggggttgcattgagtttttcagtgacaatcatgatgaaatcatcttcaggagttgtcaaattcgtcttccctccaaggcaaacattttgttttggcggtttcatctttctcaccgacaacttctgcaagcatttgttgacggttgttagcgatcagtttcaaccgtcaatattaccataatagacgagaactagttatgcttgcaatgcatatttaagttagaataataatattccaccagtattaggtttactaaccttttgcagagaataacaataaagtggagaagaatcgacatcaaatcagacgatcagtcaatcggatgatgtcgagaatcagacttatgtatgaatgggccaagaactcagaaatgacacgatgaattgggccaaagttcacaagtctacaacagggatcaagagaggaggccgccaaccgaactgtgggctggttgggccaacccctggttcgaccgaacccccctctccgccgtttgatccagggattggagggacggctgagatgagtccccaatgacggttggtgggtattaccgacctttccaaccgtcataaccgtcagtctcaagctatataaacccctcactctctccatttcttcagacacttcaagcaagagctctctcatattctctcaagttagtttagtattatcaagctagtggagtaggaatagaatagaaatcagagtccggaagtctttggaagtgttcgggtatggctctagtagctctcctttcctcttttgtaagccttgtactttatttagaatattcttatttatacatttctggtaatgaaatacgttccaagtctatgaatgccaactttattttatattcatgttatactgattatactgctagcttatctgggagatgcataggtacgggtataatgtttgcttatgcaattactctatgtcaggatgataatattagagtagtatctggtagtttaagcgtggtgtctagattattgggtatcattatttggggttatatactgcggataagaggtgggccgctgatggtgatagcttgttaacgactaaatttggtaatttaggtatcggagatgaagataaaattgaagcggaatccaagatggagatcattccggaaacagagcaagaatcggctaaagtccgaatcggctacgatcaagatcgacagagttcgagtcggagaaggttggccaattaagccgattccgacaatgtgactcggtacacattgtcgggttgagttaatgtgcttcatgaggattgccatgcatggattgagtcctgaaaaggcaattgtatctattaattagggtatttcttgtaatttccttagagataagtttgggcaaaagtctgccgcaaagacttatggtatcttagagtttgttagagatgagagtcgtgtccgacatggacatattttgtaatctcgggtataaatagaccccgagccccatgtaatacaaaaacacacgttcaatacaatctcggcgcatcaccacccttttactttcattttgttttgacgagttcttgctttcgggttgagctgcatcagttgcgatcttcaactagaggtaaaacttgttatggcggcttgcgttctcgggattagtgcttccatcgttatgatactcaaatcttgcttatgtaatttgtcgagttatcatatttcctatataatatttgacaatattgctatttaaccttcaatcggctaacatctattattagaaggcagccgattaggttaaataccaatgttggctcagattatatagggtatctaccactctatgaaacaaccagcggcttgattgtctatatattgtccttcttttcatacttatagctgcatcagttgagtttgaccttataagtcgtgattagaatcttaatctctagcctgttttctggttgcggattatggtagcgtcagggtttcagccgatcttacctaatttagctttatactttatgtgcttaactgatatgctagatctgccctttatattacgatcttattacagcaaagtatgttaagcttctgtttgatatattttgcttgctctaatatcttaacatagagttgtatcggagtattagccgatatgtgctagatctatctgatcggctatgctatgaacatctataatctcattattaatatatacttcgatctaagtgattcatactgtctcggcatgacgtccgatctatcctaatcacttgatttaagtatatatcaacataaggattatataccattaatatctacagccgatcgaatagatttagttctttcttacttattcatgattgccgatcgattcaaatatgacatcggctcaaagttaaatgatatgtcatcggcgcctggccgatcggttatcatttatggatttaaccatggtttctttgtctttatttcttgttgattgcaggatcaaatcaactggcacgctcacgaacctaaagacaagctttttggacctgcactggagttaagcagatctcccaggcctcatgttttctcttcaacatagctcagtacgggtattcctgcgcgcgtgtatatagtcctaagttaattttctggggagggtactcctccgtatttagccccggttgtatggtcatgacgggctatcgtaaggaactcggcagtcaggggtggcttctcgaagtactaggagggcatcagaaagagggtattagctagttaatcatataactagaatgtatgtatactatgtatactagaagtataggaatagattcttttctattttctttccacttagcttagataatttagtatgagaatgagtagttctatgcttgtgtgtcattctaccctatgtattatactaactcctgcttagactatgattattacaagtaatatataaattattagtacggttctctctactataatcttcccacggaattaaacaaatacgatacccttggaatactctcgggtgaaatgctacaattgtatatatgtgcgcttgcggataaactctgtaaccataatatacctggagtatttctgcaccattgccgagaattatatttctagtaatttcgttaagaaataccaataagcatttctggcgctgttgccggggattatatttctaataatgtcattaagaaataccaacagcatccaattggcggggttcgagacttcctcggtcccttttgatctctcaaatacagttgtggcctactccaggtcggatttccatggcttggcctcaaactggtctggggagtcaacgccacctgcttacctagacagcatctccaacaacgcggaaaactaccccaaaattctgatgcaactccctccgcttctcgctgcgacggttcaggacccactccatcctcgtgaattcaatctaggcatgattcgaccatgtccagacatgggcccaggaaggtgggcatcttgattcgttcgctcgatgactcctgcaacatcacggagatggtctatgacctcaaccactcggaagactatgccagattcagcatggaaacaatctacagctccaagtactccaacgattataccctactcagggaagtctttctagttggagcgccaaaagaggacgagcaggcccgcatccactaggaagcggaggaggagcacctacgtaaagaggagaaagaccgcttgcggaaacaatgtaacctaatgcatcgaggatgcacgacacatgacagcatcatccagactgcagcagaatagcgttgttgttgtaacgctacttgacaccctaatcgatgccttagacaatgccatgactccgacgctcgacaagatcgatgccatgatggtcactacggccgcacaacaggaaaaggagctagaggcactcagcgaccaagccaaccaccagaggagtctattaccaagacaccaagaatccatcgggcaaccgaccaagcaaacggccatctcttcacccttcaaaggatagccggtcagccgagagcagttggggccacacagcctcaaatcttcaatgccacgaggagaataacataacacattcttcagttgaaaaccgtgataacaatcatcgtgaagatgaccaccatgaaagcgaccgtagacaggaagacgaccacgggcaccgggaaggcgaagacctcaggattgaacaacaccgttgtcactgagagagagaagaccaggatcgccgcagttcatcactcaccccatcgatccatatcacctaattatggtgatgaaggaatagcaacttttagctgagacctacgtcgagtggactggctggctgacttcaaaccaactggtatcgagaagtacgatggcaaaaccggccctgagtcatgtctcaccatttacaccttggccattcgcgcaacaggagaagatatcaaagccatggtgaactacttgcatgtggcacttactgattcagtaagaagttggcttttggggcttcggtatcggtttgttgcaaattttcaaggcacctacgtgaggcccgggatacagttagatgtttaccatgtcatacaacagaaaaatgaattattaaaggactacatcctatcgacggtggatacctgtagactagataaatggggtactggggtatgttggtacaaggatctacacaatacgacatcaaaatagacaagagacaaggattatactggttcaggccactcgtaaggtaatagccctaattcaatttatatggaattgatatggaagaccacagaatacaaagagaactgatgaacttgttaatacagacgagatccttatcgagattattcgacgagacctcccggcggcttcggcttgagtccttcggcttcgtagactatggtgggtgtgttggcgctatgattcgatgattctgaacccctctaggggtatgctttttataccgcgagttgttttagtctccaagtagaactcagagataacgaaccctgcacgatatagaatattattcccacgagtaggactccgataatctccagcccgtgaggatattttccatgctatctcgtatatttccttatcgcatacagaaacatatcgtaggatacgggtatgccaatcttgtatatttggtaaatcgtaggatagtaggtatgccttatccgtaaccctgacacatctgacgtttctttgagacaagcaacaagattccagaagacacggacaatgtcatcatcgctacttttcaaaaaggaatctgtgacgaaaatctcatcggcaagttcacccgcaaaccgccacttaccgtcatgaagctcttcaaaacagccaattcatacgccaattcagccgaagccatcaatgttgtgcgggaggacaagcaatcaagtactccacatctggtgaataataataatgagtattacaagaaggatcgcaatcgaacacctgaaaacttggtggccgcaacgtcttattttcagtcacattgtcggcgtgctagaaaattacaaccgaatcttgaacgggccctgtccaaatcacccaaattccaaacactctgctaaggactgtttcacattcaagaaatttgttgaagacaatgctaagcagttgaagctaacagctggaaaaggaacttcaggacagaacaaggacaatactggtgaagctaatccggatggtttccaagacccagagttgagctaaaccacatctttggtcgccctttagcttataagttcaagagaaagaagctgatcgatcattatcaacgtaatacactcagcaaatatcaattcccaaaatagtagtagggcattacctctcatattgagagcttaaacttgtctaaacttttgtccctacagtccatcaacttttagatctcacgtgcttcccctttaaagtatcgcctatatagaacgtcgacggtttatcaatttttcgaattcaccaatgccagtgccgtgccatccaaaaccactacaaatattctcgaggttgaaaattaaattctataattgaaattatggttagagagtctgtctaaataaagtctagtgttgatctagagtattggacctccataaatgtttacgattggaacacaatatttgtcctagtcaataggtgggaagtaattcggcaagtaggtactggtattagatatataaagagtttatgaggatgtttgtccatccaatcaacatatatcgtagtttttccaaacacacatgaatcttgtatgaatttatgttatatattattattactctatttttattatataatggctatatgttattaatataaatattaaatctatgctacttaaaaattaaaaaataagagttgctttcatcgtccttaaaaaaaccaggcgaaaaaaacggacaaaaaaaaccaaatctgtcctatccaaataaatgggtgaaaaaaaccgggcgaaaaaaaagaaaaaccaaacctgtctgataaaaaaaggcgaaaataagaaaataaaaaaatttctgtcaacgcggtaaaaaaaggtgaaaaaaatataaaaagaatatgtctgattccaaagaaaaagaaattacatgtgacgcggtaaaaaaatcaaatcctattatatgtggcacggttaaaaaaatgcgacgcggtaaaaaaaacaaatcgaatccgattctatcgatgcagtaaaagaaaaatcaagcataaaaaaaatgaatatgtccgattccacaaaaataggaaacaatctcccatccgtttccactacttctatctatctactctaacaatctcccatcatccgtgcaaaataaatcgggcgaaaaaaatcatccgaaaacaaaatcgggcggaaaaagacggacgaaaaaaaagggtgaaaaaaatcctattctgtgtaaagaaaagggcgaaaaaaaaataaaagaaccaatctgtccgattaaaaaaagaattaggcaaaaaaaacccagcgaaaaaaatcaggtgaaaaaaaaccgggcaaaaaaacaacgacgattccgtgtaaagaaaggcgaaaaaaaatcaatctgtccgattaaaaaaaaggaatggaaaaaaaaccgggcgaaaaaaaatcaatctgtccgattaaaaaaaagagtcgggaaagaaactgagcgaaaaaatcaggtgaaaaaacagggaaaaaacgaatccgattccgtgaacgcagtaaaaaaaggtgaaaaaaaataaaaaaacgaattctgtccaattaaaaaaaataattatatgtgacgcggtaaaaaaattcgaatcctattatacgtaacacggtattatatatctatatcttctctatctctatctatgctacttaaaaattgaaacgtttccatcgttcgtaataacgaaaaaagggcgaaaaaaaatattaaaacaaaaaagaaagtccgattcaatttactttcgttgtccctgaaaatcttatcttatcttaaaaggtccaggccgctcggtgctcatcgttgtttgcacgcccacctagccggaccaccgatgtcgtggcacagctttgcgccgcccttgggtgcaccctcagcaggcgaagcaggagccgctcgttggtcaacaccgcacgcacgcactagctcaccggactgctatcgccgccttcgtcgtcgttccgctcgttcgtcaccggagagaagagatttgggagctagggttttgcccctctcttccggtcggcacttcatccatcatggggacaatcggagccgtccattagatcgaacggctcagatttgcccagcgttgggcctctaccgctgctgattacgctacgcccaatgggccgccgaagtacatcgaaccatccccgcatatgtgggccgcgctcagctgctcggcttgcgggctgtcgaattgactcagctcgccgaagatgggccagcccaagtttgggttggctaggaagacctgggccgaaagcaaatttgatcaaacaatgtggctcatattttttaaatcaaagtccgtcggataagctcctaagtaggctcgaaaaataaatataagactaaatcataaattctatgctaattcatcaaattagactcggttctacctatttgttaatatatcaaattagacttagatttttaccgatttgaggttttcaaggtgtcacactatcaaatggtgttttacccgttgcaacgcatggacactattgctagttaaacttaaaatataaaatttcatgatatcccgatactacgatacgatcctacaatccgatactactttaagaaaaatgatactatctagaatcccgatgctaacaaccttgtgtgtagatagcattgggattttacgcgtgacatgtttaaaaatttcattctagcaatattttctcttaatgcataaatctcgagatgatccgatggtcacaaatctgaaagttttagggacagtaaacttatgaatgttttctagcaaatttggaaaaaaaaggtataataacaacaaaaatcaaccaaaaaagatttagcactcctcacacatagttgattttttggacaagtttgatacatcgattcggatttaggagcacatcacgtagcgagaaaatttcgatcgaaatagtaatcccatagaaaaacaaaagattattttgtgcttcaactcaggcatataatcgctttgggcttgtctgcttagccacctgtatttagtcagattggcagcagcttaatccgtcggctaaattagtaatttagtaccagcgaaacttgctggtcatattgttgacggcctgaatctgcaactcgaggacgcggatctgcctgcgcttcgccgccgcctccgccgccgcgatcacgagctcctcgacgcgcgcatccttctcctccgccgccgcgagcacccgcgcctcggcgtcgtcggcgcgggcctcggcgtccagcctccgcgcctccaccgccgcccgctccgccacggccacggccagcgcgcgctccagggcgcccacctcctcctccaggttcgccgccacctcccccaccagcagcctccgccgcagcagcgccgccgtcccctcctcgccggcgtcgtcctccgccgccgcagcagcgccgcctctgagcgaggccagcaccgacgagaagcatgacaacggcatgttaatccaaagacggcggcacgtagagaaattagtcaaattatggaaagtgatgagcccacgggcttttgataggccgattattatgaaggaatccgagtccaattacgctgcgaagtaggccgtggtgtcccggtctgaaatagattacgtttatacgcccagcccaaacaagggagcgaaaatggttccgactgtggctcggatagtatcgcggatgtaacagaaaacctagacaatggtatcccgttgaaacaagatactcttttatgagacagtaaatgatacctgttgtggtacagttgcatggtacccgatacctgtgatacctgttactcggtacctttgatacctaggacctgatacctgtgatacccgtacaagacaatagttaatatgtctattccgttgcaacgggatcctgttttgtagcagccctccggatgcaaatatggaatattgtaccacttaccgatggagagagactacagaacgggatcccgttagaatggaaaattttaagtgacttattccctgtcttccagtgagcttccacatgcgttcccctgacacctggtaccttgggtatcagagtatctgatacctggtaccgactggtacctaggtatcacagactttggtatctgggtatcaggactgatacctggtagagaagataccgggactggggtgccgggatcgccggcttcttttgcttctgcggtggtggtggtggcggtggagccacctgcgctcattgtagctccctcatcctcctctggcgcagcggtagccaccacagctctgcacccacgcacccactagctcctacttggttcttgcggcaggagtcctcggtgacgcacggtggaggcagagcaggggtgaccagcggcggctgttccctatccctgacgatggcgatagcctagcgtgggcgccatgcccatccgatgagaagaccgacgagggcggggagccagagcggtgcagcaagggaggcgatcttgagggtgacctcgccgaggccgtgccatcgtcatcctccttggccgccatagacgacgacccctttctaccgtccggcttcatctccaccttcttggccttctcccaaaagagagagagtggaggggagatggagacagaggggagtgagggattcggattatcccgtggagaacgggatccagtgctatagatttttctcattattcatcaatggataggtaagaaaactgtcgacatattttcttttagaaatgtgtcacatttttttatccattagcctttaggcagtggcggaggggttgcctcacttaatcatgtgtccataccaatggagtcatatagaattttcatgtaatattgtactaaataattgcgcctcccatcaattattaaaagagataaatcaatatgtgatgtcaattgtatcaaaagaggagtacaacgattaaaagtactaaccaatatgagtgaatccattataccagcctagtagcacctgttcggcttggtggtctgcaatgcacgcgttgggctttacatcttcgtagcttaattctccatctaggggtacacatacatgagccaggggtgcccacatggtaattaatcactaattttactttcctacccgggttcttaggaacccctcgggactgcatagcttcgctccagctttaggcactgctctctctatcctgcagaaaaccaatctagtattcaatggaacgtttcttatttaaatttattgtattagaatatttcatttaaagtatgttgttttttagatggaggaagtagtgttgtagcagcgttattgtgacatactccctccgtcgtaaaaaagataatttaagattagatgtgacatattctaatactttttatataaagtcgttgtattaagatatgttatatttattcccaggtttattttgtgtttgacggaaggagtatcgttttcaagaaagtgctaaagcggttacgatagccaatcaatccactcccaacctggactcgctattccaccttttggctaaacgtgcccatgcactcattacaaacgaacaagtctcgacacgtaggctctattcagattcaaacttttttttaaagaaattttaacttttccgtcactacgtacctcttttccttctctcggtgacaactgactacagcaatgacgcaacgtcgcctggacatactagcctcgccacaacttcaaatgccccacgacatccacacacatgcaatccatcgagtacactccactgcgcacatccagccgagctagctcgcgcgcgcgacacagctctcctcggcgagacggcgacgtcgtcgtcgccgtcgttcggtcctacgtcggcgggcatgggaggtggccgtggtggagctccggcgacggcgagcgcgcgtgcgcggcggcctcatcagcctcgcgtgctgctgctgtgcagcccgtgcttgggccacctcatcccgttcgccgagctcgcgcgccgcctcgtcgccgaccacggcctcgccgccacgctgctcttcgcctccgcgaggtctcccccctcggagcagtacctcgccgtggcggcgtccgtcctggccgagggcgtcgacctcgtcgcgctgccagcgccggcgcccgcggacgcgctcccgggtgacgcctcggtgcgcgagcgcgccgcgcatgcggtcgcccgcagcgtcccgcgcgtccgcgacgtcgcccggtcgctcgccgcgacggcgcccctcgccgcgctcgtggtggacatgatcggcgccccggcgcgcgccgtcgccgaggagctcggggtgccgttctacatgttcttcacctcgccgtggatgctgctgtcgctcttcctgcacctcccgtcgctcgacgccgacgcggcgcgcgccggcggcgagcaccgcgacgcgacggagccgatccgcctgcccggctgcgtgccgatccacgcgcacgatctgcccagctcgatgctcgccgaccggagcagcgcaacgtacgccgggctcctggccatggccagggacgccgcgagggccgatggcgtcctcgtgaacacgttccgcgagctcgagccggccatcggcgacggcgcggacggcgtcaagctgccgccggttcacgcggtcggaccgctgatctggaccagaccggtcgccatggaacgggaccatgagtgcctgagctggctgaaccagcagccacgtggatccgtggtctacgtgtcgtttgggagcggtggcacgcttacgtggcagcagacagctgagctggcgctcggattggagcttagtcagcacaggttcatttgggctatcaagaggcccgaccaagatacatcgagtggagcattctttggaacagctaatagtagaggtgaagaagaaggaatggattttttgcccgagggattcattgagaggactagaggggtggggcttctggtgccgtcgtgggccccgcagacatcgatactcgggcatgcatcaattgggtgtttcttgacgcactgcggatggaactctacgctagagagtgtttccaatggagtcccgatgatcgcatggccactctatgcggagcaaaagatgaatgcagcaatgatggaggttcaagcaaaggtagccatccggattaatgtcggaaatgaaaggtttataatgaatgaagagattgcaaatacgataaaacgagtgatgaaaggggaggaggcagaaatgttgaagatgcggattggtgaactcaatgataaagcagtgtatgcattgagcagaggttgttcaatcctcgcacaagtcacacatgtgtggaaatctacggttggttaaaaatgaaatgatcagtggaaatcattttgtactgtgtttttcatattgcaaatttgctttggttgaccttgtgaaatttaatgcagactatttgcactacatccggatcaatcaaatatataaccaatagatgattatatacttggtctcgagggcagggacaaggctaaaatagtttaggacacttcgattgtcttaaatcaccttgaaaattttagagaaaattcataattcattagttcagctccagccgagccctaagtattaagtaatttctagtccgccctgtttggtctggttcatatatagacaggtaaagtctacattattaacgtctcaataagttgttttagaaaaatgcgtttctcattcgcaaaacatggtatttgattgagcaaaggttgttcaatccttgcacaagtcacatgtgtggaaatctaccgtgtgacttgcacattggcaaaacaaaggtaattgatataaagtcaacattaaagtctccagtgtgactttcgctgttgcaaaacatggtattttattgagtaaacttaacattaaagtcgacattttacagtttccatcggttgtcttagaatcgtgcgctttcgcaaaacatggtaaaaaaaaaagtctgaaaaggcatgttaagaaatgccagtaatttttatctgttaaatatatgataaatatgcctatcgtataggcatgaaaatagagcggatacggacgcataatgcccatatcatatttggtttcattttttttgccggatatggaaacgaatacggatagctcaaatacggaaacaaatacggattatctcgaatacgaataagaatgaaatatgatcggatacgaatacggaaacaaatatttctcagaacatgaaaagcaacccaacttctaatagaaacaaatatcaacatatataattagctcatattatataaactgtagtataatttataaatattttttaaaaattaaataatattaatagtgtggactagtgttaagagatgaatcactattaaattttaaaaaaggtatattaaaggttatagagttataaagaaatatggtatgtctaatggcttctacatgtatctgaattattatccgtatctgacggaaatcccgatatcatattcgtattcaggagaaaatatccgtattcgtatctgcatccaaactaaccgagaattatccgatccaaaagtatccgtattcgtttttcttcgtagcggacggaaactatccgttccgttttcatcctactctcgtaacctccaaaatttgtttgttctttatgagtgacggtgattttcttcttaacttcactggcgagtagagagcagagactgtatgcacggtagtggtactacgtatttcagatgatcactcgcaagagacgatgaacctccagccatatattcgcggccaaccaattcgttagttgtaattgttctaaaaaaatcgttgtaattggtcggtgtgccagtttttttttttttgtgtgtgtacaatgaatttgaaagctcactagtcaactctgattaattgccttgatggaattcatagattatataatatactagatcctagagattcacaactttttcaaagcacatgtatctcttcctcgtaggagcaattttcttattttggtgataacactgtatagttgactacaacattgtttttcaattcatagtactgtactgcagtaaaaaatagttgtcagattttacattaagatgtctaaggtttgactgacaatatgtttaatcaatcaatttttttagatttttaatcagatgtactttactaatatataatatattacctttaaaactactcactttttgttgttgctttaacaaatagagtaaattttaccatactataagttttatgtccaagttacacaaaatcacatgggttttggtatatgatgtataaccctgggtattacagttcaaaaggattacaaaactacaccattatctaatttaacttgttattgtagcaaaataaaaatgctagtatgcgacgagtcaaagaagttgtaaatttgatatataattttaaactcctaaataatggtggatcaaagaatactttgtcaaattaattaatgtgtggttttataaaactatattatgggttatgtagcatgtgccatgaaccatgtggttttatgtaagttggatcataatacttgtgattttataaaatttacttaaaaataactattaaaattcaccagttctgggtcaaaactaaaaggttattcaaaattcaatcgtatatatatatagtaacaagtgtaaactggtactattataaccactggataacacatgctaacatcgcaggctgccaccgaccttgtccctctcttgctaccttcttctaatccccaccttgccttatccttcagcgtaaagattcctttgtagaaatactttatgactttcgttgagaagtgaattttagtatatgacgccgttgactttttgtccaacgtttgaccattcgtcttattcaaaaaatttaagtaattatcatttattttattgtgacttgattcgtcatcaaatgttctttaaacatgacataaatattttcatatttgcacaaaaaatttaaataaaataaaaggtcaaacgttagttgaaaagtcaacgacatcgtacattaaaatatggagggagtatttatttgttgaaaatgattgcttaaacatgtgtgcacaagataaaagtgccaagtgaacataaacagagggtacacagtctttggtctactaatttagaacgtcatttgcactgtttactgcattatattttgggtaatgaaatgaaactagtactatatatggagtatgtggtaatgtcgcggtgtcatctgatattaaaaggaaacaaccaaaagaggttaggttaatatatattttggcgataaaacatagaataagatagttcttggtcagctcgttaatgtattctttcaagaactacatcacaccactattaaacttagtgtaaaataacaagagtcggtagcagggtgatatatacataagatcgaaacatatggtcatcgaggtcagcttgtcgtgaacaagtgcctcccatgatgtagcacataccggtatgcagcaaaggatgacggccgggcacgacagtgcggtagaggatgacgaaaatgtggtgtgatggtccagatgcgacggcagcgataggggaatgggtgtgacggtgaggacaaccgatggatgcgttgtgtgaagtaaaggacgagggtgttgagtgatgaaaagggtgtgtgatttgcgggattcatggggaatgacatggggatggaaaggacgtgttcaggggacgccagctacatacgaggtgggattgtggaaagtgaagacaatcggagacgctttagatggaccgtccaatgcaagtctaaatattggatgacaccccttatcctcttgagcacactttttcccactctttctctctctttcccatatctctatgtcatttatacgactctaccatatctcatctagagcagcggcgactcttaagctcagtggtggctcagcgtgaccagcttggcctcaacggcacgacgaactcaacctcaacatttttggggcagtgaggttggcctcggcttcctctgatagtgcaccatgacggcgatgacctctacgacctctccttcctcgatggtggtgcggtcagcgtcgtcttaattctcaacggcagcacggtacaacggcaacaaggttggccttgacttcctcgatggtggtagggttggcctcagctttcaccatgggccgttagcagcacagaagagagctccggtgctgagcccggcaatggccaaccactcacgggagaggaggaaggaggatcgggtactttttttttacgatttttttatgcttcagtccacatttttttggtgtttcattttgttggatcaaaatgtctaggtgggtattatggtggtgtttcacatatttctgtctttgtgtgtgtaatccgtggatgtctcaataaataaaatgtaacaccccaggtagccacatacctagagtgtcacaccaaactacactcaaaaaccactaactcccaaaattattagaaatttcagcagagtcacctaaaaatacagacatccacgacaggtagttataaaataactcaataacgataaaaaccacacaatccaacccatcctagctctacaaattccacgtaaaaataaggaccagaactttaaatgaccttcataagttctacgcaaaacttatctaagtagaaacataatctaaaactaaattttaatagtgtgcaataataatgtgtagttcaagggtgctactcccgtcccgtgccgatcaatatcattaggtacctaaaaaccaaattaaacacaagagtgagtaaaaatactccgcaagtataatattgaactagtaaaacatacacaggtttaatgcaataagaaaaccaatatgaaacatttgtcttcctttaatttaaaacgaaggaggcaaaaagtagtagttccctcccgggcaggtgtgaatatcctcttagcattaccgataagccgagcaagtgtgatcagctcttctcaaggatcatgaatgaagatccaaattgcattcccatgactacgcatggtacttgaataatgtaaacaaaaacttccgccagaagaatgaaacatgaataacgttgtgaacttgaacatgaagtgaaatatgaatacgtagcataataccaaaaccacataattgataatagaaaactttgaataataattggataaatgaaaccaaacaaagtaacacagtttatccatcacacaagtccatcttatacttgccttaactccttcaataatccgactcaactcctccaacattggaaccctccacacctgtggagcaaaactacgcataaactactatatctaactaataatagttacaaggatatttgctaaaatcgaaacccagttcatataaatttttgcccatttgtattaaatagcctatagctcttccattactgttttatgcgtaactcacaaaccgtctaatggaacctagcaaataatacaacttcggacatctagaaaaaattgtctaccactttcatgttgagcacaaaatcagattatgcctctgaaaatcccagattaaggaaaacgaattgctgtcctgatttccggacccggtcggcagtactgtttttgttgtttatcccaaactgtttgtcggaattgagtgaaaccagcggcgttagaaagatatcgacgatgactacaaactttatttaggacaactaacctgaatcacgatggtttaataccagatttgaaaatactattgttagcccataatcaacaactaagaaaacactcaaccggcaattaatcgatttccacgtgaaaattgtatttctatggactaagaggagttacctcttacccttacagaggagaaatcgaatttgagatcaatttgtgaaaacccagaaaatccccaacttttgcctctcttccctttttccttcttttctcctcctgctttccccgcttcctgaaactcctgttctctgttcgttccagaagcacagcaacagaccagcatcagtagcagcagcggggaacgttaacagaaacagaaacgtcaccaaggagtcgagcaggagtggcgctggacggcgatggctaaacctgtggcgacggcgcagcagcgattggggtgatggcggctagggtttgtagcggctgcagggttatcgatctcttccccttttctcctttttttctttttttttcagttggttaaatagatatcctgatgaagatcgaatggcccaaattaatttaatcaccagtacttcgttcggactccgattattataaactcatagtctattttgcactactcggcgagctctacgcatccacggttcctgatcgcctattcgaacaacggtttaaaaattaaacttttgcgcgtttatgctaatattccccgaaatatactattttgaaactcggggcattacatgaaacctaaagtttcaaacgctacactaaaatgtttcacggcgcgagtcaattgggtttcattgtttctatttgccgaaatatttctgtttgagaacagaaatattttcatttatgaaatgacacatttttttcctgattgatgaaacatttgaaacattttgttcatcaagtagtgtaacatgtgaaacatttcgtaacaatattgtgcaacaacatccgatgttttgcataatatcggacgtccgatttgtagcgctccccgaagacaattttaagcgttgggtttcacacaaataatctaaaagtgttgagtgatgaatgaagaatgaaagaatgtaaaaatgataaatgagttagtgatttattggatagatattaaatactagttgtagttattcggggacatccggtgaaaacgagctaagtattggaaaccggtaaaaatcatacttaaaagtttcataaattcatgaaaaaaaatactagatctaggtgtagatatgaaatacattctcaccaaatctcaacttcaaacttaactttgtttaggagtaacaaaaagacaaattttaagtgaataataacatgacactattcacctaaaatttgtttcttttttttctctaatgaagtagagtttagagttgaaatttggtgagaatgtatttcatatctacacctatctctagtattttttcatgaatttacaaaacttttagatattattttcatgagtttcgaacacttaactcgttttcaccggatatgttctcgtagtttatatacgttcatgatgacaaataactttgcttgaaattgaagttaagagcacttgacagtgcagtgagaagagatatatagtttcaactaagtctcgtgttcaatcccgaatacactcatattttttttctcaaaaatgtttgaagagacgactcttactctaaatctctcttttttttaaaaaaaaaatactccctccattccataatataagacacaaccgcttttattagatgttccataatataaggcatgcatgcaagcatgcaatttactatgacatcttctctattaaattactactccctctgtcccacaatataagggattttgagtttttgtttgcaacgtttgatcactcgtcttatcaatttttttttgcaaatataaaaaatgaaaagttgtgcttaaaatactgtaaataataaagtaagtcacaaataaaataaataataatttcaaaattttttgaataaaacgagtggtcaaacgttgcaagcaaaaactcaaaatcctttatattatgggacggagggagtacttttttaaatcctccactctcatgttatctaatcctattggatacatgcattatatttattaggatgatccaaactacaagatgataatctttggattaatggtggttgtgtcttatattttggaatggagggacttatattttggaattgagggagtacatgagagttaagaaaagacaaagtctcaatcataagaccatagtaaggactgcggcccagtggaaacggatatccgcaggtaaaatgccatttttcatggctggaactgagaaggatatccattctactccagaagtccagaatcgaataagtaaaagacaaaatcaaaaattcagaccaaaaaaaaaatcagagaaatgaaaagaggctgagcaacaactcacctcacggcggcaatgggcctcctcgtccacctccccaacctcgccggcgcccgccgcccatcgccgtgcggcggccaccggagggcccgcggcggcgcgcggttctcggtgtccgccgcggcgcccggcgggggcgtcaaggaggaagaggaagaggaagaggaggaggaggagaaggggacgagggggaaggagagaatagtgattcgggtgtcggacccggtgcgggagaggcggctcccgccgccgctcttctcgtccccggacgccccctcgccggcggcggggcggcggcggaggaagggggaggacgaggacgacggggaggaccggcggcggcggtaccacgtcaacgtcggggacgccatccgggcgctgcgggaggagctccccgccgcgttctaccgggagcccagcttccatatctacaggttcgtgaatcgtgagtcgtcgacctagattcccatgctttcccttgtcgggggatgatgatgattgttgatttgcgttgacggtgaaactgtggcgtagatttgacccttttctcagcgcacgagtggcactctaatgtgctctcttaagtcaaaaattggggagagaaaaatggtgatttctagtatactttatgaggtgttcttaggccgaattggagagatgatttgcaaaatttttgatgttttagtcgtgtcgtggccatagctaaaggattgttatcaggacttagataacatagtcaagtgcgatagagtctttctcagtggtttagtggtgtggttagaaaggctatgagttataaaaagtcaatcactcattatcttgttggtaaaagtactggcctcattatttttaattattaatttaaactaggaaggtagcccgcgcagatgcgcgggcaccttatttagtgatatttgaaattttgtaacgaatgtttatatataggattgtttttaaaaaatattttttactcttctaaatctatgtttatcaatatttttttggattgttttgaaagtcggtttcaatcactggatgtacggacacgcgttaagaaggtacatgctcctggacatttgtctatatgcttatgtgactatggaggtaaggtggaccaacatggacgtcgggtcctttaagggggtttatgtgacatcctagtgcaattaggatgtggtctatgttttttttatttaaaggatatgatctgtgttgtccataagcattgtgtgcacttgtgtccataagaatgaaagtgtaagtgatgtgatagcgtaagtgagcgtgccagttggatgcatgctgagctgccttgttttgaaggacgggttgttacaaattgtaaacaaattaaatcacttaaatttataagaaaaatgtctcaacaatagagttggttcatatgaaactatcattttatactactgtgtttttttaatttaaacttttaagtaatattttttccttgtatactaaacatgtctttgtagattttaggacaataatttaagaaattttctattaaaaatatgataatatgacttctttatctaattaaagacatactcacgtacttatatttacttctactacctacatccataaatcgaaggattcaaattttatcctaaaatataagagatttttaatactactcatttcatccaaccatttttcatttaattgttatccaacattactctaaccatcttctaactctttaaataccccttatttaatgatggatatcttagttttttttttcattcctccttaattcctataaaattttagaatccattataggatggagatatatagtaataaaaaagagcttcattcatagacatatttatttgtacctttgagattgatttagctttacatatttgtataggtaaatagacttcgtatgcaagttgagaaatataattaagttggtagaaagtcgttagatatctaatggtataaagtaattagtacacaaattttattaaaacattaaggtggattttttggggggtaatttttaggatcttttggttaacaattgttgtaaggaaaacaaagaggcgttggattcgtctcgtccatgaggagggaactgtatacatgtgttgtacatacgcactctgacgaactgatcgtttggtagggtttttttaagatatagatctaacagtttataacggtttaaaataagatccatcggtttgggtaaaataattttttttccttagaatttcttatacttactttaatttattagagcgtcgtgtggtagcttagaaatgtttataggaagccatgtatacagcttaagagcatttgtaagatatctaatggacttttagtatataataatagataattcatgtcatattaattaatatatcaattaataattaattttttttataatttttttatgggttcgccactgaaaagaaatggtatatatcaaagtgatatccggataattttttcttacttcgtcactgaagggtatattcatccaagtgacataataatttctatatagaaacatatgtaccaagagattatttttatatactgtgtatttggttgttagcttaaaaaataggaaagaactcggagagacacagaagggaagagtcagagggagggggtggaatggggtacgtacatacatgtgaacgcattatgttttcttttcggaacatataatacctattgaaacgggaacgtgcagatttttttcttgaagataagatttaatggtgaaaaaatttaattgtttaaaatattgggtctaccggtctaaatgaaagtgccacgtagcgatgtaggagcttttacaggagtgccaccggacataaattaagtacaatgagatagataatcgtacatatgatgcctataatgtctatccacttaccataattatcaccgttttcactctatattagttagaaaccatagttaataaatagctaatttttatcggtttaagtcattggattatttatagtttatagttaaagaaatatgttattttgaattttattgtgactttttagtatcatttaaacaaatattaaaaaaatgaaaaaaatgatatatatttgaccggctgaaaaactacatatcaaatatcatatgtcgtattctattgtgcactaaattaattatagccaaagtaagtcatgaatgtaaaatcacaacaaaataaatgataattacgtattttcttttagtcaaacgaatgataaaagatactatcaaatataaaaaggtcaatagtgtaaagaccggaggtaatataaatatattatgagggaaataaaaaaaagagggtgaatgaggagaaaagaaatgaggagtccggtacctacggtacctgtgtacgtacgtgtgaggttcacgtacacgagagagagagaggagagggagagattaaattctgtttttaatctaattaaatctaatggtctaaaataatggacccaccaatttaaatgaaaatcgatggctcgatattcctaatctattagaacgccacgtggcgatttaggagcgtttataggaatgccacatggcggtatgagagcgtttgtagtatgtttaatggacttttagtatataatagacttgtggaactatgagagaattattggtgtggatgccaaaaacacaaaatgtcacaataaaactttggtatcaaggtgttcttcttgctactactaattgagcaaagcaaaatttcaattttattcttagccacaaaatattatggttttcttagtccacacatgctgtctgtgaagcaccaagtatggaaccagcacccgattacttcaatatcctttaccccaactttgccgcctgtatttcttattcaaagttattatttccagactacaaaaaaggcccattttgtttgttataaaccacgctcaagttaagtttagcattaatcctcagcttattttgaatggattcaaattttcctaattacatttgatatacctctagagggtatcagaatccatacgcacattaccaataaggtaaggagacattacaaattgtaaaatacagaacgaaatgtttggcatcaatagcattatttcctctctttttttttttgcctgaagaagatacacttactcattaagaaatgtatggaggccattgcttatatcaacaaaataatgtggtaacttcttagattagcatgttatttgtacacaaactggttgtgtcaaggttttctgcagccaaatgagggttgatgatgtcagattgtcagatgcagcccattatggtaccatgaaagttacaatatgggattccatggggcagcagctacatacaacttgctagctcatcaacagatggccaacaaatgagaactctctgcctgttttcatttacttcgcacgttaacttactactccctccgtttcatattataagtcgttttgacttttttctagtcaattttttttctagtttgacttagtttatataaacatatagcaacatttttaaaacaaaacaagcatactgtcaaaatatattctatattgcatttactaaaactaatttggtgttgtagatgttgcttttttttttacaaatttaatcaaacctaaagaaatttgattaggaaaaaagtcgaagcgacttataatatgaaacggagggagaattaaattgtgactactactaatttcatatttattctgtttagatgaatggaagtcaccgttggatttgtgatgcaatgcactttagtactattggtaaaagaacaacatatggtttacatagcaaaaacaagtgtcaagtatttggaaacggaggtcaagtatttggaaacggagggagtgtttggttaggttggtcatatacagaaatacaactgattgactggtggttaagcaatgaataaataactcattcaagactgcccatggttttctttctttggaaggctattctagggctactcccataatctgtactcctttgactaggattgttttatttttgaagtcacctttgcttcaataaatctccttttgtttatcttgttagccacatttttagttttgtacttctatgttagcttctggcttttatcgttcaagctacttgaaagatgttctccattctgcttgataacaatgtcctgtgctcatccatggttagcgatgctatctctggtccatgacaaataaaccttttaggtcaatgagcaaacaggtgtaaatattgatatataagcacatatcggttagaaaatctactcatcacagtaatagaattaggatagtacttgatatcgaacaacttgcttgtatgtcatgcacactgcatattggcgttcatgtatgaagaaatcaaggagtggccactcatgcatgctagtgggtatgtggaataccagatcagctcagcattaaaattctttgtgaagtcttatgcaacataaaacaaattcttgctagttgtattcaagcaaacttacaaatatcaagacctcaaggttgatttttagcagaatttagctatgtaccagaacaaattttatctatcatggtatattcatttctgaaagaagatgcaatccttgttagttcctaacctgctgtgatactgcctccagagatgatattgtcttcaaagatcctatcaataatttcacgggtattgataactacaaaaggatattctgggctctacggtttactgggcaaattttcttcaaagcactatggatcgacattatcagcatatggcagcctgtcgaggatgtaatcatgatccgctggattgtccatggcattcctagagttctctcggatggccctggcagatttgaaggcacctcagagtataagtttgacaagaatgggaagatctatgagcataaggttgataatgttgccaagaacacaccaacgaaatttaaggtcttgccagtcgtagagctcatcagatcacttggatgcccatctactccaaaaccaacatattttgagacgtcgtccctacagctaatatcgctcttgccattctggttcaaattgacttggatgagatgctacttgtcattgtaccttatcctagcaaatttatcaaaaggatgaggatcgatggttgaggtccaacccaatgcctctaaattttgcccttccattgtatggtagtgtatacctttgagcagctcgccaatacctacatgtaaacgattttgtttgtgtacagctcaaagtttctgtctaggaatgtaggcatagctgaagttattccaagatcttggctgagttttgtaagctgtatattgccccctacctgggtatgtaatcaacagacgaggcaagtaaggaaatcttacatgcttgcacgttgcctgatactgaactttttgctatcgaattgcaaaaggttttataccaaaccaattaagtgcttgggctgtgttcctgtgaatgatctgaagatattttgggtattatgatcaatgagcagtgaagttcagttacagatctaagatgtcactgtcctttttttggtctcaaggaaggggtcaaggaaagcctgcctttccatcactgtctgtcactggcggagagtatagaaagtcgtcagcggttgcattatccataactatgatcttgtctaatgtctatgtcagccaggaagactggtttgtaatttgttacttatctcttgaagctttgcatgcaaaactgggttgtacttgaaacttctgatattacaactgaaccttgcaatctttattagtagcagatatggatctgaatcatacaaactagcatcaaatcaattagcacatgatgaagctgactatgaactcaactgaacacctctttcaaaacatgtgccatactgccattccacatgtagtacctttccaattcttgtttttcataatttggaagctactaaccccgataaccctgcctccaaaatccatactgctattagtgatgtagtaccttccatttcttgtttttcctaatgttttctcatgtaataattcgtgatatttgggttaatttgagacaggcttttggttggtgtgtctatgtccataaaataaatcattaatcataagcttttctaagaagaattggcagacctgaattacaagatcagtagaacttgatcagcatgatctcttacaaccttatacttaagagtgaaaagaaacaaacaaatgaacatgatgaacatatatcatatatatggatcatagctcacagcaacacaaccaaactagacaagacaagtacgtagtaaagtatgctttgcaaagccctgtttgaaacgcgagaatttcagagagatttcaccgagaatagtttgaattccgacgcgatccaaacaaaaattcttgcgtccaaatacaggagcctagcctagttgtactcgatcagaagcaggggaatcccccgctgatgaccgccgccgacatgccggactccctgcagaggcagtccagcttccaccctggcagctcgccgccgccgccggagcccggcctcttctcgctcgacgcggcggtggacaacggcaagccaccggacgatggcgtcctgcccgcctcgcaggaggccgcagcgccgccgctcgccgacgccgggacgacggcgtcgtgggtgggctgagatgatgatctctccggcttgctgctcttgttggcctccatggatggctaatggctttcgcctccttcttcctcggttttcttggtttggttggtttgcttgcgaattgcgagatcgcgtgcttcgctagcgagcgactgtgtgcttggttggtgcgatggaggagagggtggtgctattacaagggtgtagactgtagagaggataaggatgtgcatgaataccatcaacgagatacacggtttcgccgccacgtcaataataaatggtagtaggttggagaaagaaactagtattgtactccctccctccgtttcacaatgtaagtcattctattctaatattttccatattcatattgatgctatatacattcattaacatcattacgttgtgaaacagaggaagtagtagtaacatggtgaagatcaaagttagaatatactagaaaacaagaaaaccattagcataatatataataattaattgagtttaaattattacataatttgaaaattaaattatctgatattttatataaaaagttttcgtacgaaatacaccatttaatattttaaaatgtgtgctaatgaaaaccaaggtgaaattttatatctttataaaaaggaacatggttataagtgaaaattttcttcttcacgttataattaatttctttgaaaggcgagacttgtttttaaaataaaaaaaaaactagatatcaggtggtgggagggcctatacgagattctgttttttcctctagtgccttcgctttttttccatatgcacatatttcaccgttactattttcgttgaagctcaattcatctcatctaagttcaaagttgcatcctatgaaaactatccaaatttgaatatcacattcaaaatgttacatttcctacgtaaagctgtgggtggggtacaaagttttatggtttctaaatgaaaattttccactctatagttttttttttgagaactccactctatagtttgatatgtattctctaatcaaaatggttctcgtatttactagaaattttcaatcagttttctacttttcttttttattttacaaacctctctcaagtagttatcaagtgagtttagcaaagaaaccgtcagtactgagatacaaactattctattcgtcttaaaataatatagctaccatatagttatattatggagtatatattagctaccagatagttatatatattttagaatggagtaagtacgatacacgatgtatatagagtacacgtggtcttctacgatggtctgactcaaaccattggcgccgagggagagctcgtgcgtgcttgcgaattggacttggccgcccatcgctgtagtgtgggaggagaagctaattcttataaaaaaaaatcacacctatttagtatcaattagagtgacgttgaatgctgcaagaaatgcactccagttgaatggggtaaggtgatgatgtgctgctgatgtgcagatggcttgtctttgtatcgacagaagggtctggacatagaggatcaagtcaattatgtcagctcttactagattaataaagagacgatgttgatatatacttggcagatggactgtactcagtgtgacaatctgctcatgttgtgtgcagtctgaagggagaagcagatagagaatagcagccacaaaagatattggtttacagttagtaaaataattttcgacctcctaacgaggggaaaaccatttgcttgcctaagaggaaccaatcctttgtatcaaagctcttcatgaggattcagtactgtttacagatagtgccccaaatacaaatgctgctaacttgtcgactgaatgaatgacacaatttattgtcaaaacaaccaagacaacacaagggggagagtcatttgtacttttaccccatgcaggtggtgcacataaaaactttaggaacacaagttacacagcactgctcttgcagttaaagaaatattaaaattcaaattaacatctagttactttttgttgacatatacgccgcaaaagtatagccaggacagtttgcccaggtaccctctttctgctatagcctacaaattctatagaagcatctaaaaaacgtgtaaaaagaataaatcagatcatggtcctcaagatgttcaataaaacactagtcatcaacattgtatttcagaccttctggtcaagctcagactgtgatgacagtatattgtgtttctgtgttttctcgctgggtgctgagtaaacctggcgctctttgcctcctggtttcgatgaagcattcccataccaaatcatgccaataacagcaaggatcatgccaatcgcaacatggaagttaaggccctcttttccaaagaaaagaaagcccaaggtcaacacaagaaccgtcttcatgtggcctagaacttggaacgagactgctgtaaatcttccgatgcatatgaattggctaaggttggtcccaacagcaattatgcacgacagtatgatgaagaactacaatgcaggtagatgaaaaaaagaaaatgttaggccctgccacgataaaaatagtaatggtcatggcaacaacagattataaaaaatatatcctccaaatctgtcacatgctcctttctattttattcatagttgaaagaaatgcttgtctaagaagcatctatagtatgcacatacaatatttttaatggcctaaccttataaagcaataaagcattaccagtaaggcgttttttagttcatacacttctctactattagacacagcttccgtatttcaatgacacatctttttagtcagaggaatttacatggttgtttcataaatttataattggttgatgtgtgatattgggtatgtaaaagctatccatgtgcaattctgtgtttatgcatgattacaccttttgaatatgacatatttacaagaattttgacacaataagcatgcacaaaggagatagaaagagacattgccagtacagaacaatgcaacaagtacttcagaaaacacatttcttaaaagaacatgttaaaggtagcggtaaccttataccaaacattatttatcatagtcctcattgctttcaagcctacttgaaattcttgaaccaaaccaagggcctcatcgtttgccctatggcttataagccaaagccaaaatttgaattttaaaacttgattttgaatttgactttgattcttttttaacgtagtttttttttcaactttggcttttcaatcactaagaacatatatacaaaagttttactcacatatcattttttaatcgctaataagccgttatggcttataataaggccctattcttttcttgttgtcttttctccaacaagagttggatgaagattaagattttcgtggcacgcttttcaaactgctaaacggtgtgtttcgtgcgaaaactttttatatgaaagttgctctaaaatatcatattaatatatttttcaagtttataataattaaaactcaatcaatcatacgttaatgacacctcgttttgcgtaaaaaacttaatcttcatcttcatcttcatttttaggacaaaagaacaccacctaagactagaccgaccgatgggaacccaagcagaaaaatgtttcaagttccaggatatactaccatatttcatggtaattaatatttacctggtgaaattatcagtagagctatatgggtttctaatgatcagtttataacaagataaacagagaatcaccgcataccgtaactattgctgtgtaattgaaagtatcaactcttttgttggtcagccagaagtccacgaaaggccccagtactagtaaagatgctgcctgagctggagcagtatgacccaagaggttgaatgagccaagcgagtacttcctttgaaggtgatgaacatactgcagcacagaagcaaagaaacaaaacaagtaatagtgttaagaaaatttgccatgaaagtgcgtagaaaagggacaagacttctattagcagacaaacgagcaatatccaaatatttgaagatcttttactaactaaacatttcttttctacacgattaatcagaacagtagttagatggaagctaatacattctttagctcaccaaacctacaacaaaggggacaaaattcaggtttataggatgaggcaaaatacacatgagttcacattaatggcttggaaattctgtagaagggaacaccacatactattttttttcaggtttgaatattaccaacttgggagcaaaagtatcaaagtagagacttagttaatacaggagaattctcagtatgtaggaatggggacaacaaaggcacaatctaggagtggcaatactcacatgctgttgtagtgcagtgctccaaaccgctattatggcagctatgagcccttgtgaattcacactaacatcagtcacagtacacacggcaacacctactagaacaaccattatactgaactttgtatctcttgagtatcggactttatcaaacaggatttccagaaagcacaaaactggaatgatgcataacttggcaatctgaaaaaggcatgaggagcaaattagtatatgcatccaattctaaaagtgaacattaaaggacttagttactttcttcacctggtagaatccaacagagttccacatcaaactaacattcatcccaacaattgataggtttgcaaaaaagacaaattttattagttctggcactggtaagtaggacggttgaatatatcccagccatttcattactaatgtcatcaaagtcgtggttgcaaaatgcagtccagtcaatgttgtagctgtacaagcaatagcacccccatattagtacaagcatgtgttcagtagctgagtttgttacagattcatctttccaagtgatcacacatatgagtaaataataaagcattatcaatttatcgtaccaaaactaaaaccatgtgtagccattaaggccttgttgaccatgatgataccaacagatgtcacaatgttgaacatccaagctccagcatctaatgctgcttttctctctgccttgcttccaggtgccatgttctcttgtcatgtagaatctaatccaatttggattttggagtatcacaatctacattagaaacatattttaattaagacatgagtttaataatataagcatatataaatgcacatagaaaaaacaagtgaaatcaatacgagtcactagtcactaaccctaaaatatattgagaaaactatttttctaccatagcagggacatgaaattagggaaatattgccacaaaagaagatctttatcaactatcatcctataaagatcagatcaaaattatgaaaataacaccaccgtttagttcatgtgttctctgtggctctgttagtgctgagaaatttacattacaagttcactgttttcagtaatgaatgggcgagggagagagagagagagagagattcagatttggagaagaggaaagagagaggtggctatcaggtgggaccaaccatcaagtgaatgtaacaactaacagaatgatattttgttaatctaacgccttttgcaacgtcacattccaacttgtggattttgcaattgtgttactataatttcatgttctgcggttcttaatttctcaaatactgtaatagtactgtttgattttttctggatctgaaatttcggaccttctgaaattcaaaggcatgcaataactaatgaatttgagcacaggtaaaagattcacattaatgctctttttttgttctgttgcaatctaagcattaatgctcataatggagaacctcaaaacaagagaatgctcaacaaaaacagtataatgcctttcctgaataccctgtaatttgtttggcataacaaatggtcatgcaatagacaaataatctaccagagtcatagacctatcttaaggcaagaagtgtggaatcatatttgcactaactaggtttcaggataattatgtggaatactctacatttcagtaatttttattgagcatcctctcattatgttcttccctattttcaacattaaactgtagactgttaatagaagggcatatagcacagtaattatactagaagtgctggactaacatgatacacggaagcctgcgtctgtcaagaacaggccaaatatcttgtgggggaagagggaacattagtaggaacagagaaaacaaccctcaagctgaggagggctcatccctgcatgttgtcgggcggctctgatcggccgatcagctaatgctagagtgtggctgaaaagccctttgtgatacttctcattaattaatttatctcctataaacactagcaacctttataacaaaacaaaaacaacaaggtgccgactcatgaactaggagatatacgataattagtaaaacggagatagctaattagcaatgcaatcaaattaaactggtaaattgagaagagataagaaacaaaacaaatctttcatctggctgtagacctacgcctctgagacttgcacccaaaccgacagtgcacattccataaacaagcacatcattatactcctcttgaaaggaggagctgtggttgatctacactacacccatcccctcacttgagaagaaatttcgtgtctagatctatgcaggtgcggatctaacgtgggagggctcaaatttccgtggaaacaaactgccagtaacacacatcaacactgcggccacacaggcaacaagaagccgcaaatcgggacgaactggaagaattaattacttaaaaattggagcgcaatgaatcgattcgatccaaccaccccgaatgtatttcccaatctacctacagacgccagcacacagcacgtgaaggcgcgcgcaaaggatgagggagggaggatacgagatgagaatggatacctccgactccaaattcggctcgagcgagcgagcgcgaggccggagaaggctagggaaggcgaggaggaggaggagccgcgactcctccgaacctgctcgccggccgcgcggcggcgcgggggagaaggctcgccgtagctccgccggaaggagggagagagagagagagagagagagagagagagtagaggtgaagtttgagggtctctgcagcgttggattggatcgatagatagaagggatcgaattgggtttcctgttttgctagtgtgacagcaattgcaggatcaagaacacaaggccaagattgctcatggtgacgagagtgaaatggaatgggtcatgtatatgtttttttttaagggaatgtctatatttgttcgcagaaaatctcaccaaccatgtttcaaattttgaaccgttggatatgctttaagattcgtgcggagcccttaaccctaactatctccctctaattccactctctctcgcgcattccgccgccaccgctcccatcacgcatttcgccaccactgcctgatcctcggccgccaccgccccaccacccgtctcgtcggctgcccggagggcatcaacagcgccagcgagaccccctccccccccgccggcctccttcctcctcgagccatcggtggcgagatgcccctgccatcaaagccggtccaccacccttctccatccccgtggctctggcactgccaccgactgccaccgacgcctcatcgtccgcccgattcgttgcctcacatgggcatccctctaaagccggtgaacccccctcttccccatccccctcccacccctatcccactcccgagatcctaacctgtagggtcctctgtcgtgctttcaccggcgttggagaaaaagagggtgccggagttggaggagaaggtctagagcacgaatcatgaagctcatccagtggctaaaaatctgcaagatttgggcatgcattttctcccgactgaaggttagcaattcccttttttattaatttatttttgccggtaacgtgaatgtggaaagagaatttggtgttccttattacctcccaaaataagggcacatctattatttatttaaaatttatcctataaataaaaaattagaataaatgcacctatattatttatataaaaattaaatagtggtaaggtagagcttatcttattatagcgctgcctaggaaaagcttgggcctgtttgtgttagctgcactttctttcagaatcagaagttcctttaaaaggtatagctgaaaatgaactagaaagaaagccataagtgaaagatttttagaagctggctaccagctaactgcttcttagaatcttaaactctactaaacatgcccttatatgtatagtggctttgaagtttatatattaaattatggtgtttaaaaattttattaatatttttatacaataattaaaaataatttattcaaatattatcaacgtaattatacatcgagtttgaaatatcaaagcttcgagaaatctagagctgcgttaaacaggacctaaatataatccacatagctaatgggaagcaaaccttaggagcacagtggtcattacacaagagttactagtctattcatgttattgctattgctataagaaatgcatttatttattttgtgaccgagccaatagaccatgggtgtgtataaatattgagcgtagggatgagattacaaagtgcatagttgggttaatattgagcaatacggggaaaatcatataacgaatgaaactcaatgctaaaaaatatgtgaaaaaactcaacacatttttctattcttgtgcctatttagttaaattttcgtatattgggaaaataattataccttcgcatgtagtggcaaaggcagcgtgggggcttggggggtctttatacccctacccctaatgattcattagagcccccattaaaacctccctaaaatttaaatctatatatctattaaaggggaggagattgttagaaggcccaaaaggctgagaagccccactataattttttcctgctccgccactgttcgcatggtgcttgtctgctgcatgccttcacaaaacaaattacggagtagagaaaatggacagtatggacatagcaacgagataaaatggacagtatggccatacatcctctatttttgtttaatgataacccaaaaaccagctctatataaacacccaccgttactggtcatgcttccccatgcttccattgcccacacacccagcctgccaatccaacccctgaagatcaaaaaaaaaaaaaagggaagacggcactttccaaatcttacaaattttggtacattggattgctacaagattagtacagactcccctaatcctgagttcctaccccccc

SEQ ID NO: 66006 - DNA, 1846 bp, Oryza sativa
ttttccttcctttttctcttgagtcttgatgggccgtcagcctatctctctctctctcgcgccacctccctcttgctgggccggcccaagccgcctccctcctcttcccgggtcactgacaggtggggcccacctgttggccccgtcttcctcctccagccggcggcaaccgccgctgccgccccacctcttccgctcctcccgcgcccacgccgcgccgctcccatgtcctccccacgtcgccgccctctccccgcgtctcccgccccgcgcgcgcgcacgaaatgggcgggatttgatttcgaatcccaccccactctctctatctctccaccccacgtcgccggcggcttcggccaccctcccggccacgtcctcccctccctcgcccataaaaaccctccctcgagctccctctcttgtttccccattcgccgttgtcagggttatggataccacatacctaatagtagttgactaaatctcggcaggatccaccacataccatatcttatacggaaactgacctcgagggagttccggttaaggaaagacaaaccatagttctacatggaaacgacaatgactactcagattgtatccatattggtttccctagttctacttagacaaggggacacctatgggtataaatacaagaccccctaggaggagacgggagatgaccacctcaatcaacatacacggaacaacagaagccacaacatacaagccaacatacgccaagacaagacgccggatatcaacttcagggataggcacggttagtcccctacggtgtctccagatactgtcaagagagacgaaagcactatctctaatctcgccgggcacggattcgaggaggaagactaccctgttgtcgactacgagtcagaccttcagactgccatgtcgacaacagttagataggctaccccaaatattgtactggtgtgattatggtgaataagagcaacgaccggcttcggccaacatgatgtagggttattacctgacaattcaggggcccgaacctgtataaaaatcctcgtctccgtctcttttacctcagtctcgtgtatatcctagtaccaatgatccccataccatgcaaataccagaattgcgacatcaaacgtcgacagtggcgcgccaggtagggggattttggtgcttcaggatttagacgagatgggtttaagagatggattctccaacaacaagctactcgacgacttcggctgtggggagatccaacaggctgtggggagatccaacatgtccaagtacatctttcgactagatcggaaccatcatcgtcatcgacaacttggtctatcgagatcaaccaagcctcaagcctcgtggcgtaccaaaagatgttagaccgtatgatgttgaacaagtacgcaacaaggtaattagtagattggttttttaaattgatctactaatttcgtagatacatccgacatgtatctaccaaggtacgcaatattttatctgcaatttatcgtacctatttagatcatacagcattgtcagatccatgatttattatgtttacctagagcatgttctttatacaatatttattgcgcgagtgtccccgatgttaaatcgactacggtctaacgctgggggctcgctctattttcttctgtataaatcatgcttgtttacggtttacataatgcctgatatttacatctgctcgttatatcctgataatgctagaagatccatgcagttttttaagtacatactcgatattatctgctatatgtcttgccttctagaaactatttttcaggaacaattgagcactcgagtaggttgtggt

SEQ ID NO: 66007 - DNA, 624 bp, Oryza sativa
catggcccccatcgaatctactacgggaggaaccctccttgttagaaagctcgtcaatttgtctccaacgtaaattacctgctttcctttaccctctaccccacactccttgtcaactttctccctcatgatgcttacacaagctgtaaatactagtatgcttattaagatttatgcatgtttaaacatattgtgtttgttgagtagcatgcacatcaagataatcaaaacaacataacatatctcaactatcaactcattatgtacaactcatcaaacttgtgtcagcatgattcttttgtcagtttactaccatgattaatctttttttttcatctaaattatgctttaatacttggcatctttcttcccagattgatattttttggcccataatcttttgctcctaaggttgtccctagtattgctcatcaattgcatgactgctgaatttgggtggccttatcttcattatgcagaactttgaaagtttaatttttagtagtcaatcaaaatttttccaagcgacttaccgcatgaactaaccaaaaacctgtataaaactagccaaaagcaacaagccaagtagccaacaatatagacttatgggactacctaaaaaac

SEQ ID NO: 66008 - DNA, 7549 bp, Oryza sativa
ctggcattggttgcttctggggatggttggtgcatgtaatagctggtaggtttaatatttacattacagaggagtggtccttgtggtcccatttacaaaataaaatggagataatttttaagtagtaacagatcattacgtttagtggttataaaaaaattggatactttagcagattaagtacttctctagaaccataaccccacccaccaagatacacacaacaaactaaacttcttagcccccaagaggatcatagactcttagtttcagacctttgtttcatctttcatttcattctgggaataggctggtaagtagcttcacaaagttcaattaaccatttagatttagcaacacagaattcaaatcaaattactcatttctgtaatcttttgtctgatttctctctaagattttcttttttgttgttctgtttccttctatccttcagtgtgtttctttgggaatcactgtaataggcgggacttgttctattcaagtctttaatgcattcattttctttgtttctgtttgagcagtggtttaattctgcaaaattatgttccattcatgcctcaatcgtgcccctccccgcccctctttttttttgcttcttcaaatatacttctctttaccctctattcactcttcacatcagtatattttggtccaattacaattttctttgctaagatgtatagcagcatacttgatgttcacccttctaagtgctcaccaaatcactatttgggagtcatagaaatatatctagctgttgggttacgaattgttgtaagacaaatctttgctctatgtggaaaaaaaacacttttaatatctgaacaagaccagggaaaacttatttcgttttcaagtttgatgtaatagacttctgcatttggctgatgatatgaccagagctccactttaacagattgaagtgaatcatcttaggggtacatgaaacaggcctacatcaactatgaatcagcttcgcaatggaaaagttccccaatatctttcgccagctataactgtagtaccagaactctctgaagttacatttcctagtttttcagagcatagaccatcctatatcgaaagggagcagtgtggtagttctatcaactcatttgatgcttctactccaatgtgtatgttagcttccaactttacatcagatctttatatcaacaaaagtgaatcacctaacggcaagctttcttctgaatcatatgctattgatacctctggatgtgattcttccttgccgccaacacagtcattatacaagggtaatccaagttctttaaggatggtttatcctaaagtatctgaacagaatagttggagtcaagaaccactgcctggaccatttgtttgtccaactagtgttgatttcttcgatcaacaagatatgactatttttgaccaacaaatacaagataacattgcagcaagtcctagcaccaaccttgcaaagcaaaatgagtggttctcatctggcacttccttgcagtatttggaaagttcggtgtctgctggttctgtgctgaaggtatctgatttgacccttttggatggtgcactaactatttcatgatttcttatcctctctcacagcctgtacggcaatttagaccagctcttcattggtctacttaaaattttagataacatttcccctcatttccaggctgttgatgcgacaagtacaacaccttcaaattatttgcattgtcatgcacagagaaatacatcaaatcctcccaacttcaatgaaatttgttctggtaatatcgcttcttcaaacattgctccaaccaaaccaaggatgcgatggacacctgagctccatgagcggtttgttgatgctgttaacaagcttggtggaagtgaaagttggtccctgatcctctgtttttcttatcatattttcatcttgaacttttacggaacagtgctgttttcacaagaagaaacaagtacaagtctctgttttcctagatctattttcatttctgtttacttttctcttgcagaagcaactccaaaagctgtccagaaagttatgaaggttgacggcttaactatataccatgtaaaaagccatctacaggtctgcatttgttgcttctgaattttcaatgctttttatacgactcttcttgatttttcctgatggccatgggttattcttgtgcagaagtatcgcacagttcatcatcgacctcaactatctgatggtcggtgtgtttcgatgtttcaattttggtttaatttcaccataacaagatacgtggtgcactatgccggtcattgtactaaattagaatgttgcagtgaccgtactatgttgttgatgctattagagtttatatattgatctttaagagactgaattttatcatgcgctgtgcctatttaaatttgaagtaaatttgaacgatctggagctttacacaattttctttatttttttctcataggtgaatctgcgaaaagtggccaaacggatgaagtttcttctcagcccttgaagtgagatgatttttatgtgatatatatctctgagtcctagaaattttataaatatcatgtgttggcctagatgagtagtggagcataatatcacatctatgctccgacctggatgaatttgcattttcttcctaacttatctctggatgaatttaagttcaaatatatgtcgtgtgccagtgttttctaaagtcttgactgtgtacctactacagaggcatggaaaccacctgtgaaggattaagggtccagattggcttgcagaaacaacttcacgaacaacttgaggtgcccttattctttcaataataagatacttgatttttgttttgaactgcaaaagggaatgaacacgccagattttgtgcgtttgactaatgtatagggtcccttgtattttcctctccacagatccaaagaaagctgcagctgcaagtagaagaacacagcaagtacctcgccatgataatcgagaagcagagcgagagcctaagacaactgggagcattaccaagatctctagatgcacccactcaggttttggataacagggaaacgtgcgagggacaaacaggagatgctgattcagcagagcaaaaacctgagaaatgaatgcataatctggaaatttcagaagagacgccttatgctgaatcattggctgcaggaagtgagaatcagggccaattttattcagacatgatttgctcattggctgtagaagatgagaatcatattcatatcccaaatactgggagtatgagctgtccacttgatctgaaactgcgttgctgttccttcggtacacaagttttcgttcagggagatccaaagctgctgcttttttgtgaaaaagtatgactatgctgtagtgtaaccagtgtcagattgtagttgtagttcaggaacaaactcacaataagtcagtgccaggcatggttagcttatccatctctcgatggtgtacacttgtaacatagcacgagtacctttttagaagttccagactaaagacaccactcatttacatgtaaatgctgcatacaaaaccatatcatttcccccaatttattttgtgtcttcatgttattattgttacagcaggatacagtgagcaaaacacaagatgcaatacgtggtgatatatccattatccatacgagtggagtgatttatttcagtgccagaagctacaagcagaagcagtgctgtaactgctgatgccattagtgcactgcttgctagcttcatggagcaagcagaaactacagccaaacggggctagccattgcccgcttcttcagctcctggcacgctgcggcggcgccggccaacatcctcggcgccgcggtggcgtagaggttgccgcgcagcccctgctggatcagatcatcggcaaaactatcgaacagtaagctaaaataggcaaaacgatcgaacagtatgctaaaatagctattaggctctgtttagatctcctggcaaaattattcaccctgtcacattgaatgtttggacacatgtatagagtattaaatataaacgaaaaaataattaattacacagattgcgtgtaaattgtgagacaaatcttttaaacctaattgctccatgatttgacaatgtgttgctatagtaaacatttgctaatgacgaattaattaggcttaataaattcgtctcgcagtttacaggcggattctataatttgttttgttattagtctacgtttaatatttcaaatgtgtgtccgtatatccgatgtgacacgccaaaactttacacctttttgatctaaacacagccttagcagggttggaaatttcagaccaaaatttcggtcccctccgatacgatattaatttggccgaaatttttaaattttttcatgaatttgggtaatatttattcaaattcaactaaattttgttcaaaattttggaaatttcggaccgaaatttcgggatttcggtgatcccgatcaaaaaccttcaaccgatagagttaaccctgagccttagtacttagtgactaaataaagcttccattatagctaccttggtgatgagggtgaggtccggagagttcgcgccgccgttgacggtctccgccgccggctgccgcgcctcctccacgacgacgatctccgccgccttgggctccacagccgctgcccgcgcgcgcgcgccgtcgtcgctgaggccggcgtaggggagcgaggtgtggcacgcggcgcagtcgctctgcatgaacaccttgcgccctcgctgcactctgcatacatatgctcacaaaaagctccaccagattagcgccccgaaatgcggtggccaacggccggaagcgagaacgaactcgccggcgtccacgcggtgctcacccgtcgttcggccacgggtaggccgggcaggcggcggcgccgccgtcgccggaagtcgcagccattgattccgacgagagagctgcagcaagcaagctagctacctggtcgagtgggcgcgtgtgatcgactgtgaagcagcgcagcggaccgacgcctctctctgcagataacgaggagctccgattatggatggcgtcgtgctgacgtggatggtagcggatccacgggccacggccagctatgcgaatgcgacatggtatggtggcaaagccgttttctcccttgcaaagcgtattagagccaccagaaatgctattcggtgcacgcgcgctagaaacacgagtagagctcaccctaaccatttatatcgcatcgcatcgtctcctcctttcgtttgtttatgttattgaaagagcatctatgtttttttaaatagaaattgattatattttcggtctctgccggtagccacacggccagaaagtctaagtaaacagaaaggaatttaaaaatgacagccgacgaactagacgactgataggcggcgatgtatccatatgagcggagtaattaattttatttgagctccaatggaggaagctactgctacaagagatcatcgatcgatggggacattatttgcagaagcagcgctcaactgctgattatgcaggctgcattattcagagttgagatctagtcagatcgaagaaactagagccagacggggctagccagtgcccgcttcttcagctcctggcacgccgcggcggcatcggccagcatcctcgccgcctcgctggcgccgccgccggagtagaggttattgcctcgcaggccctgcacacgggatcagacataatttggcaaaacgaacagcaattgaaggtaactagctaatgccttaatgcgtgtgtgcttgattaattacctttgcaatgaaggtgaggtccggcgccgggtagtacgcgccgccgcggagtgtcgccgctgccgccaccggctgatgagcctcctccacgacgacgatctccgccaccttgggctcccacgccgagtcgtcgtcgctgatgaggccggcgttggaggagaacatgccgtggcacgccgtgcagtcgctctgcatgaacaccttgcgcccgcgctgggctctgctcacatcacatcagaaaattagctccaccgggttaattaattagcgcgcgcgacgtgggtaatttcatgcaaaattaatgtgatcaagcgaaagcaatcgacatgcattcatgctctcacccgtcgctcggccatgggtaggcagggcaggcggcggcggcggcggcggcggcgtcgccggcggtcgcggccattaattccgacgcgagctaggtaggcagcttggtcgagctagcaagctcccgatctacctgcaatggctatagcttggtctagttgatctgtgaacagcctggctctgaagatctcgaggaacacgttgcctcgtttatggcgcacagattctcgttcacgtggggctgaagtggaagcttcggccgtggagacggcggtatctcatccttcgggtatagttccaatttgggcctcagcattgtggcccaaataaaaatagacctagataagcctggcccaaaacacatgtagtcgtcggccatcttcttgctactactttcggcccgaagtatcccgctctttttttttacgatccggcctatggtaaatttacgtgtgacatgggcggcccaaaggggggccatcaaatcaactagtcaagtcagcttagaaaaccagctgcgccaaccgcggaaattagggagtgtttttttatgtacgtgtaaatttttagcatattacatcaagtattatatagggcgtcgtatagggtgttcgagcactaattaaaaaactactatttccgtcctagaatatagcaacctagcataggatgacacccatcctaggacgatgtatttggatatgccttatgtttacataatccgtaagaaaatcgagagacaaatttattaagtctaattaatttattattagcaaatatttattatagcaccacattgttaaatcatggagcaattagatttaaaagattcgtctcgtaaattagttgtaatttgtacaattagtttttttcgtggctggggtgcagtggggctcaccggcgactagagccagacgactcgatcatcagatgatgagatacaggaggaggaggagaaaccgcgcgcagggagtccaccgtacgtacaatgggcgccgcagggatcggagacgcggtcccgcggcgcccgcagcagaaacgcgcattcgccgccggcagccgtgctcgcctaccacccacccacctacccacgccgcagttatgttgctgcgcgcattcacgtgcagtcacttgcagccaggagcaggactcgtccggcgcactacccgccgtgggctctcacgctgcacggctgtaccggacggacggccagtgagagcagtagagcacgacctggattcgacgtttcgatcgccatgaacagtctcagcattgcaacatcgctcactcaactctcaactccatcagcactaggagaccaccaatggcgtcgttcgtatgcaccagct

SEQ ID NO: 66009 - DNA, 32176 bp, Oryza sativa
cccccccccccccccccccgggtgctcgatcgaggcttccgcgcagctctatgttctaataactgcccttggcctgaatctgaatttactctggacgcgaacccgagcaatatcgcatcgccaacaaggaaatctgtcagtaattagcttcagaggcaatcagacctgcctgcgccatcctcttcgatcttcttcgtctagctagcttcatcgagcctacaaccagtaactgctactgtgtggtacgtaaggttgagttatttgggggagggagggagtaggcgtgatgtagctagctgatgttaattataatcgacagtgcataagccgatgtgtactgctaataggctgtgtttagttcacgtcaaaattaaaagtttggttgaaattagaacaatgtgacggaaaaattgaaagtttatgtctgtagaaaagtttttatatgatgaaaaagttgaaagtttgaagaaatattttagaactaaatacggcgtgtgtgtatatagagagagaggaatgtactgctatattcattttgcaaactgcagctagctactccatcttcaacggccagcatcagtttgcatcgagagagaaaattagcagtagcatcaaataatatcgtttcagttcgtcgcaattaagctagctagccatttaaggagttagctcgatcgtcggcgtcgaagagggaccaagattaggcgatcgattccatttgagtatctgactcatcggctgaatcataggagagcaaggctaataatacagtcgatctgttggctataaaatttttttgtagttttctcttagcctatctatataagagcatgtaaactataaaccagctataaacatattttaaagagataaatgaagagagataagagtagcgggctgcagatctgtagctagctacagcacggactctaagacgtaatgtgtatatgacaggtgggaccaggtattaatagtatagtaagcaactattgtatgaattggctattacattggctatagatgatttggagttagtagtgggctatactattaaacttgctctaatagttagctctttacgattagtacagggcccacttgtttctctcacagagtttcttggttcttgtgtccaagccggctgtaagtttacagcccacttctcctctctctctctcctttcttctcttctccacctcagcatttagtcggcttatagcctaccattatactttgctctgagtactcgtactaagttcgcgtgtaaatgccactgactgcacgagagaaactgtgcatatcctgcgcttacacagtgtactacggcctaggcatgatctagatgatgaatgcatgggagtaatttacagagtttatacactattgcattgcaacttgcgaaaaacgcagtgctacactcttgagaattaatgctggctatccgcagctagtgatgatctgtgagcaattagcatccaattaaacaaaggatatgtcaccgagagccaagtgatgcattgatctgatttctcagtggcagactggcagttggttgttgtaatttccctcaaacaagttggtacgttgtagtaacagagtggtatacagtgctactatacattcagaagttgatcgatcttaataggcgttgtaacgctactatacattcagaagttgatcgatcgttactgacgggaggtgagtaggtaaaggcattattagcaagaactgcatcggaatataatgcatctaggaatacttttgtgtgtggggggtgggtgtctgaaattaaggagaactatgtgcaagagcgtgtatacactatacattagtccaccctttcctggattataacgagatatgtagagctagctgagctgcatattttcagcttttagcggcagcaactgttgctacctcagttctgtggtgactggtatgatttttcacttgcaaaggcaaagccaaacgaattgaagcaagtaatagtattacgcatgcagtttatagcgtgcttagtagtaacagatcgatgatcattcgaacgatgtgtttctttcaacgtatgctttaatttgggccgttagaccaggaaaggaaggtagcaggcatgcagctggtctggtgacccacattttgcactgctccttgaatgtgtgcacgcaaaagggtcacaaaaatatcctcccagcctcccaggggcatataaattaccacgacaaagttgaaatggattttaaactctccagcgcatgcatctgtcttcatttcctacgttcggtctgaataagaagatattcttttcaaaaaatagattactactacttcctctgttcccatttacacagctgactgcagcattatttaccatcacagttttaactctgaacagtattttttttttactaaattgctcgattatgattaaaaaaattgtatcattttattaacttatcttgcatgtactttaataatacagtgcatgttgcatttgcaatgtgtattaataaaaaaaatgttagtggccaaagtctgaaagtgagcactcattgatgcaaaaagtgggaacaaagggagacatataagattaaatgggaccaacataaagaagaagaaaaaaaagaaagtagcctgatttcattcctctatattttaatcgaatttgactgtgccttactttcttttttgagaatatatggcacaatctcactctttccggtcatgaataagtgatgttttgggacttgttttattactatgttactatattatactaactctatattttaatatatgacgctgttggttttttatccaacgtttaaccattcgtcttattcaaaaaatttatgtaattatcatttattttattatatgacttgattcgtcattaatgttctttaagaatgacataaaaatttttatatttacataaaagttttgaataaaacgaatggtcaaacgttggtcgaaaagtcaacgacgttatacattaaaatacggagggagtatatatttgttttgaaaattttctttacgattaaatgtaaaacgcacatgcacacaactactactcccacgcggccacgcgcccgcctactcgtgagcacggatacaactcgggaatttcatgttaatggtttggagatacaatctgtgtatgcgtaaacatgtgtgttgaggccagctggtacgaatcgttattctttagggtttcatcttcatatataccttttgtaagtcactgttcggcgttataacctcaccttaatatagtgaagatattttgctggctagtgcccttggtttttttctcttctgttttaggtgggttttccacgttaaatctcatatctttgtgattgatctagtggtttttatcgtttatttgcttatcgtttcttaagaacgtgcgtgtgctcaagattattcaaactcttaaatggtttttcgcttttattatgaacttacaattatcgatatgttttagctatcaaaaatgggagagaaaagtgtctacgtactagtcacacaaatacggcaaacggatttgttggtggagcaatggtcctaggcatggatgctcgcaatcaagtctgctggcaggaggcagagagagcaactctcagccacaggtaggagtagctctcatcgctagcagacacgtacagaaaagcactgtaattccagctcgaattccccttcaatgcgctcaagatgtgtaccggccgtccgcagaatagaccggagcatgcatgctgtagctttcaacatcccaaccaccttcgacctactacgactgctatgtacacccgaccactacgtacaaatatactccctacttccctaaatatttgacgtcgttaatttttttaaaaatatttgaccgttcgtcttattcaaaaacttttgtgaaatgtgtaaaactatatgtataaataaaagtatatttaacaataaatcaaatgataggaaaagaattaacaattacttacattttttgaataagacaaacggtcaaagatttttaaaaaagtcaacggcgttaaacattttgagatggaggtagtattagttagcatcaaaaagggaacgtcgtggtctctcagggtacatcgatttgccctttcaatacgataaccatgcatgttgttatcgcctcatccgtgagtatgggactactcctaacggctaatacaaacctagggtgtgtttggttcacgatcatatatggatgagatatgctcatccatattttgttgaatatagtgatttaatattttttttttcatttggtttgtacgcatatgatgattcaactttttgtttgggtggaacaatgtagcatggataggagaagccaaaatttagtaggacccatttattatatatactctctatgtttcatgtgataagatgtttgacttttttcgtagacaaattttgttaagtttgataaagtttatagaaaaatatagcaacatctaaaatattaaattagttttattaaatctaacattgaatatattttgataatatgttttagataatattaaattagttaagagttctcttctgcagtcatctaaaaagagttcttctacaggtaattaatttggtctatagttctatatacgcatgtaggcaatatgggagaacaaaatggcaatgtataacaatatatgagaatagaatataaaacacttaatttttatttttatcttcatctccggaggattcaaacaccacctaactgatactgttatagtaagagattttagatggacccgcatgcggactcctattttaagctcatgattttctaaaaaataaaatatccaatcaaaatatcaaccagcgtcgctgggttggacgacaggagtaaaagctagctatcgtcttttgatccggccctgatcaatggatttccactctctcagctcggcctatataaagctaacgagtacactccactcccacagccatctcctctctactgtcaatctcaagtgcgtgcccggtatcagctcgaccggtctcgcacctgcaaccaaaccacacacagctagctatcatggcctctaagccagggcctctcactcagtggccgtggcataaccttggaaactacaaggtactaaattatgttttatcgtcatcatcagatttgatttgatgccatacgttgtttgtaagctgattgcaacaatgtgagtaattaacgactgttgcgtacgtggaaatctacagtacgcgctggtggcgccgtcggcggcgtacagcacgtacaggttcgtgacggcgagcagcgcggcggagcgagacctcctcaacttcatggtgttccccatgctgctcctccgtctgctctacggccagctctggatcaccgtctcccgccaccagactgcccggagcaagcacaagatcgtcaacaagagcctcgacttcgaacaaatcgacagggaaagaaactggtaattaatcgatcaaattgagtgtacgtctaagggactgtttagtcggtgaaatgaaaatttcgggtgttacatcttttgagattttgcttcagtctagcgaaaagtaccttaaggtaacggtatatcacagtactaaatcgtttttgttcgttgaatcaaactggacaggatggacaatattagatccaatcatcagaaacgacacctcgagatacttttcgttagactagagcatatctctaagttttttgggttttcatatttacatatatggatgcagggatgaccagataatcctgacggcgctggtgttctacttggtgagcgcgacgatgccgcaggcgcaggtggcaccgtggtggagcacaaaggggatggtggtgacggcggtgctgcacgcggggccagtggagttcctctactactggctgcacagggcgctgcaccaccactggctgtacgcgcggtaccactcgcaccaccacgcctccatcgtcactgagcccatcacctccgtcatccaccccttcgccgaggaggtcgtctacttcgtcctcctcgccatccccatcctcagcaccgtcgccaccggcaccgtctctgtcgtcacggccaacggctacctcgtctacatcgacttcatgaactacctcggccactgcaacttcgagctcgtccccaagtgcctcttccacgtcttcccccctctcaaatatctcctctacaccccatcgtacgtataaatttacctgtttaaaaatataccattacaatttaacgggattgctatttagcgcaatgttggttattttagtacacctttttttctttctgaaaactttcattcaaaaaacttatattggagaacttttacatgaaaatactttatatgaaaaagtgtacagtgagaaatatgagtaataattaattatactaattaactgctaatagagatcattaattagtgtatgtatgtatgtaggtttcattcgttgcaccacacgcagttcaggacgaactactcgctgttcatgccggtgtacgactacatctacgggacgacggacaagtcaagcgacgagctgtacgagaggacgctgcaggggagggacgaggcggcgtggcggccggacgtggtgcacctcacgcacctcaccacgccggagtccgtcttccacaaccgcctcggcttcgccgccgtcgcgtccaacccgcttggcgccgcagcctccggccacctcctccgtgccgcctccgccgtcgcctcccctctcctctccctcttcgcctccaccttcaggtcggaggccaaccgcctcgacaagctcaacatcgagacctgggtcatcccaaggttcacctcccacgtacgtaattttgactaatttttaaatacaaaatatactcatacaaaatctccatttctttaagtatttttttctcgtacaaaatatacgtatagtttggaatgtttgtttttgtgtatgaggaaatagtgaattaattgcgtgcattgatggaatcgcagtatacgtcgaagagtgatgggtacaaggtcagccgtttgatagagaaagcggtgtcagacgcagaagcaagtggcgcgagagtcctcacgctcggcctcctcaaccaggtaaatgcattcgctgacccacctgacagatccaattcattgcatgccttctcactgttcgccggctttaatgtaacagtaccagcagtaggtgcaacttcgtagcatcactctttcctctctgcactagctccccaagtagttacatgggaccgaattcacctaccaagatttacaaaatttattaggctgtgtttagattcaaacttccaactttttccatcacattaacctgtcgtatatatataatttttcagtcatattgtaccaattttaactcaaactttcaactttagaaagaactaaacacagccttactagcatcagacagtataagaatttttttttcatgtttctcaaaatatatctggacatcagttgaaaacgtgcataaatgcttatacaccattttggaatggatggagtaataaatttcagcagccagaggttcatatgacagtggcactttttacttcaagaaaaaggaacagtgtttagcaaatgttcgccccataaatctgctttggtcctgcacgggtatatgtcaggcgatgctaattaaatcgatccaattgtacgtgcaggggtacgatctgaacaggaacggggagttatatgtcgtcaggaagccaagcctgaagacgaagatcgtcgatggaacaagcctcgctgttgctgccgttctcaacatgatccctcagggcaccaaagatgtgctcctcctgggaaacgcgaacaagatctctctcgttcttaccctgtccctctgcaagcgggagatccaggtataataccaaaatgacagtactcgaccagttaatattcttaacagtatcgatcacggtgattaaaaaggttactggctgtaactaatttcgaacaaaaaaacaggtgaggatggtaaataaggagctgtatgaatgcctgaagcagcagctgcagcctgaaatgcaggagcatctggttttgtcatgcagttacagcagcaaggtaattgaaaattggctctgtttggatccgaagggctattaaatagcccttcaggattttgctatttaagagtattaaacgtagattactgacaaaactcattccataactcctaggctattttgcgagacgaatctaacgagatatattaatccatgatttgctacagtaatgctacagtaatcagccgctaattatggattaatatatatcattagattcgtctcacaaaataggctaagggttatagaatcggttttgtcgataatctacgtttaataatcctaaatagcaagatttcagagcgctatttaatagtccgaaggatccaaacagggtcattgtgggtaactggacgttgtggcgtggatgaaataaatcgaaactgcgtgcgtatgcaggtgtggctcgtgggcgacggggtgacggatgaggagcagatgaaagcccagaaaggatcccatttcgtgccgtactcgcagttccctcccaacaaggcccgcaacgactgcgtctaccactgcaccccggctctactcgtccctgaatccttcgaaaaccttcacgtttgcgaggtactccctctgtaccacttacttcgtccgtctcagaatatagttatctttagctatgaatctgaacacatatgcacgcagaattggttgccgaggagggtgatgagcgcgtggcgggcggcggggatcgttcacgcgctggagaagtgggacgggcacgagtgcggcggcagggtcaccggcgtgcagaaggcgtggagcgcggcgctggcacggggattccggccatacgacgaccaccaccaccccggcatcacccatgatggccgtggcgggctgtgaccggccggtggccggatcgaagcaacctggcctgattgtgtgatcttgtgtgtgcttcttcgctcggttgatatataggagtatctccgtgtgtgttatgatggggccagattaatatccagctataaaatcccaagctgtattgttaattctctgccggtgtcataatctattgtttgagcataacttaaatttgagcatgattaatttggagatactctctgtttcccacttgctactgtaatgagtactttcctacagttttatcgctacgattgtacttgtagcggggtagcggctgattatcgatgtatatatccaccattcatcgtcacaagcacggttgattatagagcttctagctccattcaagagaagcggtccttttcctaatatccggcgaagcttccttaagatgtggctgatgtggttgaatctagtcgagatgatctcaacctctcttgcaaggaggccccttttgggtatggtcgctggttttctttgcagttcacaatgtttattctctctttcattagtggtttggatctaaccgtttttcttgcaatggttgttgttgggttgatcttgcgaaagaaatttggcgaaaatcttcggtggtgtggccgaggatcaaattgtttgctagtgcctcaaccttcgtatacgagaggtcccttcagggttcatgaataggctctacctgttgcagctcgccttgttttaagccccgccaaaatcaagatcaaagcatttattatcagcgtcgtaggcaaacaaaggagaatgacccgattacctttttattctctttgtagattttttctgcagaatgttgatctaaagtataacttgcctattctagatgggcttctgtgcaaaactggatataccctactgaattatgctcgacgcactactgcaactcatgtatcttgttcttctccctctgttgtaaaatgaattctgttctgaatttgaatctgaacatacgctatttgtttaaaatctaaaaccttaatgtttaaatcatgctcagtgctcaatcctatcaatttcattgtataatatgacttatatagagagagaaaaagaaatatcgttaggaagtatggtgatccgttttcaatagttaatgtgtaaaatgaaccaataaaatattttaaaggagtaaaatgaatcttttttttaagaaaaaaaaatggaaccgatagacagacagcgtctcggcctcgactcccgttcctcccgttcctcccttcggtcggagttgaacgacacgacctccaccttagggaggggagcacacgcggccgatttccgaccgtccgtttgcaagagatctgacctgtcccgtgcgacacggacggtccagatcgatccacgacctcccccttggaagcacgcgctggacacatccagctcctacctctcctgaatcgctcgtcagatcgcgtcagttcttcgcgatgcctcggcggcggctccggcgcggggacctcgcctgttcggtggcggtggcggtggcggtggcggcggtggcggtggcggccgtgggggcggtgggcggaggcgatggcggcgcggatttcgactaccggaagctctcggggataataatccccgggttcgcgtcgacgcagctgcgcgcgtggtctgtgctggattgcccctactcgcccttcgacttcaaccccctcgactccgtctggctcgacaccgccaaggtcagaaccacccctcgttccgtactgtcctcctgatattcagaaagctacttttgctagtaactgttgttgttctggataatatatgtgcttttgttcttttattaggattcgttggtctgttcttgtgaggcattgatggattaaagtaattttgcaatggcccatcaggcagatgcgtgtgtgcgactgcacatctgcttgatttgagtgaccatctagttataggttttggaagtgtttttaggactaaatcggttgtgtgtactacgtaaccatgctaaaactagtgacacgttcagttagaagaggtttgtcattacttcactggaaaagggatatttgttaattgtgtgatggttgggactgtttcctgtaaggcgtcatacggcttaattgggtgaggttgttacagaagcattcaatctgtgcaatgaacaggctgtaacgattatatttgttacatgtagggggtcatatttaagtattatctttcattttcatacttgcgacttaatcgggttcatggtgcagctcttatctgctgtcaattgctggctcaaatgcatgctgctcgacccttacaaccagacggatcatccagagtgcaagtcaaggcctgacagtggtctttctgcaattacagagttagaccctggttatataactggtaaattatatgcctcgcttaattctccttggtattgattggattattgaattttgagtacaaatatgctgcacgattcatcagcaatgtgatagattgtgatttatgcttcaactcccatgcaatggaaaaaaaaaaccatcgatggcaagtgagagtgataaaatttgacatcaagcttttgtgagttaataatggatattgccatgagaataatagcattagctaggttacattgcaaattcatgttcatcggtaagctgtagaattccccatctcgttcctcaaagaataaaaaaatgattagccataaaaaaaatctttcttactaatttggttttattggccaagttttcaggtcctctttcttcagtgtggaaagaatgggtcaaatggtgtgtagaatttggtattgaagctaatgccattatcgcggttccatacgattggaggctgcccccttcgatgcttgaggagagggatctgtacttccataaattaaagtttgtaacacttcacttcatatcacatagcaatcaatttactcactgcccattggctttcgatagtatttgatgttattactaataattggtgtaaaaacacttctaaattgtatcaaccagaatatactcactttgtttaccttccataccctcaaaaaatcacgcataactaagtagtactagtatcagaaatacaaaggtttggttgcctttggtgtgcatgcaagctgaaattgataattttttttgcgggggaaattgataagcttttacttgcttcttttcatttttttatgacatccttttcacttgaattaaaagttgttttcttcaagtttatacaatacttgataatgacacggcgatatgtcggaaattcattgttgcatgcggaaagatagtattttggtgctcatagtccttttaactgcaggttaacttttgaaactgcattgaaacttcgaggagggccttctttagtgtttgctcattccatgggtaataatgtgtttcgctactttctggaatggttgaaactagaaatcgctcccaagcattacatccgatggcttgacgaacatatacatgcatactttgcagttggtatgtaaaccagaaggaatttaattcatcaccatcgttatttgttagtgtcatgccatttttccttgctttcaggtgcacctcttcttggttctactgaagcagttaaagctgctctttctggagcaacatttggtcttccagtcagcgaggtcagcctttatgaattatatatttttcaataatgtgtcctctgccctcaggaggctatatttctgatatttatacatttttcctccaacattgttagtgttgaatttaagtatgttgttggttgtccaatactgaatagtttttatttcctttttggattcactaggttttgtggtgattcttttgccccttgttctttgtccctgccctttctgagagtactgttctggtaacctctcagcccttctacacgtgcaagggaaccttttagtactgttggagtcttggagacaacaatgccttacttctcatagccgattcgcacggccaggttgtgtgccacaaccatgctagttttagagtcagttagggaggttgttttggtgcatgtataaattctctaccttcgagtgatacacatgtgttgaatctgtacttagctatatattgccaaaattgttacattatatgccatcttataattatattgtctcttatgcatctaaaattgcttttattgttttcagggaacagcacgattgatgtttaatgcatttggttcatctttatggctcatgcccttctcagaatattgcaaagctgataatatatactggaagcatttctttgagggaaagggaggttgccaccacagacagcaatgtgatgaaatggaatataagtctgaatactcaggatggcccacaaaccttgtcagcatcgaggttcctacagttcgaggttctttgttgaaatttcttcccagctttaatctatgattaagattttgcttccactgagcaggtctaccttttcttttctttcattttctgttttcctctggcagatacggaagcatacccatccattatggatacaactgagaacataacatccagcatggagtgtggaaagccaactcttttgtcattttctgctagggaggtttcagatggtactctgtttaaaaccataaaggattgggaccctcagagcatagggcttatccatcagcttgagaagtgagtttgcaattttgtatgcgccagtgctgctactttgtaaattgtaattctcagtttcacatacatatttatcttcaaagtaaaccaccaacttacatgtttttatatgcttatggaagtaaatatgtgtgattttgattaaattgtatctaatacccccacattttgatctttgttgatctcaggtactaccagggtgatccagttcttaatcccctcacaccctgggagagacccccaataaagaatgtgttctgcatatatgggcttgattcaaagactgaggtatgattgggatttttctttgattgttaaagtttctactttagcctgctttgaaccacattaccattcaccgatttatggccttttttgttaagcaggtaggctattattttgcaccgagtggaaaaccatatccagataactggataataactgatattatttatgaatttgaagggtctctactatcaaggcaggtatcatgcatcttgtgttggaaagtctcgtgtccaattctttcaaattatccattatctgtctttatgtatgtctgcttctagtgtagtttcctggaacagtatttttttttgctttaatatgaaaagatatttgtagttcgcagactcatttttcatggctaatttgattgaatgaagatcctagtaagttgcactggtttctaatggtaattaccacagataatagcttttcgtgcatttgttttctcgaaaaatactgacctttgaacctttggcttttgatgagttcaattctggtttggacaactgtttatctggccacatttttatgtcttttgttttagaataaaatagtaacacaatttattctttccagatcaggtaattctgttactggaaagcccaacaattccagcggagacggaacggtatgttctactgtagtatctttataggtcaattcaatgtcttgagttgaacaaacaagactttgtggcaggtatcctacaattctctctcatggtgcaagaactggcttgggccaaaagtgaacataactagggctccgcaggtattttaccatgtgcctagtgatatgatcctcagcagaggagtttgaggcctgtttattaatttgttttgttgtggctaatagaattattgactgtttccttgtagcatatcacaatgttaatgtgcctttcctgctttgtacatcctactgtttttgcaggcagaacatgatggatctgatttacaaacaaagatgaatgtcgaccaccatgtaggccagggcatactcccaaacatgacgaggactccacatgtgaagtacataacctactttgaagatgctgagagcattccgggatggagaacagccgtctgggagcttgataaaggtgggtgcaaatcttttagttgttttttctccatttttttcatatttatgtcgtaatgtttgtccttatgccagctttatgcatttctttgctacaagggaataagaaatccatgtagaagtttatgcttagaatatacatatatttacagtgattcaggcggagtacttgtgcgtgtgcccacatactccagatttaacatgcaaccccctctaaagtttaatcattcctttgctatacaacactcattttgaaaattattattttaacagcaaatcacaggaacattgttaggatgccagtactgatgcgtgagttgtggcttgaaatgtggcatgacatgcaccctgatgcgaaatcaaaatttgtgacgaaaggtgtgctcagtttcaactcctattaccagatatatgaatccccctgcatctgatttgactttcaaagccactaacagaggtgcatgaacagctttccgaggtccattgagaaatgacgattgtcactgggactatgcaaaagctcgatgtggctttccagaacactgtgaatacaggtctgcaactcatctttcattccctttttcttgctattatcctttttcattaacattgaattttatggtgaccatatgccaggtacacttttggtgatgtccatctaggaatgagttgcaagctgaaaaattcgtcgactaacctcctgcaacaatatctctgaagtatgtgcccttcaatttaatgacgtttggtgttttacggtattctaaggctctaacttgtactgctgtattgtggtgcagaattcttttggatcatttttatggttatgatattattcagttggactgaaccaaggacaaaaaaagggtccagtcagaaacaggtgagcatgtattgttgctcttatagtcatcatgattatcatcttggctagtagttgatatattctgttttctttttctctttttgaagataagctgatggatactgattgaagctatacattgtttttaatctgatttatttttgggctgaagatggagattacgatatttttaggactgtatagtttgtgtttctaacagatccatagtggatgtcagttgtagaagtatctttccaatattgtgaaggccccatgaccatgaaccgcaaagatgtatatatattacgagtaaatgttaatgtttggacaaataaagttctcttgattcacggtctggggaaagtctaccaatgctgattaaaagaaaacttcttacctgatttcgtttccccttaaagatgcatactgctctcctatactgatgcatggcgattcattggtgacatgcctgcctgagtgatcgataaacttcactacgtactcacggttgttatggattttaaatcagtgaacttcagtgcatggggtaaactatattttcttttcctcttcacgatttacaccgtttatttcgataaaaatcatttaacagttgcttttttggagcgcatgtgttccctcttccctgagaggctgagattgtttttaagtagccggagaagagtggagtatatctgtttggctaagttgtgtgaatgtaggaagcagggtttgttcataccaaaattaacattaacaaattttgataattctaaaatttggcaaaattcgataatgggcttgatcggttgtgctggctgctgcagctctttggtttggattggggctgactggctgcagctgctgcaaccagcacttccgatcagggccaatgctaaattttggtaagatagaagtatatggatgttgtttatagtttgttatcataccaaatatccatatatatatatatatatatatatatatatatatatatatatatatatatatatatatatatatatatatatatatatacataccgttgtgtgaagaagttttcagaaaatcaccgaattttgacatggtaagatattgtggagtatttgagatgtgtttagattgcttcacaatcctaaagtttggtgtggttgaaaatggtagtaaactgaaccgcctctaagtgagcaatcttagggcctcatcttttcatttattcttatgcttatcaaccaaaatttgatttttttaaccttaaatttgaaactgattttgaggtttgtttttatcgaaatttattttctagcctttatttttagatcactaagaacacgtatataaaagttttattcgcaaattacttttcgtttgcaaatatgtcgtttcgcttattccgcgaatatgatggctccctcactactcacataaattctgcttgcaaagcttatttctaatatacattttagaagaaaaacaaaacagaagtgggataaaacggcttaaaaaaattccgcatgtctgcagaagtccagagagagccagagacgagaggacgccatcatgcattcatgctgatgctagaacaaattcgaaagtcgtataaaaaaagcacgtttattcggaagtcgaagctgcctcaaacactcgaggacccagctgccagctgagccggacgcaaccgattcccaaccaaccacgcgtccggtacccgagccactccccttctagaagattcccgtcactccgcgacgcgcttggaattttcaacgaaagcggcctcgcacctgcctccatccgtcgccacgtcaccccctatcccccgatcggacggccacgaaaacccgcacgcctccgtttccgtctcccttctccccacccggaggagcacacggctccagaagcttcctccattaattctttttgattactcatataatcaccttgttatttctttatatttctccctcgtctcgcccgcctccgttccgcctttggtccagatccacgcgtgttgcggacttgcggttgcttttgttcgtcttctcccggagattcggcgtgttcgtgctgcgaaatccgaactacttctgctgctaagatttctgccgcgtgctaatggcggaggtaaggctcgtcggtcccctacctgaactcgtcctcttcattggctgctgctcctgtaacaatcgctaatggcggagagggatttgggtgttgatggtgtggcaggaagggtacaaggttgttcttaacgtgtacgacctcagcaacggcctcgcgcggcagctctccacctccttcctcggcaagccaatcgaggccatctggtgagtgaatcagatctggcggcttaatctggtggatttttggatttgggtttgggctaaattaaatcggatttgatttgttgggtaggcatacgggcgtggtggtgtacgggaacgagtacttcttcggcggcgggatccagtcgctggcggcggggaggacgccgtacgggcggccggtgcgggtggtggagatgggcgagacgcacatcccgcgggaggtgttcgaggactacctccgcgacatctcgccgcggtacacggcggagacgtaccggctgctcagccacaactgcaacaacttcagcaacgaggtggcgcaattcctcgtcggcgccggcatccccgactacatcctcaacctccccgccgaggtcatgtccagccccatgggccccctcatcatgcccatgattcagaacctcgagtccacgctccggaccaacgccgcgccgcaggccacgcagttcgtcccctcgtccgtgccgccgccgccgccgccgcagaacaagcccggcgagggctcgtcttcctcgaagcaagaagacaaggcggccaaagcgaagcagggctcggcggctgacccgctcggcggcgcgagggggaaggtgcaggaggaggtgatgcgggagttcgcggcgatcatggcgagcgggacgctgcgggcgagcgaggcggcggcgctggcgatgcggcgggtcatggagcggcacggcaacgccaccatgcagcagagctagacgagagagacacacacaccaccatacattcgacgcgatgatgcgtgtcgcaatcgcaattaccgagtttttacggagtagttaacttctttatgaatgagaaggtgatttctgtagcgtattgattgtttgttactgtgtgtgaacctggactgttctgcttaaattcgataatctttctcttgtctactatccgatggatggataacgataacccattctccattattgaatagacaaagcatgtttgtggtgtctggtgatcagactgttaactgtgatactactattgtcgatttcattcatcgagtcttttgtttgtcgatgtttagggccttgtagccaacataatcaatttttgcgatgtcaaatttttgataatctgataatattgctaagttttgatatgatttcttatgtatttatagtgtgtttgggaccttttttagcatcggctgcggctgaagcagctcaaagtggctgcaatttgcacaatttgcagcaattttgctcattttggtcacaatttgcagcaattttgctcattttggtcagaagtgtaaaaagaaatcatattcttacgatccatcatcctacaatccaagaaaataagtggttaacacatacaacgaaggacatagctatttatttgaattatttaaaaggacgcgactacaccgagagtgctagctagatagtgctaaaaagagacaccattctttccaaaaaaaaaaagctactacactcaatatctatatattttttccttcttagagaagtttctcttaaattacttatccgatttataatccgattacgccgttgtgttcattgcaattaaatctttacaacaagatctcacatgattatattttgatgaaaaatcacaaattacttttatgatatatgtataaattacttttagatttcactaagttacttcttaaactataaaagtaagttcagtaagtctaaaagtaatttatatatactgtagaagtaacttacaacaaaacgaaggtaactttggcatgtcatttgaagtaaatccgttgtagagataaaaacatgactctatctagaaattaaattaatcagcacaaattatggaattaactaaaaagtcatatttttatccctacaacgaatttacttctaatgtcgtgacaaagttacttccgttttgttttaagttacttttaaaatatatgtaaattacttttggacttttattgaatttacttttatatgtctaagaagtaatttagtcaaatctaaaagtaacttatgtatataataaaagtaatttacaaatataaatattttttcatcgtaacataatcatgtaagatcttgttgtgaagatttaattgtaacgaacacaatgttgtaatcggattatagatcgaataagtaatttgagaggaaactttatttgaataggaaaaagatacccacgtgaactttatttgaaaggaaaaagacacctatgtggatggatatcatgacgacgtgcacagttagatggctctgagatgcgtcgcgctatagagctaaaccgagagcgctctcgaaatagatttcgcgtatttaaaagcatgcatgccataataacctcatcactctctggtcataatttgaattattttaaagcatgcatgccataagaacctcatcactctctggtcataagggaggaacaaccaaagatgatatatatgcatatagttagcctcattggtggttatataacatgagcttcagggtaaggaaatcatctcaactccacaccaattacgctcaatagaaacagtgctaatgctaagagtaagaccattgcggtggctctgctcctcgccacccttgtggcggtggttgcggttgaaggagccactgtaggggaggatttctttcgacctttttgtgcaaaggattgtaagaagaaggaacaaaaggaccccattgacaacaagcattgtatagacatctgcatcatcttaaacaagcaacttcttgggcctctgagggagaaaaaaaatcccactatggaaaaattcagcgttgtgtgcaatgaagggcgtagcaaagaatttaaggaggatcctgccaccaacaacaagcattgtgtagacatttgcatcattttaaacaagcaacttcttgggcctctgagggagaaaaaaaatcccactatggaaaaattcagcgttgtgtgcaatgaagggcgtagcaaagaatttaaggaggatcctgccaccaacaagaagtgtgtagacagctgcatcggctaaggaaatcaatggattcttagcgaaaggtgacgcttccggtgttcctgcgcgtgcatgattttgtagagttgcacatctgttccgtcatccatggtcgagtgacaatccccattaatggttctcacccattgtcatgttgttccttttgcgtcttcagttgtttcactatttggtgtttataaattctatgtgattgatctgatatgttgttcttcccaatgttaccggatgcattagttatctttaattgattaaataaatctagttgttctttggcttttaacactcattaatctacggtttcatattccacattgtgtacatgtaatgttaatatatagatatagtaagaacacagaaaagagggtggcgatacgcagagagtagttgtattgatcgagggataatttataatgatcctaggtgtacatatttatatccattggtaaatactagtcccgatcggacacgatataagtttcgtaaagataacaaaaaagatacaagtcctgatcggacactaaacacacttttctaaaatcaaaaggaaactaactaactctgtctagttaatagatagattgccacgccgcatcttcttcgaactcgacatcttttggataagctttctttaattgattatttttctaactgaatccgttgagaatccagctgttggcgactagtaattctcatcagccaatttcaggactctaaaactgatactgactctaggctgacgacgacttcgaggcttatcaaattttagcgttaacaaataccccatcatattttaggttggtttattttaagacgaatgaagtattttgaaatttgtatgctaaattatagctgtctaaacttttaaattttatttagaatgaaaaaaaataatttattcaaatattatcaatgtaatggcataactaaatttatggatttgtagagatatgaatacccagctaaaaaaaatcttaaatccagagttgtgccaaaagagggatttattagcaacaacctgataatcaaaatttgaactttagtttcttcggtattgacttttaaactactttgcattacatatataaattttacccataaattatttattatttatatttcttttcactcgtcatctccacacgtttgcatcagttcacacagccacacgttgtgacgcagccaaggcaacctcagaggaacccaagtgtcagagacatcgtcactgtgtaaaatcaccacctcaccctctgacctctgtctttcacaaatcccctcacacacagcagcggatccgggatgcaatggcttagcgccacgtcagcgagtccctataccggattggtcacttcccctgtttggtgtttggcacggggtagcgcaaggaccatggtaatccggacctaatcaagtgctccaatccccgcgcctccgaccctacacctccggctccgaacctgatggatggatgttagagaaagtttaatagtacagcccactactagcttcaattcatttatagccaatctaatagctaatttatataatagttgcttactatgggcctgttcagctgcaatgtgcagcagctgcaacacagtggtgctgctgcagctgcttacacaaagcactgttccggccgactgcaccacagccatatgagtgcagtcgaacatgccctatactattaatatatggtcccacccgttatacacacattgcgtcttgaagtccgtgctgtagctggctacatgtctgtagcccgctgctcttctctctcaacttttatctcattaaaatatgtttacagctggctatagactgccattgcacctgctcttatagcaaggctaataatatagccgacttattggctataaggttttttttagtctgctcttagcccacacatataataattagctatttacaattaatatatggttggtttggtttgtggcctaaataagccttaccaaattttgtcaatgccaaaatttggcaaattttggcatgactaattttggtaaggcaaagttgtatttggattgaagccaaaacagcctaagttcactattgaaatggcttattttcttagacatgccaaaatttggcttcaaaccaaatagacactaaacactattgaaattgccaaatattggtaagcctaatttaggcctcaaactaaaccagcccatagggcccacttgtctctctcacataatttcttggtttttgtgtccaaaccggctgtaagtttacagcccacttctcctctctctctcctctcttctctcctccacctcagcatttagctgacttacagccttctattatacttgctctcagagcagctataatagcaagctataagccagctataaatacatttcaagaagataaaaaggagagagaatagcagcgggctacagatccgtagccagctatatacatcacgggctctaagatacatgtgtgtatgataagtgagaccaagtattaactgtgtactatatgttataagtattttctctgtcccacaatacttatctttctaggttgtttaacacaaattaaggtttgagaagtaaagactatattgccccttatttgaatagaagcacgagagtggtgaggatagaatgggtaaaaaattgaattggaggtgattgatgtgacaagtaatactaacaagtgacaagtattgtgggacaaaatttgaactccaaagcgacaactattttgaggcggatggagtaactattttataaattggctattaaatagactattaagttagtatatgagttttttttaaagagatttcttatacagctctttttgtatttccaaaagcgatcaaacttacaaatcaactcatacacaaatgacgtaccaaagtgctgacaaaaatatattcaatttttataataatagagatagagaagagatagagatagagatagagatacagaaatccatattatagtatgatatcacgaattagagtgaaagtcatggattgtttgaatgctagtatttgagagtagtagccgatagcacggagaatcccacattagaatgatctagtatacggcgatgcttattctaggttatacttattggttataccttttaaattagtttttaaactttggtagtctatgaacatatggttttttagtcacatatgttaaaggatagagtcatgcctttaagatacaaacacttcaaaagtaccttcgtcgcaaaaaaagttttttaatctagctttagctattagttattagtgttagattggctttatggctttaaaagaactatttaaaactaggaaactttgagtttgtagctaataaggctaaaataaacttccataaagtgatagattgaatatggcaatatttatagtagcaaaagaaaggcgtgatcatatgtttcatggaaagatatataatgttttccggaacctataaatactactcctgtatattatggacattttccttctaatcttagctggtaacgggggtctcatagatgattcgtaggcaacatttaacgagaataattaagggtgtgaaccgcagataaccaaacttgtttcaattaaaaaaaacaactaaaagttgttaaatacaacatccatcctaaaatatagcaacatatatagttcatagctaaaaactgcatatattttaaggcagaaaacgcaatactataatgtaagcataactttggccatattaagatatgactaacattgaagttcattaatccattgtcgagccattaaagtcatagttctctccgtccaaaaataataaatgcatccatgtaattcaaatttgaactacacgtctactacaattattttggaatggaggaagtactccctccatctacttttgatagtcatatttcatcttggcacacagatcaagaataagtaattctacttatcatctatttaaacatgctactaatatttcctcgtagacaagtgattcattagtatttacatttctcgatgcccatacagccaatcttgtgtggaagaatggagagtcacacattaaatttgagaaagtcattaagatgataggttgttggattgaaatatgcctattaaaaataaaattttcagatttaaaaatacgcctatcaaaactagatggagggagtagtatttagaagttgttcggattgataccatttcgaaccataccagtaaagttgccaaacatgtgtatctatttagtttttttaccaaactctagtaaatacaaaagaaatcctgtcaaaacttggtaatattgctaaattgctaaaatttttgtaaggtttattttagctacaatctaaacagacctttagatataaaccagtgcgagatataggggttattcatattataatggtaagttggcaatattaccaaaaatttgatatgatttcttatatatttatcaaagtttagaaaaaaactaaatgcatatatatttttgacaactttataaaaaaataatatgatttaaaatgatatcaatctgaacacccatgtaaacgggtgcgaatgataattggcacattattgtccatgaaccattgcgcaaaaatgcgtgcggccgtctgccatccgaaccttcccgaaccgggttcaccactgtaagaaccaagccgcactcaaaacccacgtacaccccatgccttgcctcatctggctccctctcttcctctccctccctccctcccttcgctcgctttctctctcctccccttccctttcctccccttccatctctctctctctttctctcatctcctcctcgcttcttctcaagcaaagctagcggcgagctcggagtagcggcgcgctctctcgtacgccaaccgcccggctcctcctcctcctccccttcgggaccccgtgcccgagctcgccgccgccgatcgggcattggatccttccaccaccggtgttcgttcgtagcggattttatttttgcggggtttctcggcatcccctgagtcgcgggatcgcgcccaatcggtaatgtgggctctgatcccttcgtttcacgcgaatttggggctcgattcgttgctgatttctgccgcgtttggttctggtcggtttaatctgtttttgcttgcagatggcgcagagcaactgggaagcagataagatgtaagctactacttggatgcgttttttgggtgactgtttttgttgtttggggttaattccttccttcccgtgctggttgtgcaggcttgatgtgtatatctatgactatctgctgaagaggaacttgcagtcgacggccaaggctttcatggcggagggaaaggtcgccgctgatccagtcggtaatcatctcatatccgctgcttctctagttgctgccccttttgtttttttgccgggtttttctctcgtttcaatctccaaagtaagtttgtggttacggtgatttgaggttttatgtggagtgtcagagttttgagattaaccagggcgaattctgggtttcgaactggaaggggagggccttctagtgctaaaatgatgaaggaaatttgaattttattttattcagggagtaattttcagccaaattagaacagagaactcggaaaattggaagaggtttgcagattttggggcaaaatttaggtatggaagctgaggataggcagagattcaagctaaaataggaggatattttgaaatttgttgatagtaacttggagaggctcgtttatttatttatttatttatcctgagatggcagacttgaggctacttgtgtacatggtataatttccactgtatgtattctgctagctatgtaaatcgacctattgttatcaagtggatgagaggatggcgtgattgtgttgatcgcttttttcatgctctcaagcatgctgggttttgaggaaggtggcaattatttgtttttgccgtgcattgtgtaactatttctatttttgcagtgatttcatttgttgagattatttagttgaattgaagcataatcaattcgatatcctgaatgcaatgttacattgactgataatggtagcatttgtagtggataagtacatgggtgctatatatggatttgcagtacatgcaaaggagaaggcgggaagctacattgcttatttggttgcggttgtgttcatatatctagcacaatgtatcttgacatttatagccactaatgaaccattaatgtggaattgaactaaacttagtatattcagtgcaaaaccgtgctgttgcaatttgtgtgttgtggggcctgtctagattcgtagtactaagatatgtctaatccggctttaggttgctatattttgggacgaagggagttcctttatagttctgcgtatcgcagtaggtactattagtgataccagcaaactggactggaacacattgtcaaacacaggaattgaactaaacttggtaaatggaatgcaaaactgtggcattgccctttttaactttgaaatgaatttcttccttgctaaaacctgtcatatgagaaacggctaattggtaaccttctgtctttgtgggcattatccgagtgataacgtgtcatgtctcatccttccataatgtttgactctaattggttttcccgtcctaaatggttcttcagctcttctatgtggatgacatattgcgaccgctaagatccctaacactttgagaaatgataccatcacttttaagtcccaaatcaacttcttgattactgaaacctggcaagttagaaaggggtaggtcgacggtgtataagcgaggcagccctgtgggcggaaattctaaacgctgaagatagaactgtagtttccttgtggaaaggaattttctcttcccctctacgaattctaaatcttatgtaattctctgtgtaaaccttctaaatgtttgcaatgacaaaattcaggtggggaagctctccccctggtgatttagtcaaaaaaaagaaagaaaggggtaggtgagtttttttgccttgctgggcagagtatatctccaaagattccaaatacccttccttacagaagatctttaacgttaatgcaaaaataactagacgtatatccactccaagaagttctgcatgtggtttcctggtagagacccttccttttacctgttcaagaatcatgattgtaaattcttctcatgcagcaattgatgctcctggagggtttctctttgagtggtggtctgttttttgggatatatttattgcaagaacaaatgagaagcattctgaggttgcagcggcatacctagaggtatcctgggaattttttaagtcgccatgcatctattactcttgatctgatccacgtgtatttctgtcggaaacataggcacagcaaatcaaagcgagagagcaccaacagcagatgcagatgcagcagttgcaactaatacaacacagacatgctcaactgcagcgaactaatgcaagtcatccttcacttaatggtccaataaacaccctaaattctgatggcattctggggcattcaacagctagtgttttggctgccaagatgtatgaagagcgcttgaagcaccctcaatccttggactctgagggatcacagcttcttgatgctagtaggatggctcttctcaagtcagctgcaacaaatcatgcagggtgattctcttttagtttttgataagcttttatataagagagagatgggagaaattgaattttgatatgttactggcatgatcactaatcatatatcttaatctcataggcaattagttcccggaactcccggaaatgtgtctacaacgctgcaacaaatccagtctaggaatcaacaaactatggtgagttgttgcttcttgtgctcatcttgtgtcattttgtttgctccattaaaatgtaaaagtaaaaagatagatgttctttccaacaggatataaaaagtgaaggtaatatgggtgttgcccaaagatctttgcccatggacccatcatccttatatggacagggtattattcagccaaaacctggattgggcggtgcaggttagtcctttcctatgtatattgtgaggtcacttttgttgctaaagtgaaactgcaataatgtggagttacttgccttctctaacaacaatcgatttactagtctgtcattcttgtaataacagtaacatctaaggttgcgaatagtaaatataaattgccaaaacaaatggatattaaacaagtactgaattaattattatgctgtttctggttggcttttgtggtgaatattgcatggatatatttctagtctaaaaagcaaatgttgttgttctcaatgtagaaaaccatcctgttctcgttttgtttgttctgattttttggatgtcctttttgtttgtcaattgttgaaatttcttcttctgctgttaacaggactaaaccaaggagtaagcggtctaccattgaaagggtggccattaactgtaagttcatttatctattgtcccctttcttcatgtttttattactatctaatcaccaattaatgccagtgctgccatcctacagggaattgaccaattgcgaccaaatttaggtgctcaaatgcagaagccatttctttcaacacagtcacagtttcaacttatgtcaccacagcagcagcaacaattcttagcacaggcccaagcacaaggcaatcttagcaactcaagtaactatggggatttggatccccggagatatacagcactaaccaggggtggcttgaatggtaaggatggacagcctgctggaactgatgggtgtattagttccccaatgcaatccagttcacccaaagttaggtcagaccaagagtatctcataaaggttggtttatttttggaagcgcacttctgtttgtgttttcattgtctctagtgttcaaccatctgactgtacctgcaagttattcaggtacaacagacatcttcccagcaaccgcaggaacagcagcagcagcagagccagcaacaacagcagcagcaaagccagcaacagcaaatgcaacaggtactgacaattcgcccaggcttaacctctggatttgttttcttttcttgaaagttagcagatgtgtgcatatattgctgcaaacttcaaactttaaatctgctcaacaaaacatcactttgtgcctctacaattgcacttttgcaagcaaattaagcatagtagtttattatgagtgagttagatgtactgattgttcatagctgaataaaaaaaatgatgtttgaggctccgttgggcactgcattggcttttctcaattggatcgaaggagttagttagaggtgtttaaattagagacgtgaaagaaaatgttactgggatcagcaaagattctcctaaccgactagatccctaagcacaggaatagcaaccacaaactaactataaagcccaaagactattttctgttggcgatgtcctgcagctttctgattcttttctatagatcttgtgaattatagtttagttagatgtattgtgtgtaataggaatcatattgttaatcttggggtgataagactagattttgtgttgatcattcgctgcagcctttgtattgttttctatgatttttttggtcaatgggtttctttaaaaacaattccaagggtaagatcgcgtaaaggcaatattgaggacagcagaatgactgggatataaaattggtatgccagattattgtagttacacacatccaatattaattacagtttcatggctttttttttttgtgaacatgcaatagctttgcatgtcaatatattagacgaagattaatacaactgtggtgcgcctcaatggctactggggtggcagggagaggagctagggaaatacactaacaacaaaggagaactaaactaagagctgaactccaaagcagaaggtaggcaaggaaaacaaaacgggctaagctatgtgctgaacaaagctcccacagggttagcggtcgctgccacccactgtcatcctatttgctatggatgacgtcttttttttttctttttacctgtctactaaaagtcgacagattttgctcctgttttctctttggcatatacaagagaccaatttgtcatacaacctacatatctatttatctactatattattaaaacaaccttgaaataaggcaccaagtccgttgtaggggctagaaattcccacattaatcggagaaaaagaaaagaagagtccaaatagaaatacaatttaaaaatagctgaaattcggaattaaaaataagtaatattgaaagaagaatccatataataacccaataagagattaatcaaaattcggaataaaaataaaataaaatgcgaaattagaaaagaaagaagagtccaagtaggaatacaatttaaaaataacagaaattcggaattaaaaataaggaatattgaaagaagagtccatataagaacccaatacgagattaattaaaattctgaataaaaataaaattaatcctaaattagaaaaaaaaaagaagagttcatgtagggatacaatttgaaaataactaaaattcgaaattaaaaataaacaatattgaaataagagtccatataagaaaccaatactatattaattaaaattgaaaataaaaaatcaaataaaatccaaaattggaaaaaaaaagagagttcaagtaggaatacaattttgaaacaattgaatttggaaataaaaaaataataaatattaaaagaatagtctatatagaacacaatacgagattaattaaaattcgaaataaaaaataaaataaattcagaaaatagaaatagaaaaataatagctcaactagaatacaatttataaataat

SEQ ID NO: 66010 - DNA, 2493 bp, Oryza sativa
gagagacagacgaatgtacgtgattcggtcatacgaagtatttgttaattggtgtgttacggtatatgtacacgaagcttatgtggaaacagcttttgttaatcatcatagtacgaaacaaccatcccaagctaagaaaaggaacatgcaactatatattattaaccagaagaacagaagcaggttaatccggtcttgagaaatttattatcctaacaaggcacggagaaatcccataattacactgctccacgtcccagtcgtttcccgggtctagcattcggggtattgactacacgctgaatttagtgagcaggtcatcccgtcaagagagccttgcggatgacaaatagcaaaagaacatagattatttcatccataatggtgccccagcagacatcatagctgattcagtgatagagcttgcccagatcatctttgaatttggtctttatctgctccctcttcagtttaagtgcagctgtcaccagcccagactctggagtccatggttcaggcagcaacacaatctttgctggtatttcaaacttctcaagcctcgctgcttttgcagcctgcaccgttaaaacacattgcgttagatatcatggagaatgatggtatgtaattaacatgagtataaaaatcatactagtattatcatttgcaggttaagatcgccttagattacaagtacattaatcagcaatctgaatgacatcaaagacgatggattgcttataggaatcatctgtcatctccatcgcgatgcttttttaagtactttgtcatgcaaacataaactgtattgcactcatgtgatagcaaaatcctctgaaatccacagtaggtcggtctccttacattagtcacaggtcatctaatcgccaggttagtaaagacatacccatttcgtgtcataaatctgtgatgagctttggctataatcaggataacacagcagaaagatcaatgtgctactagttgttttcagttatgaagatactacaggctccaaataatttgaagaatacaatatgttcttcagcataattatatcctagtagttctataaacaagtctactgcatccatcttatctgttgttgtactcactgatgagcttgtaaaatccatcagcttttgcacttcacctatgttctttcataatttatatctttcaaatgtaatccagaaaatggcattgtctaatccatgaaatgaacccatttcaaattaaagatgataaaagaatttttaagtgctcctttggatattgggaaatattcctgcttcttctgggaaatgaactactacaataaaattcctgcattttaaaggagccttgaaattttaaattactttaaaaatagaaatgaaaacagtggggatttattgaatttctatgacatataaaacggacgattgattagagttctagtgcaagagttactgataatttgaatttcattttgatttctgaaataaagatggacactcagtttcaatagatgctcagataatgaaaacaaaagaacgttaaattctagcaatagacagctgatagatcaagcagacaactctccaggagaaatgcaagatcatactgatgtaatggtacatagaagtgatcaactcaagtctaacctttgatagagattgctggacctccttaatggcttgatcattgtggcacagctcatcaaagtttttgtagttaatcccagaattttgagcccactgctctaaggcctggtgcgccggcactaccaacgccacacaataattatgaaatggatcagcataaaccattatgctgtccacataattgctagtagttagagctgattcaacctgtaaaggccagagagaacgagagagagagggggtttaatataattataatacaaaaagaatacccataatggttgaggcactattgtaaccaaaccttgccaagagacacatattctccatgctgaagttttactatatccttttttctatcaatgatctcgaggcacccatcaggatggaactggccaatatctccagtgtaaaaccagcgcattcccctctcatctacctggagtaatcagaaacaaaaattgaagtgaaaaatattgtatttgaccaccaaggatgattggcaaagatcctttaccttgtagacctcatttgtttttgcttcattgttgaaataaccttttgttatgctgtatccaccaactacaacctctcctcggggcattggagaatcagaaattttatagccaccttcttcccatgaaacgagctgaattcatttgatcagaaaaaagagaattagagatacatatacaacatgataagagaacagaaatatctcacaacagaatgaaatgcttgctaataaaccaaccaaaactattgtggtattgtaaaataattttacagacttctgtgtgccactttaagttttagaatggggatgttggtcattcttaaggtaaca

SEQ ID NO: 66011 - DNA, 5855 bp, Oryza sativa
ttatcgtgtgttacttaaaactaagcgtaaattatgtatatataagactagcaattagtacacgagtcgttgtcagatgcatgtttgcattgttcagagatcgaatatgcacacgttgcattgttcagacttcagacaccgtcaccgtcttgcgcctagctacctcccaacacaaggtccaaattggcaggttaattaattgctatgactaattaagctgtgattaattacgatgagaagaatgctacactgcccacgaccattaaagacaggaaccacaccatcatgacttcatgatcaggttgttgcctttgcctgtgaaaagtaatcagtataaatcttttctcttttttttccttcagaattttatttatttttggctttttacaacttaatttgtaattaattaccacacagaagtacagaacatacacacccttttatatacacgtacctagcctagctatcttctgcaacaaacaaatgttagtatttcttacaaaaattaattaacaccagatggtccagactaattaattaaagtaccccctcctctcaaaattttaaaactaagcctttttagataattaaaaattaagcctagttaatcaactgatcattatacctcctcctacagctaatggatgacattgtaatttagcgcacgtacatacatacatacattatccaacatgattaattagtgggggaaaagttgattgattagtgcccaaaaagcagcgggttacacggcgaagctctgctaatacgacagaatccggtgttaaacccttgcacgatcaatggcctgtctttggactagcttacatgccagaaagctcttgtctgctaatgcaggcaactgtccgggtccggaagttaatgactatacttaattaaccaaaccatataattatccataattaattaaactcagatctatatgattaatactatatcgaaccatgcgcatatgtcgccctaaaaatctagctagggtgccgtcttttcacttattcttatacttatcagccaaactttaaattttcaatcttaaatttggagctgattttgaggtttttttcattgaagtttagtttttagcctttgcttttagatcgctatgtaaaagttttactcacaaattacttttcgtttgtaaatatgacgtttgtcttatttcgtgaataagcgaaacgatgggtccgctagaatgtatgcagttgaagtagctcggaacaataaataattacttaacataaaaacattaggactaattaatttcacatagaaaaaaattaatatgttggtagattattcgtatgtaggtagctaatatatgttaggatgtgatatagaaataaataatatgttagtgtgtacgcgtcaaccaaccacaagcacatctgtctatatagtatatgcagccaataatgaatgaattagcagatgtggttagcagtagctaacacaactacttttcgtgcgagaggtgttgtcgcacactaatgggaatgaataggactggatatatagagtatggtatgatggttaattggtcgatcaattaattatgacgcatcagtgtgatagctatatatatgtagctagggtaaatacaaatatatgttactgatcccaaccttgctaattaatttaattatcagagacccaacacttcaattaattacgtgtacgtacgatatataaggccagcccagctagcaacttagagctcatcgcttgctcatattccccactaataaaccgttttcatttattgaagaataaaaattaatttataaaaattaatttatatatatatatatatatatatatatatatatatatatatccgtggcgcgtctctgagtgcggagcttctccggaatttccgtttttctcccaccgagcaagactttttttcccggtagggtcacgccctctagcggcaggacgacctccaagtccctttttaattggtgtatcagtaaaatagttcccgagtaaaatcaggcctatgctcgacacgtagtaaaatatttactcctgtttgtttggggcttgataaaaatcatcggtcagtaattttttcactcatcgtatttcactgccttgttggagtacaaaaaattttcactcctcgtatttttcactcgtatttcactgctgattccattcggagtaaaaaaaatcactgcctagattaggtctcagtgagaaaaataccatgtcttatctcatgtagtctcatcgaactgtagtaaaaaaattactcatcagctaggttatttactaattaagatgcccaataaggaagggtagtaaaaaaatttcttttaatataattacatagatagtaattttttactgcacatgtttttacgtacctttcccacctctaccgtcacaagtaaaaaaattactgattcatctctaaattttaattttcctttcttgcccacctcgtatcaacactgagtaaagaaattcatctaccctaatttgtacgtggagtaaaaaaatcacttcgtcgtctctactttaatttgcttgcacaaatcatcctattagacagcaagtaaaatattgatcattttggatccgttaatagtaatatttttactcctataatttttatcacttttcggtatgttgatattaatatttttactcacgtctatttaaggtgcacaaaaatcacacccaatcaggattattcaatcgtgatcatactatccacattaaaaaaaattacagatcgaaagaggaagaaaaacagaaatgcatctccgctttctcctgttatatatgatccagtttttccgttcctccgttcctatccaaattccaccttttccgttatttccattttttcgctttctccttttccgttcctatccatgtagtaattcccattcctaaccacgtaagtaattttcttaagaaaaatctttgaagtattttttttactgatagtatttccaaaaggtcataatatgatattatcatatgaacactacgtcgtctctgtctctgtggaaaaactacaatatcatcaatcctttagtaacaattcttcccacgcgccgtcgacggagccgctgggagatgaggatagggccggcgcggtcgatagcccctccgtgcctcctcaccggtggaagggaaggaatgcaggtgattggaacgcctccaccgtaatcgcagcacgccgtttctcctcgctgatgccaaccatcccaccgctgctctcctcgtaccgtccacagattcgtataaatcggatggaaagaaaaagttggattagaaaatggccatagcggccatagcggcctcccagcagctgcgcgcacggcccatccgtctccgcgtcaagccagagtaagggcagcagccgccacggggttggccgccgggtcagccaccatgctgcctccctcccatggctgctgcaggtgaactaggacgcgaagaagatgaggagatcgtcgccgcttgccgactccacgccagatcttgccacctaccacctcataccctgacgccgacggacgcctctctgcctctccagatccgaagaaatcggtggaggtgggtgaaatgttctgggaacataaaccccatatatatatatatatatatatatatatatatatatatatatatagacacacacacattagagtaaaaaaattactacagtagagagagtgggggcaggggtgtggaacgagagtaaaataattactggtatagagggtggtgggagatggagtgcaggatcgctgtgaaacgtgctacttagtttcgtttcgtagcaccctacgtgctgtctagtagttctatatatatatatatatatctatatccaaaaacagccggcgcttgatttagaaattttaaagtcctactcggtactagccgtatgcctcacttatctgcctatttaagcaaccaacttcaggtatccctagtcatatttgaactagctaagcgtttaccatctccccaggcagttccacccgaggggaacacttctctacggatactggttctccagacgcctatgcaagatgcaggctaaaaacgagaacatccgagaggtttctcctatagggtccctagcataaacgcttatctagagcaaacaaatagggaaacttaaagaaaattacttcatattaatcaaataggcttacatacggttttccctttcgggaaccccgaaggtagatacaaacaagtttttctcaccttacaaacctttatattacaactccttgcttcaatatatattatgcaaggtaggctagaggaactactactaagaaagatggaatggagggtgagagcgcgcttggaagctttgctctgaatggtgtcttcgtggttgtgtgtctccggagtgaaggccaacgtctccttttatagaggccagggatggcgtcgcctgtgcctcctgcttatctcttcgctactgtatcttcacgggagctggctaaagtcgaggcctttccaccgaaagttttactcttcacagtgatatgtcattcaacgcaccctatattgtccccttatcctttatagggtgtccttctggattctttcttgggtaatcttctgaatttcttttattcttttattcttcattcttttattcttcttccacgcccaaattgttgatattctattatcaatatatattgaaaaacatatttagcttatattaatttattcatctggttgcccatggccaccaagatccattgtgtccaaatcagaaaaagaaacttctaatttctcatctactgccttttttatttgctcaaatttctgatccatttcttgttttaattctttaagtatttcttccttcaattccttctttaactgtggggaggcttcttcaaatttttctattatcttccaatcaatatattccccatctaatggatccactccttttgttaagcattccttgtatgtgggttttttaaaaaacccttcttcttttatagtcatcttaacgggtatttctgaagtcttctttcctttagcttttttgcatttttgaatatattcttttgcagcaggctctagataataatttattcctaatatttttctagcttggcttaatgcttcatcaatatccttatatttcttccaagatattcctcccattaatttagcatctattttttgagccacaatttcttcaaaagaaatgtagaccccagggagctttccatcaaatactacatatataggcttttgttggattacttcatgatcttcattggcaggcattaatgacccatttattaggtgaaaatattcagagaggctattcaatattgataacaaataccctttttcttcccttttattattgtattggtaccagaaattatccaagatgcactcttgaacttcatctaggattatatggtcctttggcttaaatttatatgaatttggtgggaatattctgagtttgttgtcatctccaaatgtgaagcactcgactccggcgtaattcattgatcttttcatacctgaaatatggttaaacgagaaagcatgtcaggtaaactattatctttccccttaatatgttcaaatataactctataaccatttcctgtaataatatcttcaaataaaatccatcttctagttgagcttttcttgctattaagctggttataatatctacagatggcttcacaatcagttctaaccgtgaattctttaaaccctaggtataacctaaaggcattaattgcattgataattgccatgatctctctatctgtattattgacagtttttaatttataacttccaga

SEQ ID NO: 66012 - DNA, 7818 bp, Oryza sativa
caacagctgacgatctctcagttatcacacaggttcttgatatttttggtcatgcttcaggacttgtgactaacatgcagaaaagctcgataactcccattaggtgcaatgaggatgagttgaaagtgatttctaacatgctgccatgtgaggtcaaggattttccttgttcatatttgggcttgccgctgaacattaagaagccttctaaagccaagttgcaagctcctgttgataaggtagcagattacctcccaatgtggaaggcctccctcatgaacaaggccggtcgactcatcttggtgcgggtggtcctctccgcctgagttgggcactacgtatccgttggttatggctccagaagacagatagtgaccgtgcgtggcaaggcctacccatccaggttcctcgcatgtctcataatctcttcagtgtggctgttgaatcacgagttgggaatgggcagtctactttgttttggactgataggtggttactaggaaggaatatcttaaaaatggcccctaatctgtgtatgttggtcgctaagagggtggttaaacgttgtacagtggctcacgctctcaataacgggaaatggatcacggacataaaagggcccttgactgtgcaagtgattaatgagtatctccagatatgggactcagtttttggtatagggctgcaagaaggcgtcccggatcagcatgtttggaaactaacagactcagggtcctacacttccaagtctgcctacagggccttctttgttgggactgtccgttttgctccttggaaaaggatttggaatagttgggctcctcttaagtgtaagttttttgtgtggttggccatttacaacagatgttggacggcggatcgacttgcaaagcgaggcttgcctcaccgggacgcttgtccgctttatgatcaggccgacgagacgatacagcacatcttggtttcctgtgtgttcagtcgacaagtttggtccttggtcctgcaaaggcttggtttctcctccacacttccgaatcaggatacacgtaagttttcgagttggtggtcaaggacagtgaaaggcttacagaagaatgagaagaaggggctcaattcgctagtcatcttagccatctgggaaatttggaaacatataaatgattgtgttttcaatagagctacgcatagtgtgcctgtggcaatccaagccatagctaatgagggtgcactttggtgttttgtgggagcatcaaaactccaagagctatttgcgaaagcaatagctcctgtaccataggaggtcgaagcgcgtgcttgatgttttgtgtgtttttgtgaggtgttattgttttgtataaccttggtaggtgggtgctgaggtttgctaaatccttcaccgcttgcctctttattcttgcttaatgaaatgatacgcagatcccatgcgtattcggaaaaaaaaaatcttctcatagagttttttaagccttgggaaacaatttgcatggttattgcttgaatgttcatactggtaaagatttctctcaagaacaaccaactaatgaagatagtttaggcaagacaggtaataaactgattaaacaatgtaaaccaaacagacaaaaatagtatcatatcaacaacatgaactaccatacaagcttcggtattacatttcatccaccaaacagttcgcccaaaatcttaaaagttgctgacatataaggatgacccatacttcaataaaatgtgtaaaattacccatatataaagaaaaaaaagaaacggtaggaatgtactagtttcccaagtggataattataagaatgaacataaatactgcacaaaaaagccacatatgggttgtacctcattcagtgaatgcaccagtgcatcctcgccaagagatgcatagatagttacaactgttagattttgtcgaaagcatccctgacaaaataaaacaattattgtcatacaggttcataggttctcacaaatgtatacagaaagccacactatttattataatcacctgagcagcaatgatccactcagttcttgtatcagcaaatattgcagcacgactatctcgttggtgacccaacttgatgagaccagaagaaaaattacatgcacgactaaatgcttctgcgtaggtatcccattcatattcacctaaatgcaatttctcgaacttcctgccatcaggtgactccacaaattctctattgattagcttccttgtgccaagacacctgtgtcgagggtattttttgctagccatctcaaataaagctgccattgtggtggcaccctcccatggaacttcaactaacatggaaaatctactgtttcgcatggcaagtcctgcctcaccacccacatcagcttgtactgctcttttctttccctttttgttgaatatggaagaaagcatgataggaataactacagcaagtagaatggcaccaataattccaggcagaccatactctttcaccagtggaacatcacttgtggcaattctttgaagaattgacatgtttggattatcgccagtattttctcccatgattttaagatttcatcaactgaaagatttcacaaatttcgctacaagaaagtataaagtgttaataaccgtcatgttagtatgttgcaaataagtaataactaatttcttctcaattttataaataattgccttgaacagaagaaatgagtataactagattagtgcagcatggagaatgctttcgcactacagtagcattctatttaacattatgaatcatggaaaaatgaaaaatactagcaatgaacaatatttagaagcactggtactcttcttccaactaacaaaattaaaaatgatcgtatggtataaacagattcagcagctattagacagccttgttatgcagagcaaaaaactgtaaagtgcagtaaaacagtaaatacttggtagttttaatctctttgagtaaataacatatccgcatctccagtgaatgttaaatggtattgctcagagcaccgcacaaattattttatgatgacaacaaaattcccaaaggtcaacttaagttgctaaaaagtacaataatgaaattgcttgtgaatcctgcagttgcctacttctacagtgagaacgactcaacattacaagctgactcgtggaagcaacagcactatcacaacaggttagcagtcaagatgatatgtaagattcagcacgaagcaacgaagttgacagaaatattttgtaagtggagtaagtagattagcaggaatcttatgacaagttgaagacttgtagagaagataattcaataaaatatagcatccatctctggtttgctcaaagggccaatatcttatggcaaggtccttcgaagttgcaagcaattacaaagggacacggatttacatttgaagaaaaaaaaaagataacatgatctcacctaagaaacaaggagtaaagtaaacaaccactttgtgcaaattagcagcggtaggagaggaataattgaggcttgaggaagaaccattgaatagggacattaattaaacggttaaagttataattattccttactctgtacagcagcatagtctgtgcgtgggatcaaaggaaatcaggggcggatcaaacttgggacatgggggctcaaacttttgggggagcaaacaaattaagaaagatctagaatagaagctagggttaacgcgagcaaattccaggcaaaagtactcccggtgggagagagagatgaatcagaaagaggatgtggatgctcaccccgatcccctcccctcccctcccctgctctgctcgccagatggagatcggcgcacctcccctccgttgctctgctcgccagatggagatcggcgtccggcgtcccctcccctgttcacccgcgactcgtcttggcgcaaggagcggagacgacgagacgagagatttctgtttcttttacgccaagggaaggaagtggaagatgctcgagtgctccaccttttgtataaaaagctttcaggccgcgttcggcagttagctttcccatcttataatacgcatttcaaattgctagatggggttgtttttataattttatataaaaatattgttttaaaaaataatattaatatatttcttgagttagttttttaatacttaattaatcatacgctaatgagctgctccgtttttccaaagagaaaggtttccaactcagggcaccgaacgcaggctgcgaacatggaaaacggtattgcccatgagtgtttgattaattaagtattagcttaaaatatttaaataatagattaatatgatttttctaaagcaacttttctataaaaattttttttcaaaaaaacacatcgtttagcagtttcaggagcacaacgcgtgaaaaacgagaggtaaagttggaaaagaacacagcctgttgggcacccacccttgctagcatttggtgcggataagtccactttgactccctcaactatagctctactatgattcatatccctgaatcgtaataccaggtatctcaccccccctcaactataaaaactggtgcaatttaacttcctcgttttagtgggtgttttcgctgacgttgcactttgacttgttccaatccgctgagtcacctagtgggacccgtatgtcagtgccacatactctcttctcttccttccctttccctcctcactttcctctctcatggaaataacaacatacgatggtgattaggggaggtcatcgttgtgtcgccaacccctctttccccttcctctcgtctccgtcggggaggacgaagcacgagcgagaatgacagcggcagtgagaggggaggctgtcgtcgtgccgccgtctctcccgtcaccatctccgcctcccctctgctgccctttccactcgccgtcgtcgaggagcggaaagcacgagcgaggatgacaacgatggtgagaggggaggtcatcattgcatcgttgtccctcctgccaccgcctccgctgctccctttcgttcaccgccatcggggaggaggaagcacgagcgaggatggtggcggtggtgagaggggaggtcatcatcacgtcgccgtccctcccacccataaccttgcatggggaaagccgccgcacttactctgccaacaacgcgtcatcatcgctctgacggccaccacgctctgtctcatctagccgattccgctgagggaagagaagaccggagtggcacgacacgccgtcgtcacctcgatggccaccccggtatgtctcgtcctacaccgctcatcccttccgccaccgcctcttcctcacctttgttgtcgccaacatgtctgatttcgccgagagaagagaagactggagtggtgtggcgcctctgccctgccttcctgccagcaatgatgagagggaaaagataaacgtcattgataggtgggtcccacaaggtgacatagcaggttagaccaaatcaaagtgccacatcagcaaaacagtccttcaaaaccgtctgagggagttaatagtcgagatatccgatattgcagttcatggatatgaattagatttaaccactaaggagtcaaagtggacttattcccattggtgctcgactcactaaggcctgcgtgactgcacaattaagaatgtagcccagttactcctcccccactgctccatccatttcaaattacttaggtcccgttcgtgtccactagaaatagttgataaaattttgaatatttgtggcacgcttttcaaacggctaaacggtatgtttcgtgcggaaactttttctatatgaaagttgctctaaatatcaaattaatctatttttcaagtttgtaataattaaaactcaattaatcatacgttaatatcaccttgttttacgtaaaacacttaatcttaatcttaatcttaatctttatctttaggaaaaaagaattattctaatcaaacattttaatctttaaccgttaatttctatatataaaaattttaacatcataagaattacacttttgacactatgagaaatatttttataattaacaattcatatgtggttaaactgaacataattctaaaaactaatgttaaacatagggatgtttcacttaggacaaagcctataactttaagtaatttgaaattgggaaagtagttattagtagtatcaatagtaaaccaacatgcatattagcgatcaccagacccgttccttttacacccgcaacagtagaggcgtgagaagatataaaacacatgtgtccttccttttacaaaaacatagacaatgtacttcctccgtcccaatatataacaacttaggatgggattagaccaatcctagaactacggatctcactactacaaaagtgatttttctgtacgagagcccatgaattttgcaaacggaccattactagtggcgtctgcaaaaatcgagggtcattgtcccatacggctccttaagtggcccgtatggaaaaatcgattttcccctacgggcctcttaagatggccgtatgcaaaaatgagtttatttttgcatgtggctgtttgacgaccaaatttggtaaattatgaaccacgttcgacattgagatcgaggcggattcaacaaagaggttgattcgaagaacagagtatgcatcggctagaatctgcattggctgagatggatcggacagaggacagccgatacagccgatagaggtgatgcagccgatttcgatgatgacagtttcgaagatgtttctagaatcaatcaaggtgcttcatgaagattgctgtgatggagatagggctcttggataggcaattgtatctattaattaggatattttatgtaatttctttagagatatgtttgggcaaaagtctgctgcaaagacttatggtatcttaaagtttattagaggtaaatgtcgtgtccggcaaggacatatcttgtatctcgggtataaatagaacccgaacccatgtaatcaattaacaattgttcaatataatctcggcgcattgccattgtcagggttacgggttaggtataccctttacccttcgatatacgtcgcatatcggtatggcatacccacgcgcatacagataccctccgcatgcattaaggaaatccttcacggagtttacggatggaaagagtcctactcgaaccagactgggtcgtcaacgtatcgtgtgaggtttgatgtctctgagttctacttggaaaccgcctgacctgcgatataaaagggaccccccggggaggacctaaggcatcgaatctcagagccaacacaacccccacagcctacgaagtcggagcctgcaggagccaaatcgctggggatctagtcgaaccaacttgactacgatctcgccagatccatcgagttccattgttccctttgtaacctgtgttttccatcatataatcccacatcaactggattagggctattacctatcaaggggcctgaaccagtataatcttcgtcttttgtctgcttgatgtcgtactacatagacccttgtaccaacgtaccccaataccttctatatccggtctacgggtatcacccgtcgacagtggcgcgccaggcaggaggacttggtgctcaaggttctactactatgtcatccagcttcgtcgacaacagcgtcaacaccaactcaaccaagtatttcctgcttcaacaatgctggtgtggactcaagtcggcgaaatcgtcttcccggtttacaccacgatgccgatctcagccggtccatcaatga

SEQ ID NO: 66013 - DNA, 8388 bp, Oryza sativa
gtacacagtccacatgatacacacaggagtccatattgattgtgtcaccactggcttgttgcattccaatgcacatttgcaccgcatatattgcatctgtcacttgacagggcatgcatacatatattgcaatattgcattgcaagcagaggcagccggcagagccaggtactcgatctatgcatacatgcacttactcctacagtgccagtgtgctgcaggccagcactcaccaggtcagcatacagcagtatatatactccctccgtcctaaaaagagacaaaccctaagccgtgtccaacgtttgaccgtccatcttatttgaaaaaatataaaaaaaattaaaaagacaagtcacgcataaagtattaatcatgttttatcatcttgcaacaatgaaaataccaattataaaaaaattttatataagacggacagtcaaacgttggacacggaagcccaaggtttgcttttttttttttttgacggaaggagtatatatgctcctacagtgacgccttaatttcaagtcgaggctagctattgcatgctctgcatgccactccatatctctgagactctgaatcaattcgatcataattcagagctggtagctatgcatttttttgcagcgacttcgcagtgtgtcttgttcacgcatggatcgagaaagccagtaaaaaaaaaggaaatttaagtttttttttaagaaaaagacacggtacaaagacaaaggttgacgcacgtagtcaagcacacctactactactgtatgagcatcttcgaaaaactgtccgaccagcatatcttagtgttaagacttgagagtgataaaatcactacagatatgagcatatcttaagagattaacgaagtcagcataggtgcttcatgttgacgcgatcacctagctaccatcgaaagaacaattagcaatagaatacgagtactgggataggatggttgctaggaacacttaatttgtcgtaatctgccatgtaggttagacgagtttaaccaagaaaatttgaccagttgtgataatatttgattccaacaaattagctcctacaagtcattgacttaaaaaaatgtgacaatattttcttatccttgataaggtgtggcacatatttaaatcaattttagtaggcaaatgacatagtaaagtgtagatgagtagcgtagatgagtttgaagacagtttgttgccaccttagaagagtatttgctggcaaaggacgataaactatggctgtacaatggaaccgtcaattcgagtatacctagttgccctaagtcgattccaacatttgccaaccaaacttgaactatatgacttggcagacaaattcggacggacggttagagtgacactcagtttgtgaatctaagtttatatcacttatatatatatatgattaatctacatgtgcagcctgcagttacggcacaaattaataaattgttgctgaatttaattcaaagccacgatcgaatttaatttggaacgaaggtgatttaaatgctgggcacatgtacagtaccaaactgcagtgtacgtagaacgtactaggtactgtacgcacgcacacagtacagttggcacttccatgatctcgatcgcggtgagctcaatcgcccgtccgtacatcgatcatggtcatggattattattgggtgatgcatgatcaattaatggctaattaaccacaaataaatatatgcatgattggatatatgggggatcgagcgagattgatatacattgtgcatgcatcctttaattttgttaggagggaagaaccctactagggcacgcccactctactagtgtagtgtgcaccccaagttagaacacaataataatgcggtagaaattagatatattatgtcgcaattataacacatattaatggattttcaactaattctgctgctaaattatgaataatggatcgacaggcagaatacatgcattgatgcatatagaacatggatctactggttgttaaaatatcatatcatcatatagggagtatttcgaagcgcttggacaatagaacatgtagccacaagaaaaatcatcagggtgagattgatattgtgttttttattaataggaaaaaacatcatttatttatctaacaaattatatgtctttgtcttaaaatataagaaattttatccatatatattttttacattccaagataaaggttatagtatatgtcagttttacataagtggaccaatactaaagaaagccaataactatctcatactacatttactctgacaacaaactcaatgtatatataatccttactattttctagctaataacaaattagcaagacattgcatgttggttgtaaagagttttgtgcatggatgtatacacttgtccattactcttatgcacaaataataaatagacatggagaatgaatattgatataacgataatttaaaaatagcataaaaatgttatatgatgatcaattgaaaataaaaatattatatgatgaccaattgaaaataaaaggagtataactcaagtgaatgggcactgcaggacaatcgtaggagtaccattcaccatgcctttcctgcataaatgcaacaaccatcaactcaaaagcagacaacaaattactgccaggtcaccccaaccccttggccccactgtcagtgactaacccccctccatcgtcctggcccactgaccccgtggccccacccaccatcttctactccctccataaaaaaaaagacaaactctggtttccgtgtccaacgattgaccgtcggtcttatttgaaaaaattattaaaaaaattaaaaaaacaaatcacgcataaaatattaatcatgttttatcattttatcatctaacaacaatgaaaatacgaattatgaaaatttttcatataagacggacagtcaaagttggacacggaaactcagggtttgtctttttttttacggacagagggagtacccatgatctgcctgtccatccggccccaccactccacaggtcagccactgtcctctctccccccgacacacctgccccgcacgtgcgctccactgacacgcgggccccatacctccccaccacgtgtccacctcccgatccgcatccgacggcgaagggaggctgctctcacggcgtgcgtgtatacgagtacgacaagcggcgtctcgagccacgtggcggtgaaggcgtattctaccggaatacgccttcgcgagctgggacgcgtacttgccgccgtttataagcttaggccgtcgtcctctccgcgagggagaaaggtgagcagtagtaaattggacaccgcaccaccaccgaaaagctcgcactctcctaaccatggcgtcgccgccgacgccgcagccgccgccgccggtcgacgtcgacctcggcaagctcagctacgagatattctccctcctcgagagcaacttcctcttcggcgccggcgccggcggcggcggaggtgtttgctcgctgcctgggacgcccgggagggcgcttcttggagggaaggtgagggtgctcgcgatcgatgggtgtggtccgggaccaggtgatgctctgctggcggcggcggcgctggtgaggctggagacggcgttgcgggagaagtccggcgatggcgatgcgagggtggcggatttcttcgacgcggcggcgggggccggggcggggggtgtgttggcggcgatgctgttcttgaagggggcggatgggcggccgcggtacacggcggcggacgcgctggcgttcgtggcggcgagcctcgggaagggcgggtggcgcggcggcggcggcggcggcggggggaggaggtggtggggggtggcggcgctgttccggcgcgggtcgtcggcggagaggtcgtcgctgcggcgggtgttcggggacgccacgctgcgcgacaccgtcgcgccgctgctcgtcccgtgctacgacctcgccaccgcggcgccgttcctcttctcccgcgccgacgccgtcgagagcggcagcttcgacttccgcctccgcgacgtctgcgccgcgacgtgcgccggcggggccgccgccacggccgtccgctccgtcgacggccgcaccgccatcgccgcggcgtcgggcggcgtcgcggccatgggcaaccccaccgccgccgccatcacccacgtcctccacaacaagcaggagttccccctcgccgccggcgtcgacgacctcctcgtcgtctccatcggctccggctcctcctccgccgccaccccttccaccgccgccgggtggcgaacgcctctcccctcccgctcgccgtcgcccgccgagatggtccgcctcaccgccgagggcgtcgccgacatggtaaaaaaaacacacacccacacccaatcccaaccctccatctcgaatccgacggctcccatcgaaccacgtcactaactcaccatgggtaaaaccgtaaattcccaggtcgaccaagcggtggccatggctttcggacacacgtgtgggcgcaactacgtccgcatccaggtcagacccgaaaaatctaattaccgaattacccctccatttttaccattttacccctcatttttactgacctcgtcggcgatgtgtgttcactgaccaggcggcgtcgccggcgtgcaagacgaaggcgctgagctcggtggacgcgaagaaggcggcggcgatcgccgacgggatgctgacgcagcggaacgtggaggcggagctgttccgggggcggcggctgtcggagaagtcaaaccgggagaagctggacgcgttcgcggcggagcttgtgaaggagcacgagcggcggcgggcctcgccggggctccccaacgtggtcatcaagcaggtggccgccgccgccgccgccgtgacgccggcgcgcctctcgtcggcgaccaccacgtcgtccgccaccgccaccaccgccaggaccaccgtctccagcatgccgtcgccggcggcgtcgctggactccggccgccactagcagcggcggcggcgatcgccggcgacgtcgtacgtgtagaagttttgtacatttgccatccatggacagaccgatcgaggagatggttatttaattttttttttatttacgtcttccgatgagtcactgacatgcgggcccaaccaagatggaaatgaggtgaaatatttataaacttaagttatataaatatttatgtaacttatatccatcaagcaaggatatgaatgttatttattcggttagttagtttcgtgctcgaatggtttcgaattcttctataaaaatgggttattaagatatgcaagaaacttgtgcaagttgcaaagcaaaagcagatgatgccttgacaaagtctcctcctcatcatcatccattcatcctcctcccaaaatttttcaattcattttccctcccatcagattgaaattgacaggattcggatcatcactgtcctaatcagcgattagttcctgatgttaatagactactaatcctactgccatggattgcaatgtttaaactcccatttaatcaaattcattagcctccttttccgtatcagtgtagtacattttttgtccagcatgaatgctgcacagtggcagctaaactagctatatagctccactacaacactgaatcaacgatgaacatatagtgataaaaataattaatatccccttgacgattttaattcaattcttgtagtagcttgctttcaagtgagaaaaataggctggggaagatgagacttgaagtctgcataaagttgctgataacttctacgtactcttcagctgcatcattgcctgccatggacactgtagtagcttcagattgttgtaatcctttcctgtactccatttcttgtagccttataccgtataggcgtatatacacagtatatacaaatagttttacaatggtctctctactaagtagaagtaatctagaccattcatattttgtaacataatcgatttatttatacttccacctcaactaaactttcaatggtctctatttataccattatctcaacaactgatggtagaataagtatttttttctattagtagtataactcataaattaacggttgatatcgtttttattggtgataataccaatagtaaaatattgccattatatacaatcgtaaagatatcgtatacggagtatatacgtagctgaagaagtaggtactgtgtgtaggcagcaagcccctttctgacactttagtttgatccaatccaatcctgaaaactttaatactgtagtatagtagactagtagtagaccagtagtagtttgattttggtagtccactagtatcaagcaaggatatatgttgttttcaagcctatttatttttgtttctcaccaatcatatatacatttccccataaggttggaaaaagaaacatggaaatcattcttgagtgaggacataactatatctgagctaataatatgtacaaactcggttcgaattagttggccttctcaaccagagtttatgcttttgattttggcgaaaattttggtaggaccaaaattttgtgatttttagcacttttcaaaccaaaaatttttgagatttcgacttaatttgaataaacgttgaccaactttaaaaaaaaaagagaaaacctgaaaatttcggttgatagatttgccggtggggtccaaaattaccaaaattttgttctcaacattactgaggattcatctggaacataggatctcacataaagctctacaaattacatatgattttttccaattttatatcgggacgcggaaaaatatccgtgtcccggacgaacttgaaactggaactgaaactgacaaaagtggacgctgatgggcaagctacgatcctccaacccaatagctgccatttgaactaccagctgggttacttacatggactttttcttcagatcacacggatggagaagactagcagaaacagcacataccaaactctttctgttcttgtgctcaaaaacagtggctgctgcagcatctgaattctgcatgtaccactactcaccaaattcaccagctgcatgcacagatgctactgagatttttacaggcaactcgaagacaagaaaaaaagatgagcatctcttcagttcagtacagtactgctgcaaatctgggagattcctgtacttgtgtttgatatcttaaaagattgcaaattgcaatttgttcagggctccatgcatctcacggcgctgcatttggcccaatgctcttagctagcttcaaccgcggttaattcctgaactaatttagtatctgcacacgatctagtaatctacaaaggctgaaaaaactgcatcatttttttttcagaatggaggtaaataaataaattacagtcttagagagagtgtaggtaagtttttttttcccaagagataaactaactaaccaacgccatagatctcacgtcgcccaattaccaacgcctgatctgagtgatcacctcgttaaccatcatctctcctacctctaagtgcgattttttcaccgcctccgagcagttgaaagttgttgtcactgcgatcctcggatgctgtggcctgaggatttctttttctcagtggcctcttaattgctcgagcatttgggaatttgggagcagagagattcagagatcagagagcttcactggaaccttccatgtggtgggcaaatccagcaagattaacagctttgtttaaccattcaggtaacgtgatcgagtcagacttttgtcgtcgagttttcgcggcaaatttcgcttgcaatttgtagcatgtcgagacgaatctgcagctttagtttttagtttcagtgtctgaatattttagtttcagtgaagaaacacattgatctaggagagctttgcttgattcttatttttttttacctctgctgttttcaaccaaaggtcagcgttgaaatgttaggttaacaaattactactagggtcagctacacataatgtggttagttattgttaattactgcatggtccatggccatgggtttagagggcagtaaaaaaaatgtaaaattaacactgctagcttgtatggcatatttaactagaattaaccagctcaagatcttatgagggtctcttccctagtcatatatggttgaaacgacatgaccgagatctctgaatgagtagttaattcaggttacctgctactgctagttaattagctcgtgaagcacattttttttcctgtcatgtttttccctttcagaagttcagagacttgagcaagcccaggttgtactaaactagtaatgcagccaaaatcactcagaaaaaactactaattt

SEQ ID NO: 66014 - DNA, 661 bp, Oryza sativa
catttcgaccaaattagctgatttgcaaatgatttccaccgtggtgtgacaaaattgcccctgtgaccatttagttgacttgcgtggaggagatggatccctgccctggcaccggcgcggctggggacggatcgacgcctccctcctcgccgacaacccaaactccaagctcactgtcacctacttctccccgctcgcctccgtctccctcgccccgtcctcccccatcgcttctccccgctcgcctccgtctccctcgccccgtcctcccccatcgccgtcgccacgctcccgcccttcgcgcagccgccgcggaacatcaccacgctcgccttccgcctcgaggtggatggcgcatacgtgggtcccgacgacgccgcgccgctcaagggcgggggcgttggtaccatggaggtccaggtcaggctcgccgccgtcgccgtcttcgatcgcggtggctggcgcacgcgccggaggttgggggcagcctttcccacccacgccggcgtcgtccccttccccgtccccgtccccagcttagctggcgtcgtccccgtccacagccacgccatcgagccgtgctgtgtatatgcaacggagaggaagaagagagagatgagataggataaagggtattttagtcatttcagcaagaaaaaac

SEQ ID NO: 66015 - DNA, 8523 bp, Oryza sativa
  unsure (1)..(8523): unsure at all n locations
aaaggcttgagaacctgttcttgcagtcttttgtccttgatcaattggcttcagagaaaatgtacttgtgctgttatgcacttatgctgatgaagtgaaaggaatttaggccgtgtttagttcacaccaaactttccccaaactcccaactttccatcacatcacattacatccaaaactttcctactcacataaactcctaactttttttccaaactaccaactttccctaaacttctccctaatttcaggaactaaacacagccttacaaagaaatgtaaaacaccgtcatcgacgcatgtaaaatggtcggtcaccgaaaaacgctattagttgcccgaactccacagcaccgcaggctccaccactggtgaaacaattttggttatggagtgtgtcagtttgagtgagatcccgccttgtcatgaaacgcatggatacttccattgtccctcaaaaagacagtgggtagtagtaaaggtgaaagcatggctaatttataggtgaacaccaaagcaaaagtgcagatgtgagtagttacacttgtccccatgaaagtggtaggagctcaaaaggagaaaaaaaaaagagagcaggggtcattcttccattgcctttttcaccattggtaatctaacctaaacatgatgcaaaagtttgttcacatgttgacacaaaaataaactatccttatgcaaagccatttaccccttttcctgctacatgttcagctcatgtatgtactgatagtacactatactttgatgttcttctatcatttgggggcatgcatagttgagtggtccaaaaatcacaatgggctttatggcatattggcatcctcattaataccttttctcactgaaattcagaggcatccatccatcaatcaatcaatcatcatccaagggacccaacgccaagcagagataaattcgagatcaattctatgctctgtttcagacagtccttttttatggtgtagtagtacttgtaccagtatcagcttccatgctgcattaaaccaaagcaacttctgctcatcaactaaagcttcagtctttcagaaaaagaaaacttcataatttgttttgcctaatttgcagaatacgtactttcttactaactcatatataatccataaccttgttaactcattcatagatataattatataaactttgaacaagagaagaaatgaaagaaagagagcaaggaatagcatatagtagcagacagcaggaaaagcagagccaagctcaagtcacgagcaagatcttgctgctagtagtataactttgcatttgaaatttgctcctaattcgttcgaattaaagttgacagcagtcaccatcagccaatgattggatcattgaagattttgggaaatggagactggagagtgcagaaatgcagcaaagtctgaagaagaagaagaactgaagaagggtttcctttctgatctcgcacgccatctcgaggaaattttgcatgaccaaagtcagaaattgcgaagctaactatacctaagtacgtatgtacgagcatcctttattctgttagtctcaaacgaatttgaaacggattggcaaacttgggtgatgaccattgtgagagtccttgcgtttcatcaagagtgtacgcttgggtttgtgacaaaatttcatgctaaatgcatgcttgcttgggttcgcagcctacatgagccaaagttttgtcatttgaagacaccatttttatcctgatgtcaaaattttggtaaaatcatcttcgctgtaagttcacctttttaatctgcagacgatgtcaaaagttctttgattaacttttcacctacagcttcaatccaccgaggcctttgtttggataggccccgaaatatacatccaagtttgtgggccaggattttagcccaagtatctagcccacatatggatgggctagaactgaggcccatataagcaaggccctgagactgttaaccaaaacaggccacaagcccactcaacggcccaagaggacaaccaagcccacctccaagcactgaataggctgagtttgaggcccaaccaaacgaggcctgaggctcacaaccaaacaggccaacaagcccatcatcatcaacacaaaggcccatcaggcccactccacggcccaataagacagtccggcccacctcccaaaccgccataacttttcctccaagcaatacatcccaaccaaaccgtcccgaccccttacgccactgacaccacgaccccacacctcccgtaccccacatgtcatcctcctctgaccccgcgactccacgcctccccacatctacctccacccatcgacctcttctcccaccgacacgtgggcccaatgcacgcgtggatcggtgggtcccacgtgtcagccactgccctcccggggaaaatatctcacgtcctgtgccttttaaccccattcgcctctcccttctttttcacttcgtctcctctcccctccaaaaccctaaaccccccaaaccctagccgccgccgccgccgccgcagtcgtcgccgtcgtcgcagcagcagcggcagcgtcaccaccgcgaccggcggctgcagcgatgtactctatccttcgccgcgcggcgccgctccggcggcgcgccgtttccgccctggccgccgcggttctccggcgggaggaggcggcggcggaggtggtcgtgtcgcggcgggcgacgatcccggcggcgtggttccactcctccccggcgtggctggggttccgggagacgggggccgcgggggcggcggcgaggccgcagtacgcggcggatgaggggttgttctacgaggaggataagaggggggcgaaggcgggtggagttgctgcgggcggcgcggaggaggggttggaggtggccaagctcgggatctcgcccaagatcgtcagccagctcgcctcgcgcggcataaccaagctgttcccaatccaggtatcaggagccggcagtccccccatcttctgttccatttccaattgaatcgtgaacaatttgttccttgaatcatactttcgtagcgaaagtttcatcctcttttacaaattgtggcactcatatgccaagctgcatcatgatcgcttgagctaagatttgggtcatgtagtcaagattgaagtgtgatcaataggtgcagagatattcagtgcttaagaaaattagtcagagtatctgtgagggggttaattctttatctgccctaaattatgcttctttttgtgtgctgtacactgcttgatgctgaattaccagcacttgttatgggatttctatattcagacatttaagttatacattgaaatatttgctgtgattattgtgatatccactttatataactgcacaagtagacaaatgcctggttcagatattttggtttgtttaggagtcacggggaagctgtttttggataaatatgtgcgtttgtgtgtaaataggtgtaaatagattaatagacataacacagtgcggcaattcaatcatttatatttttttattctcgagcttatagtggctcatttatagtggcttctccatgtatgctgtggccaagtttcaatgttttcctggcaatagcataggacattcaagttactttcatatattaagtcaacggttcattttgttcagtaataatcatggacttatgttttgctgctctgcgcagagagctgtccttgaaccagcaatgcaaggaaaggacatggttggtcgtgccaaaacaggtacaggaaagactttggcttttggaatccccatactggacgcaattattcggcacaatgaaaagaataggtaagttttggtcctattgtcttcatatatttttttctttactactattggtttgttcctctttgttttttgggtaacctttgagcctttggatgcaacagccctggtaaatttcccttggctattgttttggccccaacaagagaactcgcgaaacaagttgagagggaattttctgattcttccaatgtggaaacgatctgtgtatatggtggaactccaattagccagcaaataagacaactcaattatggagttgatgttgttattgggacaccaggacgagtaattgacctgcttaaaagaggtgctctgaatctgtcagaggtccggtttgttgttcttgatgaagcagaccagatgttgtcagtgggttttgatgaagatgttgagacaattttggatagagtacctccaaaacgtcaaaccttgatgttctctgcgactatgccaacttggattcagagactcacccagaaataccttaagaatcctgttacaattgaccttgtgagttttatacttgctaaactcctttgctcttggttttacacataatccattgcatagattgtggaactatatctgtttttatttaaaatgcactctcctcttgctgtgtttcaatgcattagtggcattgtcagattgtaaactaaattgccatgataactgtagttctgttgtatttatattttgttttgctagatgcctgatccttcaaaccttaaatgctactcttgaattctgttgaatcttttatattctaattaatatatatttcattggtgcaaaagaccaatgcagtataagaacttgaggtattagcattaattatttccagcaaggtataaaatttaccttgaagtacattttttttggttcgtttcattcactatcttcagtagtataactgccaaatgaaaactattgaggcaaatatggtccagtttaatctattttgaattatacagttaaaattgttcttatgtctttccattaagaagtcattggcacaatatctggtactactttatgatattattccttttataggtgggtgaagatgatcagaagctagcagaaggaatcagtctttattctatcgcttcagagggccatgccaaacctgctgtccttggagaattgattaaggtgaatgtagtttactgtcattttttatgtttgaccatatcgaccttaaatactaatttttactataaaatgctttaaattaattgttcattcatttcaggagcatgcaaaaggtggtaaatgcattgtatttacacaaacaaaaagagatgctgatcgattgtcctacaccatgggtcggagtttccagtgccaggcccttcatggggacatcacacaagcccaaagagagagaacattaaaaggattccgtgaaggccattttaatattttgattgccnnnnnnnnnnnnnnnnnnnnnnnnnnnnncccaaatgtagacttggttagtgttttccttgattattctgctcttctaattttgtatgaaatagctgtttctaggttggttttctttcgctgtgttttaggttgtttttttttaaataaaaatagcaactacactttgtgttgaacagtgcttgagtgacttcccttccttttacaggtgatacattttgaattgccaaactcctcggaattgtttgttcacaggtctggccgaactggccgtgctggaaagaagggtaaggcaattgttatgcacattttatcaacaaagtagaagctatcaggatggttgagaatgatgttggctgcaaatttacagaggtaagacttgattgtatgcaaatgcaaagctgagagccaatgtatcttagcatatacagctttctatgcaagttaattttcaaaccatttctcatacatgattctaaaagagctatccaatttgatccagcttccaaagattaatgttgaaggttctgacttgatgagtggtggctttgattccttcggtggtggtggatttggtcgtgaagggggtgggtcctatgggcgtcgtggtagttttggcagctcttcaagccgaggcggtgggtttggtgattcagggtttggtcgttcaggtggtggatttggccgttctggtggtggaggatttggccgttccagtggtggtggcttcggtgattctgggtttggccgttcaggtggtggtggtttcggagactcaggatttggtcgctcaggtggtggcggttacggtgattcaggatttggtagttccggcggtggctcaggccgttctggttttggccggtcaggtggatttggagattctggctcaggtaggtttggtgggggatttggtaactctggctcaggcagttttggcaactttggcggcaacaattctggacaatccggtgggtttggctcctcttagattggcagcttctatactagggcaaaagtaactacagttttttatctatgctatgggtgcctgctacaaatttagatggacggttttcagatattgtccaccaccacagaagggaattcctgaccaattgtttgttttccggaatcactacaagactggatatctagtgcaaatagcatatgcttatcgttattatgggtgaagggaatatgaaggcagcagaaaataatcacgagtcttattttgtttttcttagttattcctcctgcaggcattcatgtttgcaggaggactttagtttctggtgctcgatctagctcatacctgtaaaatatggcagaggatcttctgcagatgatatattataagtatctttttttggtagtagttctgtattgtatttaccggtgccttctagactataataacctagatacctaatgatcagaattgcggcttcaattctgtagtagtgttcatctgcaatggaaggatggcggctaagatgtgaccattgtctgaagtttctcgtgcttcttgcactggttgatgcacatgccagaaccaaaagaaatgggatgctttctttagattttttttttcttttccactttgacgaggctgcattctttcaaagaatttctttgatatcctggaaaagcattttcgctgaagaaaatgctggacaagctgtaatgctgtccccctcctgatgaggcagaatttatgttaatctcaaagaaaatgtgtatgccggttagcaaaggcacagcttcagtgcagaattaattaattaatgcgagcatgaattgttagtgtatgtactgctgctactccgtggaccatcagaaacgtacatgagactaaaatgtcaagagtgtattacttgaatggccaaacagtcagaaagccgagttattcaaagcgtattgcttagtacaagtcagtggccatgcgtgcacaatggccagtacttcaaagttctaactacttctaagtagcttatcaaataacacaatagtgttaaccgaaccagcaagattgtgtgtgtcaccaggatcatgtgcagctttcaagtcatattacttctctgtcggttgattggtcatacactctagcttcatttgttccttgcttttcttactcacaaggatagggatgaacatggagcttcatttggttcttggcttcttgctcttctactcacaaggatatggatgaacatgtaaatttaaagctggaaatttggaatgcaaaattgcattgtcacaactcacagtcccattactgataaaaaaaaaggtatacatatgtatagtcatggatatatacaaggccaacactgcatcgacaaggataagggagcaacttgataggagtgaatttcacattgtgttatttgagggactaagctcccaattcaaaaagcctgcatatatttgattggatgtagagacgggtaaaaaaatacctctctagaaaaaaaggagcaacttgattagattgtgacaaatttccacatgctgttactattagtgacagtatgcctaatctgtttgaccagtacttgcctgaacttttatttcttgagagctgtacttttctgaactggatagcattataaaccccttgtcattttcttatcatttgtatttggcttgcctgttcctgtcagcaaatagggctccatgtctacagctatggacctatccacagtgtcttttctatttttcgatgatggaatttaacttggcctctaaatccacattatgacaaaaggcttcgcttggcatgacatcagtttgggtcattttccttccatggctagtggacaatgaattatttttgggaggttttgctttctttttcacctcatccagaagcaaggatgaataaaatgtcctcatcatgtttaaccaagttgctgccaaaagacaatttggtcagagtattacaaatattctctctcaaagagtgtaaaatatttgctttttcaaaaaatgcactattgtttgttaagacaaaatatttaatttcagtgttttttttcaactttccattttctccaaaagactagtttttgtcaattgttttttttttcggtataactcttgaagtcaaggtaatgaacaatcactatggacttttcatgtggtgcattagttatatacctctctagtcaatcaattaataaatgtatgatatgttctaaatgccaaaaatgaaactatataaactccttcatgaaagacttgggggtat

SEQ ID NO: 66016 - DNA, 716 bp, Oryza sativa
gctggatcgaaaccggcccaagtagaggcgcgtgctgggcagcttccccagcccaggtccaggttgcggcttggggaggagggagtgcccgcacgtgcgcataatatgccgtgggctgaccggcaggccgggaaaaagtctattctaggtccctcggccgaagaaaagtaccagctaggctgggaaaaagtctgttctaggtccctcagccgaagaaaagaagtttaattttgtgaagtagaaatttgacgaaggctagaattaaaaataagaaatattgaaataataatagcgtagagtcacggtcattgttgtcgcggaagggaagcggacggccagatgcggctgctacctaccgtgctacggtcatcgatcggccgtcgattggtctgagtttgctcgcttattcgctggtcgaccgtgctgctgagccaccccgtagatctacccatatcttcagagtccatgttgactcgcaccgtataaaggtggaaatcaaaccggctttgtttttttatctccctttcctcggaactatatttctttctatcatttgagactttttctagcgagcaaaagtaccaaaagcagtgtaagaataacttcggttagaaccaaaaatttttagttttaatacaccgtagcgaagcacgggtattttgctagtacaatatcaaatagagaaagtaagcggtcatcagattgatcggtgtaga

SEQ ID NO: 66017 - DNA, 1428 bp, Oryza sativa
  unsure (1)..(1428): unsure at all n locations
taatggttgtccttactatcctgtaatttagaatatgcagccaaagaggaaacgttttgtttcttctgaaattgtaggataatttttactgagttcagtgcaatgttgtgcaattatgagttttttttctgtggcattttcgtatcttggtaattgaaaatgctgctgaaagcctgaaatacagccattctgcaacatatatgatgcagtagatgctacttcctctgtttcatattctaagtcattttagatttgtcctaactcaaacatttctaagtttaaccgagtttatagaaaaaattacaacactaaattagttccactaaatttattattgaatatgtttttatagtatatttttaattttgtgttgaaaatattgctatattttttttataaatttgatcaaacttgaaaaggtttaacttaggataaatttataatataaaacagaggaagtatcatttatctccattgttctggcttttgtccggtaaacacaagagggaaaaaaatcatctgttcttatcaggattgcgtgatatacactataatggcattagtataacaatataagatcagagcaggtaacagcagtttaagtctcataaaatacatctccagcgactgagaggacgacaaactggagattctatccaattcaataaactactgaggaatctcagctgatcagagctcaccattagtgcctgcattgtttaatgcatttcggcttaacacccggcaaaggagttgatcaatgtacccatcatgcctaaagaaacccacccaaccacaatggcacaaatcaagggggaaaagaagtcatcctctgcaaagaattttttggcacaacttggtttattctgcaatccatagtcatgccaatccatagtcatgccaatcaagtgatataacaaaatgtaagcatctgtgaaattatccacctaaggatttcaattggataatataaggggggcagaatttggtagcagatgtcagaatctgtgaaattatcaatcgaatcagaactgcagctgccttgccccaggaaattaatcgaacaaaatggttatcttcgtgacaccaatatgtatgctggttcagatcacaagttaatagatgtttgaactttaagtgcagattattaantanatnnnngattactgaaacagaacagcttcacatgctgaactttcagtgttacatgttgcagatctaatcccnnctattctcagtcaccttaaagaatgaccatttggggatagagtaataacctgagaactaacttgtcttttgtcacaatttcctctcagatccgattttcaatctagagtagacccagccaaaccaagcgcaatccggcaaacttctttgaacatacatgaatttgaatgcgcaccagataaaggtgcatacataaataat

SEQ ID NO: 66018 - DNA, 133037 bp, Oryza sativa
ccccccccccctcacctcaccattgccgagtcaccacactcccctccttcctcctaccatgaccacgttgctgttgtgatggatgaggtggcacatgcaacatctggatctggtggcgttgctccagatctgatgacccccatataggatctgatggaccctttaactgtaactagttccccaatagggaaggggtgaagatctctcgggatgatgtcacccgtgctttgcatggtggttcctgattcaagctgatgataaactggagctaacaaagatacataccaacttgcactattttgttccctccttttcagccttatctttatctttataaaactgaatatgctactgaaataggcattctaactaacgaggaatgactaactaatcctatctcaatacctgcacgcacacacatctaatttacataagagtatttcatatactacactaatgacagtgtctatacttgccacattaaatgggtgctctagatagaagcaagtattattgtcatctttaataaccaacatagatattgtcaatggaagattatccttcatcaggtctgaagaaacatcttcaagaactcaacttttggaagttgactaacaggatgagccacaacatcttcccagtacacacctgcaattgtatcatcctgatcaaatacagaacaaattgcttcaccatgtctaccactgatgccgtcacttggaaatcagattgggttgatatcaccctaagcccatcttacagaatctttcctctgagtaaccaatatgccttcaaatttgccctctgtcatacccaagcattgcttgaaaatcatctatctaaatagcataccagctctttgcatcacagtgattgaactaattgaccttttcatctatatatgccctgctgctaccataagaaacaaaagaaccaccatggtatatctcatcagtgaatttgccatcagtatgagctgcattgcacgttacggcatcctaattagcaatgttgaaccctagataatgaactacatacttaaatcgacaaataactcaaccaaacagaccatattgaaagaataaaaatttcatcaaccaaatttacctacgtatgaatctaactacaataggcacaagatacatggagatttcaatgtctcttccaaaggcggttccccttcaacccagaacaacgtcctccacatgactaccattgggcgaaggccaagccagagaatccactccctttccatgagcacggaaaccctatctcatcagtgatcacctccttcacactctccgacggtcacctctactaaggcaaagaagacgaagtggtggcagaattgaaaatagagagaaatagaggggactagagaaaaaaaggcagggcacaggcagcgccacacatgtcgcaagagagcgcgttggctaccgggcttcgaggcttcatcgagccagcaatcgatgggccacggcatcgaggaagtcgaagcgacgggtagtatgcacaaagttgagggtggcagagctcaacatggttggtgtgtgcaatcacacaaggaagaattgaacaccatgcaatagccgatggatgggtcgacctaggaaatatgggaatagaattagaattatactaggtgattccccgtgttttgctgcgggaattactaactaatatttattgtctttttgtaatattagttattaactacaaataaaattggtttatccaaccatgtttggagagaaataaatttagtacactcggtaagagattgtagatgaaatattagttggtcaagatttgcattgtaggaagcgggaggtaggaaaaattgataaaaagtttttgtttattagtataaatcacaaaagaaactaaattatatcccgcactttgaaaatatatggacaaatatatgtgaagtattacaaaataatggatagatatgtttaagaactgtagaaatgatgagaggtatagatatatttgatgctgatggtcctttcatgtgatgggccgtatattttcagggccctatagtgagatttatcccccaccccggtcctatgtgacgtctgggccatgactcgatggcaccgtagggcaagctggccagcatcagggtttatcggaggctgcaagctggcgcgtgcgcgccagcagcgagtactcctcccctcacttagtcttaactaactatattagttaatatatttaacactaatgatagtaattaggaaagattttaaagatttttttgagatatttttactaacagattgaaaatttttgaagttagatttgaaaactttcgatttaagtttcaaattttaaagtcaaattttaaaaactttcaactcagatttgaaaacttttaacttgagatttgaaaactttcaactcagattcgaaaactttcaactcgagaatcgagattcgaaaactttcaagtccaaatttgaaaaatttgaaaactttcaactcgagatttgaaaactttcaactcgagattcgaaaacttccagatttaaaattttgaaaattttcaaatcgagatttgaaaactttcaactcgagatttgaaaactttcaagttcagatttaaaaattttcaactcaaaaattaaaaactttcaaactcaaaacatgctaaacataaaaacaaacaagaaaaaagtggaaaaagaaaaagaaaaaaagttaaaacaaaaggaaaaaaaaacctaagcgctccgcgtgcgtgcctgcaacgcgtacgcgctatttagctttctcgcggtttatcaatggtagacgtaaaatctaaagatatttcttgtctgcggttttgatctggtatcgagattgtcaaccctgcctagaggtttcctactttcctggtccatatggggaatttgccacccaatacaatgtctgttcttcgccatgaataaaaagttatcattacatgttaaaaagtccattaaaaatacataatacatagtatatatacttttgtttaatgaccgtactaaacaaaatcttctatggaacttaacagttaacaatgattatggggatccgtacccctgccaagtgccaacagaaaggaaaacattgggtattctcttgcaagcagaaactacgatccccatcctacctgtgtatgtgcaagaaagtacaacttatgcaaatatctgagatatgtatacttcaaagatacttgacaaaatggtacatgcatgcattcatgcatatcgtgttcaacatatctactgataatgtggcgctgaaaaaaaaaaactattactgcgggactcgacagtttatttgtttatctgatgaatgcacaaactgaactaatggacagacggaaataaacgagtactatgtttgagcattaaatttgttgtcgaaagacaactgcatacgtcgaaaaacgtggttactcaacagtggttgaaaggaaacgaagtgtattgaattttgaattgttttctttcttttttcccctccccccattacatggccctaggggactatttatagccccattacaggttcttactattagggtttaggttgtacaggggaatttacatgattacccttacgaaaaggacatttacaggggtacataatattataggggctcatgggcccctgatgggccgtctggcgatcgccggccctatagcccctaggcttgttgggccggaaaggcttcctcggccctcgcgggggcgaacttgccatagtgaagtcgtcttccttcggcagatagtcttcgccttgcacccttccctgagacgcctctggcctggcaaggcactcgtacgactcttcgcctcacgccgttcttgctccatagccttcgccacgggtttcggcagatttggtcgaagggcctcatgccatccgccaacaagcccctcacggacaagggtgagattggagcttcggccgagaccgtgcaaaccatgtggtatggtatgcggtgccccctttcgaccgatgctcctgccgaaacctacattatttctgcgaatgaagtttgttacttgtgcggctggtattattttgccgcgcttcgcctcctgcgattggtggttatatattttcttttcccgggccgaacggaacagtattgggctttcccttcgtgggctttttactgtgccgctcggacggtgggaatttaccgtttcgcctacccttgcgacacgtggcgctttattactggtgggtaggcgaacggtcgcccgggtgagctatatattcccaccgctctttccttttcaccgccacacttgccattttaccgcgtgcgctctcttcctccgtttctttcttccacagcatctcttgacccctcaagcgtttcgcccgttctctttcttcgccatcgcaaacgcaccgttcgccatgacccctcgcaagccaaaccctgcttcggcaaaagagccagatcccggccgagtcaatgacgacagcaccacctttttgggggtttctcttatggacgacgtcgagctggcgaagctggtcagctctggggcgttggttgaggggtaggctttcgccccagggaaagccgtggtgccgaaaccaatcgacaatcggacggtggtgttcgccgtcttttttgatgcagggctacggtttccctgcaacgtgttgttgccggagatccttcgcctcttcaaggtggagcttccacagctgagcccgtcggcgcttgttcggatcgctattttcgactgggcatgccggacttccgggtttgagcctaacgccgagcttttcggcgccatattcttcgccaccgtgaactcgaagacggtgattaccccaactgggacaaagaagaccgagttcaggagtgtgaacttcaacgttcatcctgagcggtccgatctctggccggtgaacgctgccatgtcgaagtgggaccgccattggatggctaggtggttctatcactccatccccttcgaggctggttctgactcggcgaaagccctccggtgccggcgcagggcgatcgcgccgaaccggaaacccaagatcaccgtggacggcgctatggaggcgcggttcgttctgctgcgcaaagtttgctcccgccttagctgccgtgacttggtagaggaattctgtatgcttcgcatctttcccctctcccaggcatggcaagtcacggttgatcaaggcgaagaggttgacggtttgccgaacctgattcttcctgaggggacgaacagtaagactgttcttttgctatatactgctgtgctttgttattttgctttgtctgacttttaacatggctacacacttttacttttgcagtgttgaccctcgaccaggctgaaaccgaagcccgcaggatgatcggcgacgtatcggtcgtcgagtatagccaactgctaacacgacaagtagggatgaaaacggagcggatagtttccgtccgctccggataaaaacggatacggatacctttcggatcggataattctcggatagttcggatatggatacgaatacagatattttctaccggatacgaatacgaatatggtaccagggtttccgtcggatatggataataattcggatatccggtgaatagtgttattcggatatccgcaggacccatgagacataccccatttatttctaactctataaccttcaatatacctttatagattttaatagtagtttatctcttaacactagtccatactattaatattatttaaattttaaaaaatatttataaattatacctcattttatataaaatgagctaattatatatgttgatatttgtttctattagaagttgagttggttttcgtgttccgagaaaaaattgtttccgtattcgtgtccgatcatattcgattcttattcgtattcgagataatccgtatttatttccgtattcgagctatcagtattcgttttcgtatccggtaaaaaaatatgaaaacgaatatggtatgagcattatccgtccgtatccgctctgttgtcatccctaacgacaagcgtctgggcgggcgaaccgggtttataacagcgagttgcctcctcgggcaaacccccacaaagcggacgacgatgcagggccttcgcgaaagcgaatgcgcgggcaagtgaagcttgcccctaggaagcgaagggtccctgcttcgtcggactccgacgccgacaacgaggacgatgccgaagaacgcgacggcgagaatgaaggagaggaggaggccgtggccgataaggccgcgaaagaggcgatcgaagatcgcgtcgatacccccggctacactcctaccccaagtccaggtcacaacgagaccggggtggagtcgaacagctccctccttcgacgaaaggatttggaaggggcgaaggctctagttgcgttctcctcgggcacggtggcgaagggaggtccggtgaagaagatctccaaaaagaaaggactcgtcaacatcgcccgcattttcagcgacgacgagtcttctgacgagactccgacttcgcctgctggccgtagtttggacctttcgactgctccccttgctccgctcggcgttgctggggcaggcagtagcaccgccgccggggcttccgcctccgccgaacggatcgtgtcggctacggcgagggttttcgggagccctgtgcatgagccagctatttcgccactggtcaaggcgaaggggaagtgtgcggccgccgaagcatctgcctcggagtattcccttgcagcgccccactttgcccctggtgacttcgagactcgggcagaccttattccctttgtggagggtgtgagcaaccttgtcttgcccgccggcaccccgagcctgttcaccgaacttaacaagttcgacgaggggtgttccaccattaaaagtttggcggttcgggtatgccttttcttccttcttcgttttcctcctcttccctcttttttttacgtctcacaattagccttttgttcttttcgcccgctcctatctttcatctagattcttgcggctcactgttcgacggagcgaaccgtgcgggcccgttttgacggttttaagagccgtcttcgggccaaggatgatgaaataagccgcaagaacttggaggtggaggccctggcccacaccctcaaggaggcgaaaactgaagtcaaacgccttcagtccgaattggataaggggaaagaggccagggccgaggttgatcgcctcaaggccgaactggagaaggagaaggcccattcggcggtgctcatcgattactacaaccttactgagccgaagatggaggctctttgccagaaggctagcagggccgaagcgagcgccgcggaggagtcgcagcggttttcgcgagagatggcgaagaccaccgaatctgcgagaatggcttgccaaacgctccgcctcgcccttaccgacatggacgcgaaggtgcggggggtccctgccgaggatgcctcagccttcgacttctccgagtggacccagcaggctggcggatcggtttcggactgcgccaccgcgtacggcgattgctgtgcgcgtgtatcggcggccttcaccttaggccttttgcagcagttcggctgtgagcacgttgccgagttccctacctatgcgaagggggactgggagattagtgcgcagaacattttgaccgctcttcgcgcgtggcgaaaacagttttggcagaaagacggccggtccgctgccaaggcgcaccttctggagcaactggcgaaggcggaggcggtagatcggtgcgaagaagagggcgcggtgggcaaagaggttggaggcgatgcccaggatcacccagaggtgtgaggccctccaccctttctttagagttttgtagtttttctccctcttttgcgtttgcctagagaggcgaatgatgtatattcagcaagttgccaccaaaccttaaaaaaggcttttttgtatatttggaatgtatgacacaatgttaaattcttttttgatgatcgaagtctttagcatattattatttcgctcatttcgcattatgccatacctcccccttctttcgcctattcttactatataagctgtgttttgctttttctgcgctgtctatcagggggttcgccaaaagttgtgcattcggcccccttccgggagctggcgaagtcaaaacgagaaatttgtggcattgaaggacctgccgaaggtgcgatgtccatttcgccctgtttatcgcaaaatggagataaacggtcagagctataaggttatcaaagttgccaactggctacgagcgcaccccgggcgaaccttagaagattacgatcttgttcattcaagacgtttggaggatatggctcgcttttggcgaaaccatcagaagactaaacgtcaggaaacgatctttcagcgtcgttacagtttagtctgtgtttcgccccctactcctcttaaggttgtgtatgatattagtagtgatgacgaacctagttcgtctgaccattccttagagagggataatgattacgggggcgaagatgtaatttacttgtagagtgaattgtatcgtgttgtgaaccttctattcttcgattatttttttgaagttaataaagaacgtgctttatttccttttcgttatttttcgcatcatcacattttgtgcttttgttaggtcggaacatgccggcccctttgcgtatattagcgaaataggtgtactgtcttttcagtttttcgtcgttcgttttcgatctgtagcattctgtgtcgaaagagacgcttttgcttttatgttgatcgaatcgtaacgtcattcggctagttatttttcgagacaagctgttgcggtttcaacgttcggcgagcgatgcttcggccgattcgtttctcccccctggcttttttcgctgatcaggcgtttgccttggggtttttccacaaattatcaatcacgcgaaaaaaaataaaaagaaggcgtaggacacagagattttatactggttcgggcctccatggtggataatagccctacatccagtttttttttcctttttttctctcttattttttttctttgccgaaaggcttacatagtgccgaagggcttacatgactgtatgtacatttttacaagttggcgatttgggtgccacccattctaggcatagaagcgcttgagagaggcggcgttccaggaatagtcgaactcctcgccttcgagtgtcgctaggcgaaaagatcccgtcctagacttgtgtttgatgaggtacggtccttcccactttgattcaagcttaccaaccgctactgggttcaccttcttccttaggacaagataaccaggcatcagctccgtgggtcgaacttttttgttgtaagttgccgaagtgcttgtggcgtacttgtgcatgtgctcgagcacttcgacccttaccccttccaagagttcgagcgatacttcgcgcccctcttcgcccccagagaatataacgcttggtgagttagcccctagctctgctggggtcattgcctcatcgccataaagaagcataaacgggctaaacttggttgatcttgtgggggtcgtccgaagggcccagagaaccgatagcaattcctctggccatttgcctttcgctgccccctcgagttttttctttagtgcttctaggatcttgccatttgtacgtttggccgccccatttgactgcgggtgcgcgaccgacgcgaacctgatttccaggttaagcccttcgcacatttctctgaacttatcagagtcaaattgcttgtcgttgttagtaatgaactcttttggcactccaaaacggcaaacaatgtttttccatacaaacttctgtactgctgccgaagtgattgctccaaggggttcggcttcaatccatcgagagaaatattccacagctacaattgtgaatttatacccgtttcgcgccaccgggaacggcccgatgatgtccagtccccatctggcgaagggccatattggcgcaatgggctgcagatcatactggggcgcggtttggcttcggccatgacgctggcaactttcgcacttcttgatttgctcaacacagactttcaacacagtgggccaataaactccttgtctaaatactttggaggccactgttcttgcagcctggtgcgcgccacatagtccctggtgtatttcctttgccatttcttcgccttcggcaaaagagatgcaacaaagtaagggttgaagtaccccggagcggtaaagctgacccgagaccatcttatacttcgtggctctaagttgcaaacgctttgcttttgcttcgtctaccggaagccagccagtttcaaggtgtttcacaaatggggttcgccagtcatatgggtcttcgcccagtttctcctggtcgattgccatgacttccgagctgtccatggacacacttggagcatgtaggacttcgaaaaagatgccaggcgaatgtgggccaccacaagcagcggatttcgccagggcgtctgcttcctcgttctggcttctaggtaagtgttcgaccgttatgccagtgaagtatttttccatgaaccgaacagcctccagatacctcttcattccttcttcttttgcttcgaaggagttgtcaacatgacctgctaccaacttggagtcgattcgaattagcaagcgccggactcctagtgctttcgcctttcttaggcccaggaaaacggcttcgtattctgctgcgttgttggttgtgtcgaactgcagtcttgctgcgtaccgaatcggcacatcattcggcgaaaagaggactgccgcaatacctgcccccctgtgcgaccacgagccatcagagcacatcacccagaattgttcggcgggctcggggtcgagggcaagtaccggtgtccattcagctacgaagtcagctagcacttgagacttgatagcagagcgtgcaacaaaatgcaagtcgaacggggatagctctgccgcccacttgctgagccggcccgtgacttccttgcctcggagtatttcgcccaaggggtactgtgatggcactatgactttgtgggcctggaagtagtgcttaagctggcacgaggccatcactagggcgtaagcgagcttttccatttcgatgtatcttgtcttcgctccttgcagtgcttcggagacgaagtagaccggtttctgtccgaactctgtttcttggacgagtgcagcactgactgccaccggcgaagctgctaagtataatagcagttcgcttcctgggggtgggcttatcagggctggcgggctttgcaagtattgctttagctcgtcgaatgttgcctggcactctggggtccaatcaaactttcccgcgcccaggagggtcttgaagaagggcaaacctctttcggctgcctttgagaggaatcgactgagtgccgcaattcggcctgcaagcttttgtacttcatgtacgcttgacggaggcttcatttgctggatggcatcgattttctcgggattcgcctcgatgcctctttcggaaacaaggaaacccaacaacttgcctgcgcaagctgtcgaatgtctcctgcagatcaatcgcatggtcgaaagccttgcggctttttacgacgatgtcgtcgacataagcttccacattccgccccaactgctcaccaaggactttgtacaccagtctggcgaaggttgctcctgcattccttaagccgaaaggcatcctgaggtgacaaaatgtgccaaacggagtgatgaaggatgctttggggatgtcaagcgggttcatgtggatctggtggtagtcggaatatgcgtccaggaaactcatgagctcgcatccagctgttgaatccacgagctggtcgatccgtggcaaggggaagtcgtctttcggatacgctttgtttaggtctgagaaatcgacacacatgcgccatttgccatttgacttccgcaccaacactggattcaccaaccactccggatggtcaatctcttggattacccctgccctgagcaatttttgtacctcggctttcgccgcttcttggcggtcggcagacatcttgcgcaacttctgttttcttggcttaatgtccagcttgaccgccaggtgatgcatgatgagatctgccggaacaccccccacctcgtcagggctccaggcgaatgtgtcgatgttcttcttgagcacctctaggatactctcaacttcttcttcgcccatgtcgccccccagtgatacaagctttgtggggtcggcatcatcaatctgcactttcgttatcttgccgtgaggggtgggctttggcatgttcttcggctgttcatgcggttcggtctcaacgctgtgcactgctctgttgattatggctagatcgcttttcgaagcggccgaagactgaagccccttgactactatcacccctgccaggccgggcatcttgagcttgaggtaattgtggtgggaaatggcttcaaacttgttcagggttgcacggccgaagatggcgttgtagttgtacgggatgtcgacgacgtcgaacagtatttgctcttcacgtctgttctcccccgagccaaaggctatcagcaagagtgcttggccgagtacttgaactgcttctccgccgaaaccgcggagtgatgctggtgctggggtaagtgcttgggtaggcaaccccatcttggcatatgcttcggcaaagataacttcggccgaactccctccgtcgaccagtattcgtcggacctcgaaactagattacgaaaggatcttgatgcgggaacataactccttctgcgtcttccggcccaaaagaaattagctggtttagatattgcggcgccccttcgcccgccgaagtgatgctgtggaccatacggatctgcatcttcttctgccgcttggacaactggcttggcgggtcggcccttgtaatcacttggattatccttcgctgtgcatcttggcgttgtttggctgggggtgtttgctcctgaactgcttcgcggggtgcttcgacagttgttccctgctgcagccttgggtcttacgcgttgccacattgcctaatgtttcggcattgctccgtggtgtgcgaagagcgtccgtgaaaggcgcagtagaggtcttttcggaccttcttgcgggctggctgctgatggttgcttgcttgctgggcgtctcatgatatatgcctgcatatacatttgcgtataaaaagacacaatgaggttcagttacaataaaaggctgaccaagattatctatccaccctgacaattttgttttggctagtttcagagcctaaatatttcgttgttattatggagtagtttcatatgataaggagcaattctgctgagatatatgtttggagaaaattcatacttagttgcttacctgacttgatgcctgtaagaaagcaagccgaggagccaatggagtttcaaagaatcagatcggaggcggtgaaactggcgagaagggcgacgagcggcggagtggcgcgcgacggcggactggcagcgttagggtttggagagtgatggaggcggcgtgaggagcgagaggtggagggggcggggcgtgggttggaggcgcagtggagcgagaggtgggggaccgatggcccgcgatgcggtgccgggggaggggagcggaggaatttcgcgatcggaacaggaaggaaagtgcgcgtgattcgggggcgctgctgggtgagggaaggcgatgggtacgcgggagacgttagattgagatgagataatctggactgttgagtgacaaatgaaagaatgagtgataagtgatgagtgaaaccatttgttgaactatagggtagatagataactctataatatttatgtattctaaaccaaaaatataaatattcacaggatatttttagttggtggcgcacccattttataatatatggttgaaaataagactatttgtcctccctgaacttcatgttgtgccatgccaaggcggcagcccaaacatgacccaactattgggtcgggccaacacgggcccgacaccattcgggccgtgctatgcctaggccgtaccaaagcggcgtgccatgggctaggccgcgggccataaggccatctaaagttcaggaatgtgctgctgattttttttattagagcatgtgttaatgggattgtgagtatgatgttgcgggtagtgatatgtgtttgtgtgtctctgccacgtttcgaaaaaacaactgatatactccagtatacaaagattgcatttcaaggtagttctcatcttaaacaagatccgatgcgtccatccatgatcacaaggctgggaacattcctccctcgtaacacctacactacacgtatgagctgaacccaccgctcagtcaggaccagggtttcccaaactgctggggccggggttaccgcgtcccggcggtaagcacggttaccgcacggtaaccgtggtaaccgtgataaaccgtgcaaaatttatcaaaaattcaaattattttttaaatttatttgaatttaaaaaggttaccgaagtatttatattaccatacccccgcgataaaccggttaccggcggtaagtccaaccctggtcagactcaggagagactcccgcgggaaagccgaggagtttcccgccctgtagcgcccgccgcttcactccctcccaatcccccctcctaaacccagctaggtttccgcctctctcaccatctccatctccatggccccgaagcgccgccgtgcccgtccggcggacgagagctcgacgccgccgccgccgcctcctcccttgcggacggcgccttcgcatttgcagccggtggttgttttcgcccacggcgccggcgccccctcttcatccgactggatggtccagtgagctctcactctctttatctctctgtcctgtcttctctcccccctttgcgtgtgcgcgtatggataatcggaattgtggcgactattttgttggtagaggtagcgtcttttttttttttttggtatgtgcgtgatgatgtgcgaaattgagggagtgatttctcatctctgttagttggaaggatatggtgaaggatgcgctcgatgctatcgaagttgtcacctttgattacccatgtgagtttgtctgatgagctctaagtgctgatttgttgacccctcactgttcgctaaactcgttgatgaaaatctgttggggggagaatttcatggtagagcaacaatttgttggctgcagatatgtcaggtgggaagcgcagggctccgccgaaggcggagaagcttgttgatcatcaccttggtgtggtgaaggacgctgtagcgaagcatccagggcacccacttgttctgatggggaagtctatgggttcaaggtgatatgtgggagctttaatctcgtttattactttatttcagacttgtttgtgtttttgacatctgtctcaagattgtagtcctcatacatttttcagggtcagctgtatggtggctgattcagatgatattattgtttctgctgtcatatgcttgggttatccgttaaaggtatcctctgtgttgtgtggggtaatatgattgctacaatgtatgaggatgtaacccacatcaaaaaatgatttagccttcggtttccattatataataatttgtaggacctgaaccagtttttcaggaaaagggttgctgtgattttaaaacatgctccacttggttattttcactctctgttatggctctacttagggatgttttgttttgcatccttgctttcttcctcttagggagtgaacggggcagtgagggatgagacactactgaaactgaagattccaacaatgtttgtgcaggtatttctttctgaacacactttgaaatgaaaaataatattcaatattttttaagcttggtatgcaatgcatttttgttcacagggcaataaagatgggttatgccctttggataagcttgaggccactcgcaagaagatgaactgcaagaatgaactgcatgttattgatggtggtgaccactcctttaaaatcggcaaaaagtatcaagagtctactggagtgaatcaacaagctgcagaaatggaagctgttaaagctattgcaaaatttgtgcagaactccatagcaggaacctgaacttagctgtttatgtactatttagggtgttgcaagaattagtatgttcatgccttttggtatcacttagatgtaatagaaagctattttgctaagatggcaagaattaatatgttcatgcacttggtatcatttaggtgtgaaagaaagctattttgccaggatgctagttttgatttgcgcatccgcatccaacatctatttgttttcttgtcaaggtatgccatggttgaaatcattatcctgactactttacatagttgggcaatactgcttatctgcgagtcatgaatttgtctgtgggtatcacgatttaattgtaggtataaacataactgtaaacacagtgaagtttgtaattatcaagggatttctctttgctatcatcagagcaatatgaagtactttgtacaagatttctgttgtttaacatcaatctattttttagataacttacaccaatccaaatccatgaagatcttttgacatccattcatggtgctgaatttatgtacagaagttggcaatcatgcatgtaagtttaccttgcgttcctacatatatatttttttggaagttttgtttcatcatgcatgtaagctattatgaatgtaatattctgtacaatgttcaatgtcaaaagaattgataaatctgtcctggtgttacatccataaaacttcttagaataattctggagttacattcatgctgtcgtctttgtttcatcctggttccatctccatggttttgcttagtagacacccaatcatgggtggagcttcttagaggcttatctaggctatagccctcccctgatttaactactacaattaagtccctttactttgtgacaggtagcagaaagtaactgtagaatggtccctacgctgaaaatagtttgaacattatccccctcaaaatttctcttcaagctccgccactgcgcccaatgttgacgataaatcattttaaatccttatatgctttgatgcaatccttgtgtctatggtaaatcatgtttggtagcatgggaggtagactcttattccgagatagagatgctcaacattggatgagttgaataaagggctatatttccttaattttatttatatatttgaattgtatgatgtacctttgaacttcgttactgtgtttgttttcattttgcttgaggagttgttttcttgctgaggtctagggtgtttcttccagtatatggaccttgtgttttgttttctttagaattgaccaggagctgtggccctcagtgagatgggcaactggaaataacatcctaataaatgtaggcttgtaatagcatgcatcaagaatcatatttttataaattgagattttaaccccaacttaagaagtaggaatgatcatgatatgaaactatgagcgcagtaaacccattctttatttttcacattctactaaatttcatatgtcaggtggtaatgatcacttaatttgtgaatggtctggttttgaagccatctattttattaatgtttgttgtaatatgatgaaccttttgaatgatagacaagaaaacttgccaatttactgatgttaaacaactccaactcttctaggtgaatatattaaacaaatcgtaaattcacctggtgaatatggtgtgctatagcttcagttttcatgaagttccaatttatggacatgtgggctgcatgcctgcacatgcattcaagtgatgtggtacaatgatatatcataacctccgtagaacctttcaaataataagcttttttttatatagggagaaacaagacagatacatgaatgatcagagacaatatattctatgtaaccaagctttggtaagtcataaaacttttgctagtcatatcatagaagagggcttactcaatggcaagccatagaaatatagaatcttaaaaatctctaatgcatggaaactttcacataatgtgaagcatatcgtccttgtgtagcatttatgggtacaacagacatttcttgcaaacaaaacagataatatagttcaattttcagattaagggttatgcccttttgtgtccacatgacttgttggaattttcactacatttgcttgttcaatatcgtgaagcaccttaggtgcttccttgcatttgctgtaaatgcagtatacaaccaactgaagtatacccattatgctgccgatgcagtttggggtcttcacaagaaaaaaagcatgtcagtttgatatatagaagtttattgtggctaaaattgattatgtccttaccgcgataaaaggatcccttcctatgactccatatgccatccaggttaaacttgtgaagagggtaaacaatgacagatagaaaggcatgaactcaacactctttgtcctgataacttgtttctgcaattatggaagtacatattatatttttaaccattcaaaataaaatatgtgtagaagttgtcttgttttgtttctctaccatatctaattgaatgctttgttcctctattatactttctgatgtgaatagcatttcattgaatcatcattatatcttgaagcacatgttactttttagcatttttcttttttattgaagttcagtatgagatcaatgttgcaaggttttatcttgcaggctgatattctattatctgaatttcataattcctcagtcaatataagtaacaatactcaccatagctaccagcggagagccgtacattgatatggaagacactagaccaacactaccaacaaataccttacgtatatgatggttgtgtattgaaaagcttgagaaaaacacagtcatgcaaaagactgctagaatcagagatgccatcagcatgacttgcttctgcaagagattatcagtcagtgttaacataatcaatcaaaaaattcacatcctgtaaaatctctctagtaacatgccatgtaacatcaaacttttataaccacttaggcacaactatgaaataaaatcatttcttgtttcttctgaaccggaaatgcgagtgtttgttctgtcttacgtgtgtctgagaagaatcagacataatatcctttctttcaagagaacaagaagcaccgatggacatcatatttttagtgttctattttggtatagtgctaaaattttgggggtgtgagatcagagattttactactggctaggtacttatgatttggatcttacttagtttgcctctggttcttatcaatattaattgattcatgttgtcatgactatataacatctagaactttctaatctcacaactttgaaccaaaactgcatcacatgcacaagttccctagaggcctttgcacatggttatgttagagctaaaaagaacaaaatcttatatgactgactttgtgctgaatatagtactgcttttggagtacaaacagatagaaacatggtcatttgagttcaaaattttggatagatttttttactattttatccaagcaaaagcttgcattcgttcctactttcttctgaatatgtcataattatacagctgttgtcgtcttactatattttgttgtattcctaatataaaatattagtgcaaacaacttcaaaaacttgatagacacagaagtaaattagtttacccatggaaatcattgaaatgctgaaggaacaatagaagagttcttcagaaatgacctactttttttcctcttggagcaaaccatacatatatgctgatgaatgtgccttcaaatagcaccccaagtgagctgatgctgcagactgtcatgttctcccacccatagctcaccacaggaaaaccataccaactgtatgtgaggcagctgaacaaagctaagatatatggtatgcacgagaattcttctacactggccttctttatcactcttttaaatgtcaatctaggaaacatagtaaaaacaagtgtcaagcaatgcattatatactgcgcaaacatagtatagcttatgatgtatagacatgtagttgggtacattggtgctgagtagaggagcatgcaagctacagatcctgcaggagaaagagtatggtgttatgaacataaagaaattaatcgaagtagcttgtgggtgcaaatacctataattcccacaataaaacgtatatcaggaaacattcttttgtgctgattgatgaagctattttgttgcccctggaactagatttttggatagttcattgtttacaatatgggcaggctatttataatgtgcaatggctgtttaatgtgggaatgtcgagatattgctcaaaccactaaggtagaatatctgtttttttttgttgctatgagatttaacacagtttttttgcaaacatggagtaatgctggtattctctttcatgttattaccagcatctaactattttattgcacctatgtacctatgataataatataagtttcatgttaattttgaatctggtccgtcactggagtaggaactagcgaactagccaatcagtatctattgtacttgcaacatagttagatgtgaatatggtactcaacttctagattttaattgactacgaagatacggaacagcagggttggaaatttcggtcatttcggtcccctccgaaacgatattaatttggctgaaatttttgaatttttcaattttttcatgaatttgggtaatatttgttcaaattcaactaaattttgttcaaaatttcagaaattttggaccgaaatttcgggatttcggagacccccgatcaaaagccctaaaccgatatagtgaaccctgcggaacagcattagcaaaaatattagcttagaatcgttgctcttggatggcacttctgatgcacgatgaaaagcaaacatgaaaacaatcaattgctttgctcttttatccatttttccttcagtaagttaagctcataattttgaaaagcagccattaatatgatgctccattactccgtcatatagaacagttccgttattccaatgaaagaactgatgctgttgcttgccactcttcaagaataacgtgtctttttctggtgacattagtgaacatcactaaaacgagtaagcttcactaaggttttgcttccagcttttgagaagatgctcatgattagagagatgaaagattcaagtatgaaccctttttagacctgtaaatagttttacaggtcatgaagccaagaactttgagtttttcataatgtttttgactcttgaagaattagagtgcagtgcatttactgaagtagcaattgtggttctttatgattcatccatatctggtaaagaacaattgtttttttccttgaagatctgatgctgtcatggctacaattgtaacctcatatatgaacttttctgatgaaaaagcagtctatgtatatattttttaacatgtggtcattctgatgcggctagttagctctattctctctaaattaagttggttctattgagttgacgttactaattttcttctgaatcttctaaagcactattaacaaacttttctgttataggtacatgtcccctccttcaatctgagtgctgcccctcctccaattgttcagttcgacctcaccacaatcctgtgagttatttgtcatctactggcagcgcatttcttagcaaacacatggtgaccaaccctctcaggttcttttgttctggtaccaaaatagatgggatgtctgattctgcgtggggctactgaattcacctgtccagaacttttgcctgagatggaacatggcctcgtttgctccaatattgtgtggaggaataagttaatgtggccatgtttctcctgttaatttgggaataagtcctttggttgatattaactgcaaagacaacatgacaacccacagaataaagcttgtagaatcaactaacaaagtttgtctgccatcaaatattgttggctattttttttgttcattggtgcaaacataccctaatcatttatttggtcagcatttatttgacttattacaacttcatgcatatgagtcataccatgcaatgtgcacttcaagagatttgaattacggatatggcaaaagaaagtagtatttggaagtttaaacacctatgatgcacttatattgcaatcattacttccactgagtataaacttacggttaaacttggatgtctaagctatttacctttccacagtatgcattgaagcaggagaggcaatctgcaggcaaccactacatatagtaagggatacaggcaagttccatcttaatttttaatccctcttttgcaacttataaggatctgaaacttttttgtcttattggtgtcctttttatacaattaagaatgctgtgaattatgaccactccttttgtgttccattagtgcagcctttctggcaccaatcgtgctgaaactatttagcactctcatatctttagttttacagcccatcattccataaactacattagttgtctggtggaaagctagattaactgtatacaagcatgactgattagctttagaggcgctagttttggtaaaatatttgagacaatctaccatgcttgcttgaatgtgttgctttcaacaccattaggaaaccatatgactggttaagttaaaaacctggtcaactctagggaataacttgccaacagacaactgatcctggtgaaggatccacgtggctgcctgggagtccgttaatctaaaaaagaaattccttttgttggctggctcaatggaacattgtcgtcccatgatatgatggtgatcaccatgatcaactaattaatgatgtgaaaccaccgaaggaaactatgaagtgaattagagcaatgagcaatctcgatgcgtagtgtcataggcagtgtctagatgagagagcacattaaatattaatttaaacctaacctccccaatacatagtttcttcatgttttttttctataaaaatagatataacaaacatttgtgtaggggtcaccgcatttctataggaggccatgacaagaaaactactagcatgtcattgtgcagttttcttgagtcgtcatattttactctcattagctcaggcgccacatcaaatttttagcttatgtggcagcataattaaatctatggaaactatcctacctagagcactggagcactaggactgcccttatagattactcgtttaggattcacccttcttttaaaaacaaatgttaagagatggccgaattcattaattaatatacaaagtttcaagttaaagttatatttttcgctcattactaagtccggttagtgctggagtagatatacttagttttgttgttatgttagttgatttacattgcagttcgtggaagctttgtccgtgatcgaaattgttgcttctgtacggtagccgtgatcaagaggaatatgacattatcttacagagcatcagtgatctataaatttccaggacaaactgatctagcacagaatgaagcagcagagaaaccaaaaatgagatatttggagcctccacccggagcggaccaccagagagatggcggagtcggcgaaagatggaggtcgcggtggacatcaccaccattaatgggaaggtcgatgtctcaggcttgcggttgcagctgagaaacctcacagagttttcagctgtgaccacatttgattgattgaagtgctaaggactaaggtaacgtgatttctgcaataacgctttggaattttgggtcgctgccgaggttcttcaaacccgaatactctgttcacagttctgagattatatttctttttcctagtatatattgcggttgtgatattcttctctcgatgtttgcaaaaaaaaaacagagaaggaaaataaataactttcttcttctgatgttatagctgcacgctatttgtttgaatgaaatagctgagtggacagctacgtgacatggtccgtatgtgcataagtttcataaatatttgaaacctcttccaaggttatatagtcatatggaattcttttttaatataaagcaactatattgttgttggaccattcattgtgttggcggatggcattgtgttgacggatggcatgaggcccttcgaccaaatctgccgaaacccgtggcgaaggctatggagcaagaacggcgtgaggcgaagagtcgtacgagtgtcttgccaggccagaggcgtctcaggcgaagggtgcaaggcgaagactatctgccgaaggaagacgacttcgccatggcaagttcgcccccgcgagggccgaggaagcctttccggcccaacaagcttaggggctatagggctagcgatcgccagacggcccatcaggggcccatgagcccctataacattatgtacccctgtaaatgtccctttcgtaagggtaatcatgtaaattcccctgtacaacctaaaccctaatagtaaaaacctgtaatggggctattaatagtctcctagggccatgtaatggggggaggggaaaaaaagaaagaaaacaattcaaaattcaatacacttcgtttccttccaaccactgttgagtaaccacgtctttcgacgtatgcagttgtcatttcgacaacagctggcgccgaccgtggggacctccgagcgaaaccactgagagcgaatgctaccgaagagggtcgtgaaggagaaggttgccaggcgaaaggaaagcgacgccggaccggacatggccgccgaggaaggagcagagccttcggcgcccgtggccgaagatggaggaggacaagcgccatcacaaccgccttcggcccctgcaacctttgtgcaagagccgaacgcggccgacgtggcgaaggcggctgcggcggcaagggcactccagaccagggcggagatcctttcgacaggccaactggtggtgccccaagccgctccatcgcagccggcagcggccccaactgcgctcgccgttgtgcaggcccaggtcagccctgaccccgaaacacaagccgaagccgacatggaagccatgcgatagaacatgacatggctccaagacatgcttcgccaaatgcaagaacaacaacaagcatacgaggcggcaaggcgggccaaggccacgtcggctccaatccttcagtattcggcaggttatgtcccacctcaagtccatccgcaagtgacgacccagccctttccgccacaagccacacaggcgccggtgtacttcgccgggcagcaatcggccgcagcagtgcatccggcccctcacgtgcaacagcaagctcaaccagtcgctgcccaagtacaccatcaaccacctggccaagcgccacaaacagtggcggaaggggcttcggctctgcaggcgcaacttcaagctttccttcagcaactcaaccaaccccactgcatttcaagtacaatcccatcggcccacccggaggggaatacaagtcaaggtgcgcctaattggttgccaccgattcagccgggcctgggagtttcgccgtggaatcaaggaccgcagctcgacttcgtcaacgctgctcaggcgccaaccgttcggcagcaagctccaactccaggcttcggaacaaaccaagcaccaatccaagctgccatgacgtggtcgcagccaatttttgacccatccatggcggctcagcaagtacctccagttggagccgggcagtcgaatgccacggcccaacctcacgcacaagctgcgattttgcccttcgccacaccgtacccgcagcaaggtgcggtaaacagggcgggaggcgaaaaggggctaccgctgagtgggggaatcaagactcgtccaatcccaccccagttcaagttcccacccgtcctgcgctattcaggcgaagttgacccgaaggagttcctctccatctacgagtcagcgatcaaagcggctcatggtgacgaaaataccaaggcaaaggtaatacatctcgctctagacggcatcgcccgttcttggtatttcaatttaccagccaatagcatttactcatgggagcaattgcgcgatgtttttgtccttaactttcgaggcacctatgaggagccgaagacgcagcaacaccttctcggcattcgccaaaggccgggggagtcgataagggagtacatgcatcgcttctcgcaagcccggtgccaagttcaagacataaccgaggcgtcggttataaacgccgcttcggccggtctgctcgagggcgaactcacaagaaaaatcgccaacaaggagccacagacgctcgagcacctacttcgcatcattgacgggttcgcaagaggcgaggaggattccaagcgacgacaagctatacaagctgagtacgacaaagcctccgtcgccgctgctcaagctcaagcaaaagttcaagttaccgaaccacctcccctctctgttcgccagcctcagccggcgatccaaggacagccgccaaggcaaggccaagctcccatgacttggagaaagttcagaatagaccgggcgggcaaggctgtgatagctgtcgaagaagtgcaagctctccgcaaggagttcgtcctattctttcgtgatgatttgtttttttaaaaaaaaaatcttaaggttcatgattgggtagggttagccccttttagttcaacaagttcagattctcagcaacggcacagtgtttttaggaacaaactcccaaatctagcacaatatgatgttttcaaacagcaggaaaccagtaagtgcagaaaaagtatatgcatctctggacgaaacggacactacgatggttttaaacatataccatgtgatgttgcaaaccactgaaatcccagactgaccttgaacactcaagaatgacatcaccacctcttcctccattaccacctgcatatttcacataaggaggatctgttctggctccattgtttaagaatcatgaaaaagaaaatcctgactgactgccgaattggaccaaatagcatgaattaaagccatgacagcatccctctaaatcaggtaactattctctccctaatcaatttcctacaaaatactttacacctcatagatcgatactgtttatttcaatctgtcatgatgtatgcctacacttatctccactcaccctactttatatggcgccaagctttttcatgttcccaggagtttgtatggcaccaaactgttcacctgagcaaatggtccaataatgaatatatgatatgatttttttgctttgtcatggtacgttgctaaccttctggtgcagttttctcattaagatattttgtgcagtgaagaaatgcatgtttgtgttgtaagatgcttttaaatttattttacaaatggaatgtatgaactacgaacaagtcaataatagtgtactgttaagtattgattatattttttattttaaaagttcagcgtgttaaatgaggtttcaaagatgctatgaaatttattgtgttatatgaaatatgttgccgcaacaatcctaagatatcaatatgcgtgtcatctaggtgcacttggctgataagctgttggagttgtccatatcctccaggaaaatgtgttgatgggttatgcggggtctggtacatttagacatgcggaagttctgatagtaaatgtatggagagatttaagatttatcagatgtatttgtatgcaaattgtggataaagaattgtcagatattcccttttggagaagaaatgagacagttcaggttataatgttataatatcggtgcatataccttttgtgcaaacattcaaataatttaccgtttgtgcatatgcataagatgcaattaattagtccatctaaatttactactcccttatacaaaaattaaaagttatatgatttttgaattattttgtattggtggcgtgcgtttgaccataattttatatttttcaacaagttcataaaatactataaatttaagaatatggaattattgttttaaggctaaatatgtgttgatcctttagcattcacataagaacatatacttcatatctttgcttggatatttgtatttttagacatatattttgatttgtattatcaaaaacagccgtagcgttagcacgagcagattactagtttggaattagtttgatttcttagatatatatgagatagagtaaaaattaactaagcgacaataatcggtagcttttgtgataacttagataaatgaaaacttgcaaaaaaatctaagctcaaaataacatctcaaaagagacttggctttgacgcataatgggccaacaagtaaaaacatattaatgtgctagaatacagaatgttttattcggtcaattatgtaaatgtttcacatgccgtactattaattagcaagtcttccatataattaacatttcttggagaaggcaagagccaactcttcgggaaaataaacgtgctagttggcatgctctctgtatggcttctataattgctaagggtaattaatgctaatattttgctagactttataggaattagctcaatttttcattgaattcctgtgaagatcgtgcacttttaagatattcacaatggaagcacatatgtttcatgattcacgataatcttattgtacccatggtagattttgtatgtcagctctctacctcttctatttaagtcttcttattttattaatgagtaaattgcgccagcggtacaaaaatttggcaggtgggtgtgatttagtgtaaaaaccttgtaaaataagcaaactggtacataaacttaacaatcatgtgcattttgataaaaacacggttacatacctatggttcatcgtattttattggttgtatttgtaaacatgactgctagattaattgttggcaatgagtatgttttacagtgctcatcaccgaatttgtatgatcagatggatcgcttggaaattttgttagttggcatgcacttagttttgataatcattatttttctaattttaaataataggttattttagtatttataaccaagcaaatgcaatacatctaaaaccttattcggaactcaagatgacctaactggctgctttttctttatatagctgaaaaagtatggtgtggaagagagatattttaaccaaaatgcacgtactaaccaagttgttacatctatataatcatttttcaaattcttgcactagatcgtacccacttactaagtttgtgtactgtagacgcaatttactttttattaattaatattcctcaattttttaccttactaaccatagataagaaaattaattacataggcacctatgagcccacttcacgatataatttactccctccatctctaaataaccgctcattttggtttaaaatttgtcccaaattaactactccctttgtcccaaaatataacaacttctagcctctagaatttatcccaaaatataacagtttctacaccaacattctcttttcaaccaatcacaaccctccaccattcaaattttccacctacctccactttttatccaatcacaacccttctctatttaattctacatatttttttaataacattgtcgaactctaaaaatgcttatattctcggacggatggaattactcttagggtgtatttgagtgaagagaagaatgataagatacataaaatgagataaattattagcatatgattaataagtactaattattttaaacctgaaaaatagattaatatgtttttaagatattttttctataaaatttcttttagagtaaattttattttggaccatctttattgcttatgtttcgcttttgatcaccttttagccaatgtttttattttagactgggtaatcttgcctgtgttactctcttctcatgcatatgaatgacctcgagtacccctgttcttattcgtcaataatcagttatatgtagaccatttatatgatatatgacaatttagatgtagatggataaaacaactgacggtgttacaaaatgctactccagtataaaggtaaaataacccgatcaaaagtgtaaaaaaatagttaaagggtgatgcaaagcgaaacaacgccgataaaaagtggcccaaagtgatttactcttcttttcatttacgaaaaaaaacacacggtttatcattttgcttatcgtatgaaccatacataagaaaattaattatatagacaccatgtaggcccactttgcattctacagccccatcgttttgcttattcgttgaataaacgaaatggcatatttgcaaacgaaaagtgatatgcaaataaaactttcatatacgtgttcttaccgatctaaaataaacttcgatgaaaaaccatcaaaattagctttaaatttaaggttgaaaattcaaattttggctgataatcataagctaatttactccatccgttccaaaaaaagttgatattatgggtttaaaatttatcccaaaatcaccaccacttaggctgcattcgttacctccctttcccaacctccctttctcgttttccgcgcgcacgctttttaatctgctaaacggtgcgttttttgcaaaaaaaaaaattctatacgaaagttgcttaaaaaattatattaatccattttttaaaaaaaattagcaaatacttaattaatcatgcaataataggtgcttcgttttgcgtgcgaacccctcctccctaacacagccttaggctgagttagtttccaagttttccctactcacctctatctttttccgtgtgtacgcttgtcaaactgctaaatgatatattttttgcaaaaaatttctatacgaaagttgtttttaaaaaatcatattaatcattttttcaaaaaaaaatgcattaatacttaattaatcatgtgctaatgagttactccgttttgggtgagcgagggattaggcggaacacggccttagagtgtgtttgagtaaatgagaaaaaataacaatggtaagatacagaaaattaagtcattaccatatgattaatgagtattaactattttaaacctgaaaaatgaattaatatgatttttaagtaaaaaatatatagatttttcttttgaaaaaacatgtcatttatcaattcgggtaacatgcatgcagaaaacaagatttatttccactttctcacaccatcgaacacaaattaaggtccttattggttgtcaatattctctaataagtaaaaaaaaacttatttagaaataaaaattaatctatagctaaaacatttatatatatgtattgctagcgacttaaaattcaatactgaaatagaaattacattgaaaatatttttaaaatcaactttaaaattcagtttgaaaatttaaattttagttttaacttattagggcaaccgataggatttagttcccaaaaacttttcacaaaaatatccaatcgaatctttggacatatgtatggagtactaaatatagataagagtaaattgcacccacggtataacaacttggcaggtgagtgcgatatagtgaaagaacttgagaattgagcgtccgagtgcaacaacttgacaagtaggtgcgttctagtacaagaacttgacaatttgtatttttgtgcatcaacttggctaggcatatgctaggtgagttttttttttcccgatgttgtgcatcaacttggctaggcatatgctaggtgagtttttttttcccgatgtcaataatgccactacatagtaatcctacggatattaccttagatattaaatttaatctttaataattatattgcacatacaatttacattcaattaccttaagatttttttcgttttctttaccttctcaaatatcaaccgaaataataatttttacatccagtttaattgacttcaagttattaattattataataaaaatataaatatgcttatacaaatccacactagtatattgtcaaaataattacttaaattgaatctatatagaaaatgctccaaataattaagttgtcgcataatttcttagtttattgtattaaaatcgtacctaccttgcaagttgttacatttatacgatcacttataaagttcttatactaaattacacatatttgccaagttgttgccactagaatgctcatttctcaagttcttgcaccaaattacacccacctgccaagttgatgcaccgtgggtgcaatttactctatagataaaaagaaaaattaattgcacagtttgcatgtaaatcgtaaaacgaatcttttgagtctaattaattagccataaaagtactacagtaacccatatgtgctaatgacggcttaattaggctcaaaagattcgtctcgtggtttctagacgagttatgaaattagtttttttcatccgtgtcaaaaaaaaccccttctaacatccggttaaacgtctgacgtaacataaaaaaaaaatatttcaccaactaaacagatcctaagtcacatagggggcatttgatacgcatttttttttgtttaggtagtactccctccttccctaaatatttgacgccgttgacttttttaaacatgtttaaccgttcatcttattaaaaacttctgtgaaatctgtaaagctatatgtatacataaaagtatttttaacaataaattaaatgataggaaaataattaataattacttaaattttttgaataagacaaacggtcaaatatttttaaaaaagtcaacggcgtcaaacattttgggatggagggagtactctactagtatttctctatgttttagtgcagccttacagcgaacagttagaaataaaaaaaaagaacaaaaaagcagacgagaatagtagtagtactactagcgcgtaggaaaggaaagtgcagctttcccgcgagcccatgaccactcgtttcccagttcccacatccacttccacgcgagcgcggagagcagtgtgagcagtgcgcagcgaagatggctatagagtagagaccgcgaccatttaggagcgcgtgcgcggcggacacaggggccggtgggagcgacctccggcggcgcaggatggaggcgaggatggcatcgagggcaaggcccaaatcccaccgacgagcaaacccccgctgctcgactgctccatccgtcgctcagcctcaacatccagatcgtcgagctcagttttctctctcccccgtccctctctctcgcctcaccttagcagcgcatatctaatcggagcaggccgcatagatgcaggcgccagcggcgtggatcgaggcagggcggccgcacggtgagtacgaggttttttgttgcgatttttttctccaataatccggactcttccagataaggtcacacgttttgtaaaaaacccctcttgaaaattgcaatttacatttagatccgccagatgatttttgaccgtcgatgtaccatctaacggctgtgggaggggtgcgaaacgtggcgcattcttcagccgagaatgccgatggagctcaacacgcgatgccacgtggcccaatgggatgcttgggatcggaccctgaaatcgatttataagatatggcacggccccaaaaagagtaaggaaaaatagacttattgtagctatgtataagacgcggttcaaagatgagggacacaaaatagacttattgttatcccacccaaagaggagggaggtgaaatagacttatctcaaagaagcacaagctgccgacctgccgtgccttcgggccggcccggcacaacccgacttgggcggcaagggggctgcatgtaaattttcgccatcctcggtggccagctgtaaagcgagggccaacgaccatctgccacgtcggataaatcgtccactagactcccagagggcaatggggactagatttgtaaatttttcaaatagaaaattatttttgtaaatattttaatagatatgaaaaagtccaaatacccccctaaactttagatagaagtccgtctagaaccctaaactttaaaaccggacatccaaccccctaaacattacaaaaccgttcaaattaccccctacggtggttttggatggtgtttttgcatattttaaaagtttaaatgaacagctttaaataactaatataacatatttgcatatcatcagttgtaagtcattaatttatacttatacagggatattgtcgacggggatacccgtagaccggatatagatgatagtggggtccattgatacgaggatctacgtaatacgacatcaagcaaacagaatacaaggattatactggttcaggcaccttggaaggtaatagccctaatccagttggtatgggattatatgatagaaaccacagattacaaagggaatagcagaactcgatgatactgacgagagcgtagttgagttggttcaactagatctcttggcgacttggctcctgcacgctccggctccgtaggctgtgaggtgtatgtgttggcagcaatattcgatgccttaggtcctgtccagggggtcccttatataccgcgggtcagttgatctccaagtaggactcgaagatatcgaacccctcacgatatggtaaagacccagtctcgtccgagtaggactcctcccatccgtatattttgtttctatcacgtgatagatttcctcatcgtatatggaaactatccgtatacgcgcgggtatgccatatcgatacccaccgtacatccaaggatagagagtataccttatccataaccctgacagatatcatactattattatgttggtacttgtttgtaagtgagagctaacaactagtaaaagaaagatttaagtgaagattttaatacatatgtccaatgtgtatgttacgtgatcaaactcatccaatttatatacaaattagataaaaaccactgtacaaaaccaccttagggggtaatacgtacggttttacaaagtttagggagttgggtgtccggttttaaaattcagggtgctagacagatttatatctaaagtttagagggtatttagactttttcctaataaataaaaataaaaaattctacgaaatacgaatcagcagcaagcggcaacggtgaaaacaaatcgtaagtactagcccagcatgggattggcccttccaacatttcatcttcctaggctcttgggtctgttaattatttcctcagtttcaggttataaaataggattgtccatattcatatactttctccgtttcataatgtaagttgttctaacattttctgtatttatatttatgtcaatgaatttagatagatatatatgtctatattcattaacatcaatatggatatgggaaatgctagaatgacttacattgtaaaacggaggaagtatgtgttaatgaatctagacatatatgtgtctagatatatgtctagatttattaacatctatataaatttaggcaatactaaaatatcttataacctaaaacggaggtagtggttgctaattaagtatacacaattagtactaagtgtagattttggggtcctaatttttgggggccctgagcatgtgcacatgttgcaccggcctatgcatgggcctgtatagtacagtagtagatctcgggaactttttaagtatttttgacaaacgaaatatgtggaatctaatttagtgcgttcatatgaaatcttctagtcattacgaactgaaaaaaaagttaaaaatgtgagtgaaagtaagcaggcaagttctaaacaacagtggtcaaaacataggcctactaatgggcttggatgtctggcccaggatgttgggcccagccagcccaagtatgcaaaatatgactagttcactttagatcagattcaggccatgatagtatactttctatacaggtggtatccactgacttctaaaactcaacatgtaacataatgtaagtataccacatcattacccactagcaattattatctagaatattttagatctcatgaaaacatgacatatcatatcatttgtaattttattgtatttttagaactcagcatgcaagcaatatcaattcactatcttcacatcattttcacattatttaaacatatacgtctatcattttaataatgtataccatacattcatccatatatcccatagcaaaacgcggggtatcaagtagttttcttattagaacaagtttaatagtatagccaactattggcttcaaatcatctatagtcaatttaatagccaatttatataatagttacctataaatatatactacataattaatgtctagtctcacttatcatacacacatgtatcttgaagtctgtgctgcagttggctacaaatctatagcccgctgctcttatctctcatcttttatctccttaaaatatatttatagctagcttatagtctactattgtacctgctcccattgattgaagtccacacaactacttttttattacttgataaatccacacacacatcatactccataaatgcaagtacactccctttaacatatttcggaggaggcatgcatcgttgtatccataaatctcacttaatttataatgcaagtgtatcggcgtgcaaaatttgtaggcaccatagtttaagttttgatgggtaaattcatgcatacacaactccctcacaacaccctctagtacttcccctacatgttctgtattttggtgtgtagtgttcttctcctacggcctattggtgctttggtgctggaaatggtgatgcctagcaggaaatctggacaatttgtttaactagtcagcaccccacgcgttgtgccggggaaaaaggagatctaaatttaattcacatccaagtatttcaaattggcatatggtaaggtctatttgaattatgtaaattgagaaagaaaaacggacaccaaatattaagcatggcacatgaaaattcgtaggcaacagtaatgtttcatgaaaccggaaggtacaccagttcttcaattctacacttatgcaacattctaactaatgtttctcaaatgctataccacaaagaaagattgaagcaagagtaggtccacctacttaaaccatagcccatatatatagcccatatatatagctgcatacgtgcgattgagtttgaaataatgaaactacaactgtttttccttctattactgtcaggtcggcaaaagggaaataacatggctaatgaaaagtagtgttttctgaaaaggatagtttccaatggaatctgtacaaatattattatgcaaaggattgttttctggaagtaaagaaaccggtcaggacacatgtaaatagatgcatcaagacacgatacgtcttagaaaggtttgtctattagctcttgaataaaaagtgaagaatgtgtttgatagaaatgattttgcaggcggattgttcttcatgtacctgtggaaaacagaactggttagacatgtcaaaaatgccacaaaaattagcttacaacagaacatgggaacaaccattttttttatggacactggcatttgaccattacaatttgtggagcaaatcaacacatgaaaaatctctatgatcaaataaattcatatgaaatatacatgaaaccaagaatgcaggttgtaaggtgaacaaatgcacatgtgcccaagaatacagtataacaccgccacaaaaattttccctatatcagaaagcctaaaggtacactgcaacagtaaagagagaataactctaggcattatgttgatacacattcgggtccagctgaatcatctaggcaaataaaaagaatacacagctcattgttatcagttgtaaaatctaggcctaacttttatataagcaaaagcaaaaaaagaaaattaaaggcaagtaaaatcgatggatagttttaattactcgaggccacaaccaagttcactgagctaaccaacaacaaatacttgtagatactatgtatgtacatacatatgttatcatatataggacatgagcgtccagccaatttagcttctagatatttcaaagagttctctttttttatacgatatttcaaagagttctagacagctgatgctgaaccatgattagggtcatgcatcttgcttgtaagattattgcaacgaaaatgaaagcttctgaataattccgaaatctgcaagtacttaacgaaatgatataataacaaagctgtgtacctttgtttggttttagtataattggcggggttgttcacagagtcagtggacaaaaaaaatatatagcagaacacagctgcttatccaaatgagattttgatgactggaaaatagcttctgagcaatacaatgctgcagcgcaaaagaacagaccactcttcaataaatttaccttgtaaacaatgaatgcaaatcatggattgtagagtaaaggatggtgaaaaaaggcataccaaaccaagcattgtcatgggtcgaagcaaatgttagatgtgataggagggattaattttttttcagcagagaataaccaagctggagatggctgcatatccagcagcatgccattggaggagcgcagatggctggacagccacacacctaaatcaagcttagacctaatccatgacggagatgatgggggagatcacagagtagaaccatatctagagacattggttagtggagctgactctgtcatgcacattggccatcacacttgctctattccatacccaaaccctaaccgcagatcgcaaccctaaccacagtggcaactcatattgtgtatgttttacaattaatctatacagattggccattagcaaaaacaaatagaaattaaggtttactgttccatgacccagaactgacgattttatagccaatcctggagatatgagagttcagtattttcgcaaacttgccattaattagcatcaatctattttatagccaccaataataaaaggaaaatagatccacggtttaaccttgatgaagagcatgccatatacagtaatgaagagcatgcatatcccacactattacaaataacaacatgtaatttgaacagaatgaaatagtctgtaatttcctaaagcatgctaagtaatatagcatcagcatataacagcatgagaaagttgaaattacccggactagtggtcatagaagcatcagtgaaagtggcatcacatattcatttatgttagctaaggtccaatgtttgcctcacattgtggtatctgccatgtgcccatgcctgaaaacgaaaatggatgaatgtagtcagtgagatgctgctaaatacaaatattgcctcatgcaaaaaaatatatgctatagtttaaccgaatactaatttatatgataaaaaatagagtagggaaggtcatttatcaaaacaactaaataatgatcatgcataggaatataacgactaaacaacaaataagacatcccaaggaactacccaaaaaactgaaataatatcaggcaataacagttaacaggtagagaaaccctgaagagcaattgccaaccagctggaagccttgaacctgaaatatgaagggcataggaattagcaaacgaagccactcaaagaagcaagaacactattagaaacctataaaggtgaagaagatgtaacaatgtaaaatacctttcatggctttgataataataactgcatgcagcacccaccaaaagtatggtccaacattgttaatattatgataggatactctgcattcagatcaattggagaacacatctcaataacatatggatttagaatataataaattaacatgtcaatataaataattttgatgttgaactcatagagtatcctataagaaactttgatgttgaactcatagagtatcctatgaatataaataggttgtttccctatttttagctgcataagcaactgatagagaggattttgacattaaactcataaatccttccctaagaaatgtgccatcacttgccatataattttgcttgtctgatgcaccctgcatacattctatgatcatatatagacataaaaggctaatgaattaccttcagtcacttactcattgtactttgagatacaggccgatcaatgcaacaaacatttgctcaatcaagttaattaacatgtaaagcaaggcagaatgggtatgtatatccaagtggtgtatatgtatttgcaggaaaaggtagtaacgtacatatgtgatcctttcgtttgtgcttccaagaatcagtgaatgtgggcgacgaagcggcgcaagggagagatgtggaagaatcagtgaatcgatgttaccgatcgatgggacctctactgcactgtagagggggcgcgggctggctgtcgtcgagccgttcctgcagtcgagccgccgccgccgccttcgagctgctgctcccgcagtcgagccgctgccgcagccttcgatctgctgctgccgccttcaagccgccaccgccgccaccgcctcccaaggccagatccggcgaccttaaggccggatctggcgaggaggggcacggagcggccgtcgtcaagccgccgccggtgccgtcgagctgcagatggggagggagagcggcggagctggggaggaacagagcggtgaaggcggagcttcgggagccggcagccagcgagggggggcagcgcggaggaaggcccgccacgcattgtcgtcgccgccctccactcgggcctccgcggcgcccagcgccgtcgcctccgtttgacccacctctggcgccgccgccgtttgggctgcctcgtcacccggcgtcgtcgcctccgctcaaaccgccttcggcgccactgtcgctcgagccgggcggcccccaccgtttgcaccaccccgtcgcccgacgctgtcgcctccgctcgacctgcctctagcgccgccgcctccgcggcggcgcaaaatagtcctgaccccctccggattagttcgctccaacagccgtgcctcggtgagttcgccgtccggccatcatcccctcagttggcgacggctccgtggagcaaccgaagaggagcagcggctgcacaaaaggggatcgggagaggggcttttaactatttgccactcttacggatgttgcttaatgatttgccactaggcccacatgtcatagacacatgagggcccacatgtcattgacagggtgtggcaaatcgttaattgccatgtcacaagagtggcaaatagttaaatttcccatcgggagagggcaaaggaaggaggagtccatggagaagaaaccacacggcagggcagaactggtagagggagatagagggactggatcctgtcacgtggcagatcggacggactaagaaacctgcatttgctgttgattgtaaaacagaaaaagggcaaatgttgtagggaaaaacattaggttttacttcctctatttcacaatgtaagtcattctagtatttcccacgtatatatgtctagattcattaacaccaatataaatgtggtaaatgatagaatgacttacattgtgaaatggggggaatatatgattagttaattgagttatagttttggttgagctagaagtaaaaaacggaacaaaagttttccaatacaatatcctccatttcaatttgcagaggatatatggctgtgagcccctgactcgttttcttcggacacctaaaatccgaaagctgacatttttttttcggttgtcttcatttgctatgctacacatcaagcttgaatacagtgatccttgtttttgttgctgtacagagcacagttaacatcacaagatgcctacgttccaatcatccaatgtcacacagcagcgcatatcaggccaaaagaaaaaaagaatcgctaaaatacaagagctggtagctgttgtggtagaagtagaagtgtataactctatcaaacacagtaaaagagtagaacttcagtgttgaatatgctaggttattatataggcctcatgacatgtacactgacaattaatagttgtccatagaactgtcaactagatcaatatgccaatatgaacgagagaggagagaaaagatgaggcgagagaaacatcaatgttaagttcaacaacgattgttagcataggataaaagagaaaattgctactctctccgtttcatattataagactttctagcattgccatattcatatagatatcattaacatatatatgaatgtgggcaatgctagaaagtcttataatatgaaatagaggaagtattatataaggctaagaaaacgaatgaagggtatgtagtagcgaatttctctagatgacgtgtactgctaaaggctgcagaaaggaaggaatgataaacaaaatattttggtggattaaaggttagatcattaatttatttttttccttgaatacacagtaaaaatgggcatcatttcattaaagacggtaaaaatccaaatgaaaaaaatgaaaataaaaaacataccaaaacaaacaagagatacaagagatagggctaccaagaagcccagtgactaagggcctatttagttggtgccctagaagctgtgcttgagaaatttaggtgcctgagaaacatcggagaagtgcatgtgctttgcctggtcaggcaacctgagattttgcttgtttggtttggcacacttgcctgagagaaagaaaaagtgattgggcttagattatttatgttaattatgtgttcatgggaagaaacaaaaatcgaccaaactctatgcgcatcttagctctgagaaattaatagcatacacacaaagaagtgaaaaagaaataggatgctaagaaagagatccccaatgtgagttgaagcgatacccttcctccatgttcgcatacgtgttaatataggcgcaggaatcacccctggcgtggtgtttacaagtgagagaatcacgcattatctcaagataatagcgcgtgtagttacaacaagaacagaaacagaaaaactatcttatctatatcttctatccttatctatctatctcaacagaagacttaacagaaaccacattatctaacactccccctcaatctcaagtttcccaaattgagattgttacaaaacaactgtagttgccgaacaggaagaggcttagtgaaaccatctgccacttgatcctttgacgacacaaatcgaatctccagttgcttctgtgctacttgctctcgaacaaaatgataatccacttctatatgcattgttctagcataaaacacagggttaacagacaaataggttgtgccaatattgtcacaccataattgagatgatctgggatgtggaattccaagttcttccaacaacttgcgcacccacattatttcagctattgcatttgccaaagccttatattccgcctcagtactagatctagacactgtagcctgctttctagcactccatgacacaagattagtacctagaaacacagcaaagcctccaatagatcttctgtcatctagacacccagcccaatcagcatcagagaaagcacttacaatgctagagaaagacctgtcaatcctaagtccaagtcctaatgttccttgaacataccttagtattctcttcactgcagcccagtgtatatcagtgggattctgaagaaactgatagactttgttaacagagaaagatatatctggtcttgtgagagttaaatactgtaaagcaccaacaatactacgatattgtgttgcatcatgtactcctaaggtcacaccttcacttgctaacagtttttcagctatggacataggagtacttgctaacagtttgcaattcctcataccaactcacttaaggatatcaccagcatacctttcctgactcaacaacagaccacctcctagtttcttaacttcaattccaagaaaatagtgtagatcaccaagatctttgagagcaaactctttttcaagaccttttaacaatgttgtgactgctgaggtgctagagcttgcaacaataatgtcatcaacatacacaagtaagaatattgtgactcctttcttattaaagaagaaaagagaggtatctgccttggaaggtgtaaaaccaagttcttgcaatttcttacttaagagagagtaccaagctcttggagcctgtttgagaccatataaagctttgtctaacttacagagatgatgtggtagtcctgcctcttcataccctggtggctgtctcatatacacatcttcttcaagatagccatgtagaaaagcattctgaacatcaagttggcgaagactccatccttgtgacagctagagacaaaacaagtctaatagttgcagcctttactacaggactaaaggtatcctcatagttaattccatatcgctgcttaaactagcctagccttatatctgtctatagttccatccgctttcctcttaattttatacacccacttacaatctataatatttgtccctcttttaggtggaactagatgccaagtcttattatttacaagtgcctcatactctttatccattgccaacttccaatttttattacgtagtgcatcttgcaaactatctggttccctagtatctgtcagacatgcataccttatagtcccatcggcgtatttcttcggcttgcgggtcccgtgtcttgatcttgtgactcgaccaggagcaggagcttgcgttgtggagctgatttcctcgttgctcagcacagatgatccggactggtgtgcagaggaatcttgtgcatgcacgggactgtgcacagcaggctgcacgatgggcgacgcacccactgagcctgtgtcttgctcgtcttcggactcagcaccacctgacggcgcctgcatgcttgcgtcgggatcagcaccggtgtggtgtccgccggaaccttgcatggagccgtggtcgtccgattgcacgaaaacatgatcatctgccgccgttcctgcatcattttcatcgctgttttctccgttgttttcagtattttgtcctgcagcatgctcagtatcctgattagtgtgattagtgtggttaggatcatcaatcataggttgatcatgtactatattgccccctggatcaagcaatgatgatggtggaagcaaatgtggtggcagcaagagaacttctgaacggagacaggcgcccgcattggagtggagtttagcaaagggaaaagatgactcatcaaacacaacatcccttgagatataaactcgcccggcagatatgtctaggcatttaaaacctttgtggagagtactatagcctaggaagacacactgttgggagcagaaagctagcttgcgagcattgtacggccggaggttaggccagcaggcgcagccaaaagtacgaacaagagagtaatccggagggagattgattacttttaacggggttctattaatgagataaacagcagtggtgaaagcttcatcccaaaacttgagaggcatggacgcatgggctagcagggaaaggccaacttcaaacaatatggcggtgtttgcgctcggcagaaccgttttgttgatgcgcataggggcaggagacatggtgctcaatgccaatgcgctggaagaaggtatttaagtgctggtattcccctccccaatcggtttgcatggccttaattttcctgttgaggaggtgttcaacaaggttctggaaatcgcgaaatcgctcaaaaacttcagatttgtgcttgagtaagtaaatccatgtaaacttactaaagtcatcgaggaagctaacataataaactttattgccaactgaacttggtgcagggccccatacatcggaaaaaataagttgcaaaggtttggaggacacactaaaagacttggaatagggtaattgatgattcttgcctctctggcaagcatcacacacagactcctgactagaatccctagttaccggtagattattcttgctaatgactcgatcaacaataggaagagatggatgccctaaacgactatgccaccgggacaacgatggtttgacaacaccataggcctgcttatgtgatgcgctggacaacttgtcagttggcagagggtagaggccgcactcacacttgcctcgaagaagcggcgtcctcgtgacctgatccttaaccaagaagaaatatgggtgaagctctatgaaagctctattatctctagtaaagcaatgagcggatatgagacttttatatgcacttggcacatgaaggatatttttgagaaataggtcacgttttggggtgcgaatagtagaatgaccaacataattgatgtccatacctgttccactagccgtgtggacttgctcattgctggtgtacttgtccttcaccgccagcttttccatctcgccggtgatgtggtcggtggcgctgctgtcgacgtaccagttggtgtcaacgctgtaggagcttgatgcagcaacgttggcgttcttctcttctccagtgaaggagtgatcgaagcatttccagcacttgatgacggtgtggccgatcttgccgcacagctggcatgtcggccttggcttgccgtcgccgcgtccacgtccaaagccgccacgtccagggtttccgccttgaccccggccaccgccgcgccctcctcgcgacacagaattggccaaggcagatgaagagccttgaagaagttctagccgactttcaaagccaactagcagtgcataggcctcgctcatggtgatggagtcggctcggccagcgatggaagacaccaccgagttgtagtcgaagtcaaggccggcgaagatgtaagacacaagctcctcatcatcaagaggcttccttgcagaggacatgtcatctgctaacgatttcatcttaccaacatattccgcaatagtgcgtgttcccttcttggtggacgagagcgccattcggatgttgatgatcctagcgcgggactgcgacgcaaagaggttttcaattgcctcccacacctccgtcgcctttgtgaaggtagcaacttgagtcagcacctcacgggacagagacgatagcaagtagctcagaacttgctgctcctgagccctccacagcgggagagcaggatttgccaccttcttggtggtctttccatcatccttggtgatggtgatggttgcatctggcgctttcgtgctcccatctagggagcctgccatctgcgcgccgcacaaagccgcaaggatctgcgccttctagagaacgaaattgctcttcgtgagtttctcagaaacagcctgtccattaaggacagatgcaacggtggaagaggatgatgccatctaatctaaagattggtggaggaaggattcgggtggagggagaaggctctgataccatgtgagttgaagtgatacccttcctccaggttcatgtacgtgttaatataggcgcaggaatcacccctggcatggtgtttacaagtgagagaatcacgcattatctcaagataatagcgtgtgtagttacaacaagaacagaaacagaaaaactatcttatctatatcttctatccttatctatctatctcaacagaagacttaacagaaaccacattatctaacacccaaatccaataactcgcaaattaaactttcaattcccagtcgcatgcaaatcaaatcaattaacgaaacaaatggaggcagccatcttggtaagacggtagatccagctagatagatgacaggggctgcttcatgcgagaaggtgagagatcgcactataccgcacgccagcttccgttggacctggcgatggctccgcacgacgggcgacggccggaggcgggggcttcgcgcgacggcggccggcggcaggggctttgcgcgacggcagccaggacaggggcttcccgcgacggcggctgacggcgggggcttcgcgcgactgcagctggcggcggggggctttgcgcgacggtggccaggacaagagcttctcgcgacggcggtcgacggcgggggcttcgcgcgacggtggccaggagaggggcttcccgcgatagcggccgatggcaacgataccgatggcggtggctttggcttcgtgcagcgctagctgagcatgggacttcgcaagagattaggctggtaatcctcgagtgatgctacgcctcgagctcaggtgaccaaaatgggtcgcctgactcaggctaatgacatgccaggtttcatcaggccaggcaagtggaaaaggggctgagggtggcaaccaaacagagggtaaaataactcaggcttgtctcaggtcaagcaagttttcctcagggtagcaaccaaacaggccctaactccagaaggtgtgtttagcccatgcatacagcacactgcacaccacaaggcatcatctctaactgcccttaaaacttgatttatatcagggacaaaaaaaatgaaaaggatgtcgcgttgtagttactactaaaaaaacaattttcctggacaaggagctcccattttcgcacacagaccgtttttgcgtgcatacgcaaaaatcagactcctattttcacgtgcggacccttaagaggcccgcacgcgaaaatcgattttcgcgtgaggcccgcctacaagtggtggcctcgagcgacgatgacgacaaagaggtggccgggagtggtgccgccggccccgcgcgcacaccggccagatccgcatcgccccgaccgatgacaactgggaggcaatgttggccgggagcggcgctgccggccctgcgcgcaagcgtgctggccggatccacgccgcccctaccgatgacgacgagaaggcaacggcggctgggagcggagcggctggctccgcacgcacgcgtgccggccggatccgcgccgccgccgctggattctagggtttccttttttgaatttttattttttttctagaattttatttttccttgtgggcgacataacatgaccgcatgcgaaaatccaattatcccgtgcggtccacttaacccgaccgtacaggaatatagattttttcgtgcggttgggccgtccacacgtgaaaatatttattttcgtagacacctgggtgcagacaggcaagacctccgcacggaaaaaccctttttgactgaatggaaaaatcgatttcgtagtagtgagtgcttccaatgctcctagtcctaggcaactaggatgaccaaagaattagcctttcttagttctcacagttgccaggggataatctttagatggcgtgtattgcttaagagccaataccagactcaactactgtacttttgctaagaaaatctccactctttataatttaagctagccaaccgtttaatattagtagttattctagaaaatgcatggtccttgtctcaaatgtgcaaagtataacttggttcttggtttagtcataattaccttcataaatcacaagtgtcatcagccgttactgtttaccgtccgacaatggtaacacagcttgacacctctgctctggtctcagagccattcaaagtacatttatgtagtgcctgctatatataatctccatctcaaatattccctccttttttagttttcacgttggttagctcaaattgaactaaccaacataaaaaatttggaaacggaggtagtacatcagatgggtaccccccctctgctcccataatcatgccaaatgcaattacaaatgtccagtatctgttaatgatgaaatttgataaatcatgcatcggatttggagttaaggccgaagcggatttgggaggaaatcgataacggaaacagggtatgaatcggcttcggaaccgcatcggctacagtgtgcatcggcagttaccgaatcggacaagacaagccgatgtagctgattccggcaagatgatattggaatcattgtcggattgagttgacgtgcttcatgatgattgccacgtaaggatcgagtccgaagaaggcagttgtatctattaattaggaatagtatgttagtttccttttatctttaggaaagtgtgtttagtgtcctataaggactttatcttttccttttatctttaggaaggtttctttcttgtccgacaaggacttgtatcaacccatgggtataaatatgtacacccggggtctatgtaatctatctccacgatcaatacaattcggcgcatcgccaccctttttatttctacttttgtttttacgttccggcggaacttggcacccgacgcggggctgcatcgtcttcgatctccggcgaagggataagtccaatgttccgccggcccaggcaattatatcgtttacgtcggcatgttcaaggctgcatcagtacattcgacctcttggattgatctggtttggatgatatacttgtctacctatttatcatatatctctgttaatctagtcttagcatatcaatttagctctatcggctgcttctcgttttagggtttctgcaggcatcggctaaatcgcgttgctagattagattagcttagacatctaccaccctgaaaactcagtcaacgacttgattgtctagatattatgtttcttttcatacttagtgctgcatcagttaagtttgatctactaagtcgtgcttagaaccataatctctagcctgcttcttgattgccaataagggtttcatcggggtttcagctggtgagttatctggacgttgcatcggctcataaggattgcatatacatataagttggatttagccgatgacaacaaaggcttcagtgtttaatctaatcttgtggatttcatgacatcagacctccagccgatgtgtgttttgaccttcgaatcgatgcttatttatcatatcattatttgctgattggtttatactggattatattgttattttattacatcgtcgtcagccaattgcctttatatcattatctacattggacatatagccgattgcttaaaccctatcgctatcggctggtatcggcatcggctattatcggcatcggctggaactactccatcggcttgtcagccgatcggctatttcgatctactatttgcatatcttgtcagttgcaggatcaaactgactggtacgctcgaatctcgtcaatatttggatctgcacaggagctaagcagatctcccaggacggtgtgttcgattttttttcgtcaacagtatcacacagttattagcaacttgttgattgatctttgttgttagtcgtgaacaatcaccgaaacaacatctcgtgatgaacagcataaacaatttcagaatccagtaatgcatgcatttagtttgacaaaagtttacttgccgcgctagtgcaaaatggaggcatatgccacacactttgcaacaacgtttgttgcagttcgttggctcagcgcactgaggcactacctaagcaaaaaaaataagcacgacataatatatgtaccggcagatcgactcagcttccattagagaaagtcacacacctcgaattaagataatttttgaaatagcacgcctgggagaagaaggtaaataataataataatatgctacaatgatattagatcactgatgaagatggcagcatacacgtcttggacatggagaggctcgattaaattacattgcattatggggaagcaccggtggagtggtgatggagtcgtgggtacatgattaatttcagagttcaaatcctggtgtctacgaatattatgtacacgtaaatgaactgtcaatcgaaatttagcgagattatggatgtaccgttggtttccgtctttttaaacatgtgagaggggatgcattcgcaagctgtataagtgtggtgttgcctgtgtaatactccctccgtttcaaaatgtttgacaccgttgactttttattcgtgtttgaccattcgtcttattcaaaaatttaagtaattatttattcttttcatctcatttgattcattgttaaatatactttcatgtacacatatagttttacatattttacaatttttttttgaataagacgaatggtcaaatatgtgctaaaagtcaacggcgtcaaacattttgaaacggagggagtattgatcaatgtgtgtgcgtcccccttctagtaaagaaatatattgcattatgtaaacagatataggccaggccacccactataaataccttgctctcccaacattgttctcacagctcattacacatagcccgctcggtcatcggagcgagaaagctcgccggcgacctcaccgtgcacatggcgcgcgccgccatttgcctagccgtcttcttcctcctcgccgtcatttcatccgctgcctcagatgacccgttgacaaccgtgcagcagccaattagccaggtaagccatggcgccaccatggaggaaaagagaagttcgccggtgaagcaagacgaaggcgaggagaaggcagccagcaaggccgtccaagccggtgatcggcgagacggcgagcttgacgtcggtagaggatcaggccaagatgctgagcatcaccgaggtatagagatcaagaaattagataatgatgacgatgatggcagtgattgggactctgttgatgactccgattcggaccacgattcagactctgatcatgatcatgactcggactcagatcatgattcggactttgatcgcggctcagattcggatcatgattctgactctaaccatgacatcgatggtgatgacaacgacgacgatgacgacgataataatgacgacgaacacaaaacaaacaagacaatgagtaagaagaagaagcgctcagcttctggtgggagaagggtaggtccaggtggtaacaagagctaattaagaaagaaaggaaatgctatgggggtgtttgggagagaggggctacatagggacttatatttttgtgagagggactaaagtttagccccactttaatccctccaaccaaacaccacctatatattgcaataatggtgtgtgagcttggtgcaacgtgcttcctccacaaatcgatggatggcgcgttcttatctttatttaacttgtataattatgagtgtgcttagggcatccacaatagttatctatatgctctctacaagagattcatgtcagcatatcttcctacttggaagatattaaatgaagagagagagagcaaaactatctactaacttggagatagtctatagataaaacgaggcaatagatcgatacccatgtagacatactattaaggaggtttactattaatatagtctattgctgagatgtacatatgttatagagagcaacttactttaccattgcgggtgctcttagtgcttactgatcgatacatctcctctaaaaaaactaagcacgaacaatgtaagcccgtgtgtatttgtttgtctatcatacaagctggaagatttaaatatttcttactaatatactaggcagaagcgaatggtactcggtttgaaatctcaaatttagtattcccatgatttgataatttcgtacgaaatctagagtctcaacaatacttatgttatgatctaataattctgaaatttggagctaataaattccagattgtcaactataacttttattattattactagttatcgtgcacgtacaatgcacgtaaaaatcaatatgaattaaatcgggcaaattgcttaaattaaacttgccaaactgcaagggagaacatctatacttttatatagttggtactcactaacaattattagaagctaaaactcaacatgcaagtatgccacatcatcacccactagcaattactattttagatcatttaaaattccatgcaagcatgccacatcttcactcactagcaattactattctagcctattaaaatctcatacaagtatgacacatcatctataatattatattatagagatcaacaagtatatgtcaaatcatcttcctcacattattttcttaacatttcaactttcatcattttgacaatatttaacatatactcatccatgaatcccgcagcaaaacgcggagtatcacctagattttattattttaaaaaccataatgatggtagtaataagattgtctagagctacggaataattttgaaaattgaatttcatgtagtttgcatagtacattactgttgggtagtacaattagattttatacgtagatcaaatttaaattcttggattcattatggcacacaattttgttcttcttagtacaattctgatgtacatcaaatgctcaatatttttgtttgagagtactacaattgaatacatatgcaccgctacatgcttcgatcaggaacacgcacaatagagattacttgacaatttcccgtaaataagaacttcgctggtcagaaaccgattgaaagaagaagaataaacataacatagtataattaataaataacatagtataattaaattgaagtaaaattttgtcttatgttttctgaattacctattctcgatgtggatacccaatctaccacgggagcacatggagaagcaggcaattgtgccggtaaatgttggcatagataaacaaaaaatcatgaggcaataaaaaaaatcccatatgctgtatttggtggttcctttccaagaggtgtaaataattgatctacacaaataattgatctagaaaagaataattgttataaatacatataaacaaaaactaagaacataaaaactgctccaccttctgtagcaaaaaaaaaagtgatacatatattctgtaccacgatatcctaaaggaaggtgctcaatttagcttgtgagcctcatctttattgcaggcaccatctccacacaaaaagtttgcaccaatcagttggcatctccctaatgctcataatcaatgttttatttaagagaaatttcatcttagttttttttatcaatatatatggagaacttggtactgaagtataccgaagtgagattaatactattttttaagatgatggtgcttgatagcgatagccgtgctcatctacgatgttcaaggccaccgacaaatcaagatttaagaagaccataatattctgaatcttaacaagttaatggcagaataagagagcaaaatttccaaggagataaagatatttcacatccaaatagaatctgtattaacaaataatgcacatctcatattccttcttgcattgccatgaaaaaagagcaaataaaaactgatttttgcactcaagtaagatagggaaaaaaatggcaattggtagttaatacctgatcattcttttgtgaaactattttaaattagaagctctttatgcatggagcaaatcagcaatcaaacatcgcactatatccatcacaaaaaaaaatgatcatacatggcaacttcataaaaaaaatatagatttcagtaaaaaaaaacatgactcaaatttggcactaaaatatttattatttgaggatctagaaaaggaggacatcaccttaacctacagtctgttcaggtgctcgttgatcagataagtggctatggctcactcctcaccactgcatagtaccctaggccaccagatgcttagtctgtgagtgctacgcagcagcaagcaaacaataccacagtctgctcatcagcttgcccattcgcccatattcattgttgctttgtgtttcccactacttgtacagctaaaaaaggtgtcacaatcaggcagaagctataaagggaggtcaaattgagacaacctgcatacataaagccaacatacttacattttttcagacaacctgcttttataaatgaccaatatttgatgtaaatttaacataacacttggtttcaaaatacaagctatcaagaatcaggttaatcatatcatactgaagcatgcaaaatcataactaaatctagccttttcctcaaacttccctccggccctcaaatgaaaggtgtctgatcattggctgactactttaaggcttcaaaacaaaccagaatgtaaaagcatccctccttccatgcttcatctgtatattcttagcttgaaaaaaaatatgcttagtgagttcacaaaaggaacaccactatactcaagcaataattttaggagaacatattgagatgacatattcggcaggtgaaattttgatactaaataagcacaagttccaggcgacctcttacattttgagctcacagcatgcggcaaaaattgagccagctgtacttctttgaatgttccgaaaaataactccatatttgaaatgttgtgaatctattgaacaaactgcaaacaaactccataaatggcacttctcagtgaagacaagtgtttgtgataaacataaatggtactttgtgttgccattgaaaaatatgtaaaactgctggttatgcattcagtcttcttgatattaccagtccataccagcataaaaacactgatagagaaggttaaagtcctagtaatctgttgttgtagaaattgactgcttcaactacaaaaatatattctcttcattttttttaaaaaaagctatgcagtatagaatgaacacccaatcacccatcagttatcagttcttaattagtaactgaccacaaattcttttcactgacaagaaacttattagaaaaaataattcaagttccaatagagagtaatactatttttttcttcttcaagccctacaccaattcaaatttgttgacctacttgaccttagtataatccactgcttgctgagctatgcgcgtctttaaatcctggattcaagtaattgatggaaattcaaccctgtagttatggaaattaacagaaatttgcagttggaaattttcaagcagcaatccaattcaagtcttgttcagaaatctgaagcataaatgctagcaatctttttgctggtagataggagcttgaggaaaagattgccctctagcaagctagctacaagatggaaattccctggtgtagagtagttttgagattgcctatggttggcgtgctaaatgccagtacaagtgcaaaaatcatcttgcctgagatatgtacaggcgtacagccatgtagcagaccacaacacaccgacctttcaaaatggaacatgggtactgaagattgacaaaacacacctcagacagaagtgaattcatagtatgtgttccatcgcccacctagctcttgtgttgcccctaagcagactgttgagatcacgtagatagaaaatatccaaactgaattccagtaagccgtataaccgtagcatcttcagtatctcagaatatatcaacgaaagcattatatctgatcccaaccggcatatcaaaacctgaccaccatacaaatcaatacaaatttagacgaaccatatgcaagcaagtatgcaacatgaacaagattgagtaaagctactgagtgaagatgtatggctcttccagctgacaatcctcatgaatcgaaagtcctaaagtattacatcatcaccgtacagagaataagtgattgtggatgtaccttgtggatgagaatcaaggaagacctcaggatggcgggcagaaggtaggcgtcggcgaggaagccggtgaagaagtcgtggaatgaaagcacggaaaggcattccacttccacctaggcgctgtggggggcagtcccggacgggtgcggtggaaggggaaccacctcggcgccggtgattccagactgcggtggagtgcggcggcggcaggaaaggatctcgccatcgggggcagtcgcggcggtccggtggacgggggaaccacaacctcgccgtcggggacaggctgcggtaggtggagtgcggcggcggcgaggaaggacctcgccgtcgggggcggctggggacgacctcggctccggtgcggcagcagttgagtgaggcggcggcaacagtacacgcgaggaagaggagcgaggagggcgtaatcttcgcccggtggacagggtgaaattgcgcggaggcgtggtcttcgcgcggtggagagggtgaaatcgcggtggacggtaggattagcgatcaaggtgatgtggatgtagatggacgatggtgattataccagattgatttgggtagtaggattgtagggggacaacttctccttttcctttttatattagtacagatatagatatagattatgtagtataatttaaatttaaaattgatatataccaaattgtagtcagtttggagtataagtgtactattaacttggtttaataaatctgatatttcaaattaataaattttaaaaatattatgttgtacttcatccggacccttaattaggttttttattctaaaattaataaatgtcgtcttatgcttatgtttgggatctcaattatagtatttttatgacataataaatgtaaaatagcccaagaaatccaaattaagtagagttgatagttgacgagataaagttttggaaaaagtacgaattaccccccgaactatcgaggtcgactgaattacacccccgaacttgaaaaccagatattctacaccctcaactattaaaactggacaaataacacctccgactcaatccggagtggttttgggtccacgtggcagtctagtcagcatttttttaaaaaaataatcagtgggtcccacctgtcagttcctaccgctctctatcccaatctctccctctctctctcttctcaccagcacggctgcggctgcacgagggcgggagcaggcggcgccacccacgacgctgcgcgctcaactacacatccaccatgatcgccgccgtggcgaggagcaagagctacggctgctcggagagcaaggcctagtccatgtacaacctcaactacccgtccttcgccgtggccacgggtggaggatttggtggcgctgctggcgttcaagatggcggtgaccgatgacccgtcggggggacgctgtcgtcgtggtcggacgccgacgccgacccgtgccggtgggccggtgtgacgtgcgtcaacacgtcgttgtcgaggcggctggcgggcggtgggtggggacagaggccgaggctggctgcgggtggcggacggcggatcagcaaatggcaacaaatatcagggcaggtcgcagttgcattcgcgcggtcgcgccgcggtgaccgacggaaaggcgcgcggcgcggatgtggcagtagaccgccagcagttggaatggagcggctggagcgctggtggtgaacggccagacgggatgacctgtgggcggtgctaagcgtggagacgtcacgatgcgaggagccgaggtcctcgccgcccgccgcggcccgtcctcgcgccgccgcccgtcgtcaggccacggcttgtcggcgtcgccatcgccagaagaacctgtccgggtacgtgcgccgaccgtgctcggcttgctcgcgctcgtccgccacctcaacctgcacagcaacctgcgcaggcgagctctgcctcccgctgccggccgcccgcttcgcctccgtctcagctgcccaccgccctccgccgccggcagcgccgcctgcttccggctctcaccagcacggtggggtgagaagagagagagagggagagattgggatagagtagagagagatagagagtggtgagaactgagaggtggggcccactgattatttttttaaaaaaatactgactagactgccacgtggactcaaaaccactccggattgaatcggggggttatttgtccgatttcaatagttgaaggtgtagcatttctggttttcgagttcgggggtgtaattcggtcgacctcgatagttcaggggggtaattcgtactttttcctaaagttttacatgtcgtttaacttaaatcatgtcttaaaagtgagatatttatgatcggagttaatccactcttgcttgtagtaggaaactcaacagagtacataaaatagtcccaagaaatgcttcgtgttggtaacttgtatacaatgtcaaataaaagttgacatattgtttcaaagaaaaaataaagttgacctgttggggcacatgcagcacctgcaaggctcgacctttcaatacacgtgctcagagagaccaataccaggatcaaaatctttggaccttattcatttttttatcaaaaactgctcacttatggccgaaagtttaccctacacaactattatggttatcttaaaatacaaccaaattcttaaaactgttcattctatcgtcgaccgttcatttatttcctcttccaaaccaaactaatgaggaaaatattacaactattatggtaatcttaaaatacacccaaattcttaaaacaattcattctatcctcgaccgttcatttatttcctcttccaaaccaaactaatgaggaaaatattttttataaaaaaatttgttggctcaacatgtcatccactcatcctctttccctctctctccctatcgctctcttatatcttcttgtgcatcttgtaagttagagcgcaagttcctacgtcgaccggagctcttatccagtcttctgccggcgtcgcttagtccatatttgctagtgtttatacgtagcttgaatctcctcatactaccgttgttgctcagagcccttgtccatccacgccgctccttgcctcccatattcacagccatccaagcccacctatacgccatccaaagctcttttcccctgcatgtgacacttagaggcgattggctagagcttctctactcagatgctggctaagctggtaggtccactgagaacatgacatgtcctaaagtctggatctagttggctacaagcctacaaaggcttgtctccacctccgctttcatcaagcaccacaacaatccttggtgggctcgggactacccccgattttgcccaggataccccaccctccgaaaaaaaagcccataaaccttggttctcattcaagccaaaaaaaacaagcccacaaagagagaagggaaaaagcgctaggtctgatcttttgggagtcgaggcatccgacacaccacgacgccatctcgactcctttggtcctcgccgtctttgctacgcgcttgcgtcgtcgcttcctcgccgcgccgccgtcgagccgccgccaccacttccctaactcgatctacagaggccgaatggcagagtgctagaggcaccgctccccacgccacgctgcccaggtgtgggctgcctgcgccggggctcctcacatggcgccgccaccggccgccagcgtcaggagccgggagcccaggacccctggcggcctggccctagttgatcccctgcctcgatgctttccttctgtctaccccttagagtcccgtgcttaggtgagtaaatcagtgtactctgatttgtgaatcggtgaatctgtgaatgttatttttatgagtaaattttacaaaactacatgttttgtggtccaagttgcagaaaaccacatatactttgacacttagcgcttaagtacatatattttagtagtgtagtttcagaaaatcacactatcaatgaattgattcacccgtgatatggcgtggctgttccacttatgacgaggacgtggcatcttattaccagccatcacacgaaattaataggatgccatattctcatcctaggtgtaacaactacgtcatctcacatgtgaatccatttattgatagtgtggttttgtgaaactacactaccaaaatatatatacttaagtgccaaatgttaaaatataggtggttttctgcaacttaaaccataaaacatgtagttttgcgaaatttactctatttttattggtgaatcagtgaatgtgaatgtgttgctatttggtactattgtagttgtaggatttgtaaacatgaggttgatatggaattgctcgtttgtatgttagccttaatctagtgatgaccacgcagagaaacaatatactcctatgatttattgaatcattgattcgtcacatgtatcaagtgagatatcttttccgaagttagtgaagaagacatgagaataacaacttttatagctaagatagtggcactgtgattttctatatgtgcccaatatcttttatatttgaacgtgtgaacttgcttgttaagttagtcaaatattgactatattagacaatattgttacattcctatcactttttcattaaatttgtactcgtatatgggatttaggacttcattaaatttgtactcgtatatgggatttacgacatttgaaaatttagctatatgtgatgtgtatttgtgagtaggactacccaatgaaaaattcctggccacgccactgcttggatgtcggcttgatggtggtgaaaagttcagagagagccactgtaacgcttagggctggaattgtattgggcctaatttatttagttatcacctagggttcaaaaacaatattgtttttgggttcaacttatttacttatcacagctacatatgcttttaactctcttgtgttttcatcatcattttacataaaaagtttaatggagttaataatagtaactaggtaggccaccttataaactagtgctgctctagttggctgccggctgagagaggtgggactaagagcatctccaacatcgtctccaagttaaattttagcaaaaaaaatctcactccaacagtctctctacttgaatggctaagctaaatggatggccaaacttcacctcccactagtcaaacttggccagccaaactgactggcaaattgtgggcaccacgcctttccccaatgttgatttccgccaccacgacctcccgcgccgatttccgtcgccacgagatccgcttgcggccgtgctgagggaaaaaccagggaagaggatgtggtggcatggcggcacgacggcgagcgtcgccgcagcctcccacttgtcgccgccggcatccagcgctgatttctgtcgccttgccgccgtgccctcttgagcgccgaagagagagaagaagggatgaggggcagcggcgtgaaggaagcggcggcgccagtgagatgggagacgaggtggtagaggggccagcgagggagggcttcgtcgtggcctcccgctcgcagcctggtatcgtgcaccgagagagaaagaacatacgggtaactcggaggaggtgttgtcatccgttgccgacgctgccgtcgtctgccgtcgtctgccgccgagaccgccgcctcgttgttgttcgccgtcgctcgcttgctcccaccggcctccgccgcccgcaccgctcccaccggcgccgcctccatcctcgcgccactcccgtcgtcctccgccacccgcgccgctcccaccaccgccgcttcgatccccgcgctttctcctgccggcgccgcctccatcccgcaccgaaatgtagagaagagggaagaataggagactgatgtatgggtcccactattaaattggagaagtgtaatggagatgctgtcagagtgaaacgtaaatttggttctctaaatttttggcaagtagcccaataggatatttggagagtcaaaaatagccactctgttggagatgctctagaccatcttgccgctgctgctgcttctccgtagctagcttagctttggcccaactgctattgctcgctgcaaggatgcaaggcccatggtctgctagctgcactagcactactgcttgcttgcaaggcccaactcctttcttttctagtagtattttttttcctctaattattattgggcgttacaacttacaagtacagtccacataccgcctctgctttcaaggagtgcctcccacatccaccgagcatggtcaactccttgagttcctctcttccctgaatcctgagtgtcatattctctttgggctctttctcaccatgagctcggtcgccaacttatccatacactgcgtctgccgagatccgcctttgctgccatcgctgcttccacggcttgcttcatcaatagaggcaaaaagaagatgcatagttggctcgacagtaggcgattacaacctgtcgataaattcttctttacttttttgctgactggatgttgaaagtcaaggtgacttttgcaaggaggtagaatgaacaattttaaaagttgagaagggtaaaatggacttatccttaatttaaaccatgttgagcggtgtcaatgaagtcatactcctttggttccaccacggtgcttttagttttcctgtgaataccatgattatatatgcagctattatattacatatatcacgtattttcgtagtataatctaattcctccgttttaatatcttatttggtgaaagatatatccaaatttgattttatcctcaacaaacttttacacgcaacagaaaaaaaaaaacactttgtgatgagacaggtccaaagattccatgtcccattttcaacccgccatctctacctcccttgacacatgccatatcaggaaggaccctccgccggcgccggccaatggcggcctcccacctcgctcccgggcgatggcgccccaccgatccaaagatccaacaaaatggccaccggataagctcgcgacaccgccgcggccaatggcgccacggcacacgtacgcacgtccgaccgatgcgaatgttgcgacgacgacgacggcgatgacaatcccctctccgagatggtcgcgtaacatcgatcgatctcctcttctcttttgcaaaaaaggtgaggaagactgtacgtgcggatggttgatgcagaccggtccatatgcatgttctgtgtagtattgtagtgcagtggttttgtttggccaaagagtatgcagagatggagtattctcgtaacacgataatagctatagctgcgtgcgaggtcgatgcatattggtctgctacttgtcctctgcgatggatatggagcgaggagtttagtggggtttgttcagtttgtagctaaaattattgttttttttttacatgttttagtgtacataaaatttggttgagttagatgtgtttagttcgatgtcttcttcttaaattttagtagtgtttttatgagagaacttttagaactcccaaaatttggatttccacaaatcaatttgtacaccttactaaacttttatgggcattttggattggtaccaactaccaagtcatgctctacaaattaatttgttagtagcttcaattctactcttgaggggttttgatcgaagccaaatccttgcgatatttcttgccatcagttcgagcctttctggctttggtatggatgagttatcctctgatatactccactactctctaaaataggtcaatgacatgtggacccatgtctcaagcacaagctaagactgcactacattagtttcccatgggtaccacggccatggaattatccacgcacatgtttgctcctttcgataagtagtgtgtgtacaggaaagtaggagtactcgctaaaatacttgcacgcggtgggtgtcttgtaatcggaaaatatcctgatgtccataattatcttgcacacacagacagacaacctcttcagtcaaacactcaaacatgtgcgaggacggcgtactccccgcagcgcactaacgtagtctcaagatgactctcacaagtgatgccactcattctgtccaccagcataaacggcaaaacaagcgatatcatccttaccatcttagggaacaaaaacgaccaatcgttagttagtcatcgctgcagtgaacaaacagataaagaggggaaaaaaaaagatgcaaacttgtataaaccaaaacacatttttctctgaaaaccgccatactttggtggtaggagcaagtcaccgtcagagtctccctctcagccaaacaaagctacaaacaagaacagacgcgagcaaagcttgtgcattgtttggtccagcatcgacttttctcgagaagccatctcaggagcttctggccctgaaagtgaccgcctttgctttgtctcaaacaatgcttggaaagctacttgtaacgagaggattagaatgggggtagacttggattaatgataataataagtgacctgaaaactgacagcacccaaagagggcatggattgcaaaagcatgcgaggatggacttgcctccttcagccttgatgatttttggttgtcattcaaagggttggcaacctaacttcacacaggaaaacccagatattttctcaacgattctgttctctgttgcaacatgagaattcagaaactccttttaaggctgactttaatcttggacttctaggtatcttgtttgtctttgaactcatggtcatgtgcaggaatattatactggttcaataagcatattctttgactatgaaaggatttcatagtgcaaaggagaactcctttcatatgtatatattacagcacaatccaagatccacccaaatcaaaaggcccccaaccaagcccaagtgttagcggaatgtcatccaagaacacaacaatactatactacaatgggaagccagctcaaatgcaggaaaaagaactcttgaggttgtttcacatgtgcaccaaagaggcaaaaaccactccatgcttccctatttatacacatactactagcagtatgcatacataactacaaggtagctaggtgcagtccctaaaaagacctaagcccatcactagccagcaactaaagataattaaccctacatactaatccttacaagaggcatatatatcgaagacaatggaggaactaccatctcaaaaagatttaaatctctagcaaccatttgaagcttcttattcatgccagttcgcatgtcccgtgccagtgatgaccctactgttcaagtggcgaggtgggtgactgaactgctagccgctctgatacctcggcgagagatgttaagttgcacttgatcacggcctcgacaaagtagcatgtctcgtcctttgtatttccatcaggcacgtccaccacaaatgattcaatcacaagcgtccctggtcttccatcgatgctctccggatggacagttacgatggatgagtagttctgaaggagtggggagacagaaatcagtacaaatcaaaataaagctttgacaagtcgtaaagatcatgagtgcctagctgtccataaacaagaacctaaaatcattattcttcaattaaggcaacatggtcaacttatttttcaagtaaggttcaagaaacagcaaggccacatgcagaccacactagtaggtcattgcctttcaagaaagcagacgacgtattggaattcacatcgcaaatcattaaactgaagcccaaatgaagaacagggaaaacagggttgagtttcccagtgtccattttttcattctatccctagtggaagtcaaaactactcatgattatattacttcctagaaattagtaggtcaaataatgaagcacaaggttatctatcatctgatccaatcaaaacgatggatgaaccaatgtgacttccagaacccatatccattctaaatctagataggcatgccatatgcagaggttataatgccaaacatttgctaccaagataaaacagaaaacaagatttctaaaaatactggattgcagtgagtttatcatactgtggattagtaattaagaaggcataaatgatatacttgcagtgagccaatcatactggattagtaattaagaaggcagaaataagcagagcacattatctaatctaaaaagggacaaaaaaaagcagagcagtagacagaaatgggtatcagtatcgagtggcacgaaccctgaggcggtggtcgccgccgacgaacttgacgctgaggatgtgctcgtcgtcgtcgagcagctcgagcctctccgtgctggtggtcgccgggaggccggtcttgacgttgacctcgcgcacgctgccgatctcgaggtcgccgccgcgcacgacgcagcggctgacgaacggcttgtacctctgcggctggtcgaagctccgcaccagcgaccacacctgcagcagcagcagcgatcgatcaatcgatcaaacaatcaaatactcccatcaccaacaatacaatcaaccaagcagatgccgcgaagaaacaagtcaaaacatcccatacaattttgggatctcgagcggccaaaaacacggcgaaattcgcacattcaattcgagctagtaccaatcaaccgaacaaatatctcaggcaacagctacgcatcaaaccgagccgcacgagcaccaaacccagcgccaaaacaaagtataaaaaaaattcagatccaaggagcaaccaccgagccaagtagccaaaccaaacgcaaccaatcgaacaaacaccaaacgaagaacagaaaaaaaaaagaggatggaaggcgtcgtgagtcgtggaactcacgaggtgaacaggagccttgatgtgcttgacgagcgcggagctgcactggtgctcgccgggggcgtggctgtggagcctccgcatgtgctccgcctccgccgccgccgcagcccccgccgccaccgctcctcccccacccccacccgccgcatcatccccgaccctccaacctcctcctcccacaagccccaccatccctcctccgatcacccgccgccgccgccgccgccgccgccgcgactagtggctgcgcttcctcctcctcgtcgtcgtcgtcggcctcgcgtttgcttggctcgcctcgcttgcggcgagaagagggtagcggtgggttgggtttgcttacacacgcacacacacgggcgggtacaaaaatctgcgggaggggaggagggggtggtggggcccacccacgagttatccatgcgcggaccccgagggggcgggaggggtggggagggtgcgtgcgtgagcccggtgcatggaccggaggggtcgtttttaaagggtttgcttagccgcgagggcacccatgatatttctgttaaagaaaaataatagggggtttgagttgtttgttttggttttgtttttcgtagtaggttagtcggtgggtaacttggaaaatatctttggcaccatgagggggagcactaatgtccaaggtagtggtgtttttatttgcatatagtattagggtgtcaacttggatgggtgtatatcctagtggcataagttggattcagaatgtgccacctttctaaaaagatccttttgtagcttcatttagaaaaagatagattagtactatcatatttattgggtgtgattaatttggaattttttggaatggtaaatattgaaattatcattttacaaggcatatgctaattttaaaatgtcaaatggagtaattatgacttagtgatttgtcaaattataagtatatttagtataaaagtatatactaatatattcatatttcaaagtgttctttatatcatattctaggtgatatacagacttatattagaattttattgatcatattaactttttcctattttgtaacaaatctaagctacaatggaccatataaaaaagtatagagtaaattttgttacaatgattaaactatcacaaaactatagatttaagactgtatatcgcaaaattatatatttagcaataaaattatcacggaactacatattcaagatagagtttcataaaactataaattaagtagtaacttgagtaaaaaaaacttaagttttagtatcaatttaatcacaaaactacaactttatagctccaacatgacggtaatgctagggattaaaactctacaacttatagttttgtgataccttcaatattaaaatttgtagttttcgatacttaaccttaaacctatagtttcatgataaaattatcgctaaatttatagttttgtaatataacatcttaaatctactttccccatcctatagtaagttcattgttgccttttttttccgtttgtctcaaaataagttcactcttgaatagccattgcactaaagtttgtgaaagtagaagataaatttatttatagtagataaagtagggaataattagattgaaatttaataaagtgggagtaatctagtcttttttttattggtatgtctgagataggtgaaaaatgaggttgttttgggacggaggaagcatagttttagatagtttgattaaaatacctataatttgcaaaattaattcaaaaagtataattgcttaataggaacataattctgattataaaagaaatgtactatgtaaggaaaaatcactagaattcccgagggtttctcaagagatgttaaagggcctggttgtcaggccgacagctacttcctccgtttcacaatgtaagactttctagcattattcacattcatttagatgctaatgaatcttgatatatgtatgtgtttagattcattaacatctatatatatatatgtgcaatgctagaaagtgttacattgtaaaatggagggagtattattgtgctaccgttgcatttggatactattggcgccggccgtggtgtagccgcaaaaccaatgattgaacatgtctaatgcaaacataaaattgactatgtaatcattaatactcccaccgttttatattataagactttctagcattgcccatatttatatagatgttaataaatctaaacacaaatatatgtctaaattcattaacatgtatatgaatatagacaatactagaaagtcttataatataaaatggaggaagtaagttattgtgctaggcgtgatattctctaataagtcattatgtactagcgcacgtgatattcctaaatatgagcacatttatgcatagtacgcgaaaaattattttattggtttagcggcgtataacttcaacttaaaaattgtgacaaacacagacccttgtttgtaaagcggaaccacacgaagcttcagaagcaggaaaccacatgagtacatgaccgagtccatggaccttgttcacacaactcgtgggacccttcgcaagtttttttacaatatctagataacctgccaaagccggtcgcagcgccgacttgcctattgtgccggcggttgcattcaatgcgccggacaatgacatgtgggacccacgcagctctaccccaccctgtcagtgacgtgagcgcgctgttcttttttccccgccttcgccgtgccaataatcggagggagggctctgccctttttctaaagctggtcaccgtcagggcagaaagaggcatgccgtcgaggaagagcgatgggccgctgccatgtgggccccacgcgcaagtggggtgtgggcgcgagacgacgcggtagggggggtgggcatggaccgggcctgatgagggtgtgtgcgtgtgtgggtggtgtggctcgtcgtggtcgcggtcggtgcttcacctcgacacggcaaaaaatggtgacgcgcgatgacgtcatgcaaaaggacgaaatggtttttaatacggggttactgccaccagcgtgtatcggctgcaaatacggacaggcaaaatgaatatgatttatactgatttataaacatatagtactcccttttgttatatcaaaattttaatttctaagtttgaaactagctatgtcatgtgtctagatttacagttgaaaatcatttttttctaaacggagtaatagtggatagcctacagggctgcaaagaagattgttactccttttttttttatcttttacacagttggctttttaatctacgatttgatcatttatcttatttaaaatttatgtaatttaagcattacttaatttcttttcatatttgtaagaaatctctatctctactattataaaaactgaagatgtttttgccggtattttggttccgtgtatgagtggtttttaagttcgttcacttttgaaaatacaaattcgtatctgagtcaggttttaagtttgttcgtttttagaaacacagaaggagtcgtataagaaatccctttaagaaaactcgcatgctaacttgaaatgatcggactcctaaccgtagctcataattttctagaaaaatatatatccaagctaattcttacagtgaatttcaccttaaccgtataacaataataagattaaaacaactttcacccgttgcaacgcacgggcattctttttcctagttaatagataaaaatgaaggatatatttaaaagttaactatgttaaaacataaaagtataggtggagtatctcaataattctaggagtattaattgagacatggtatttgtgtaataatttttaatagcaccatctcaggccatccccaaccctacatgtcatctagtgttcatagcattaaatatattgacacataagcaaaattttgatgtgccaagaaaattaatgaggagagaggtaaaaagatgaagaaattatttctcatgcaaggaaccacctcttcacaagtactaagaataaaaacagggggatatagatggataaaagaagagagaagagaggtgattgaataagaatttgatttgaagacaccatctattgaatatatagtagtttctatacatagattctatatcactggtaagtatggaaactacttggcagtgtctggattggagatggcctcacaatggtgaagaacgagtggacgatggggaatgaggaattaggatcgagtgaatgtaaacatctagtgttgttccgttgtatcgcgaatttataaaattaccctatacaatagtagcatagaaagataattttaccttttttaattttgtattgtctattttagtggtatggcaaatcaatataaatctgtggattttatctcggcagtatgtgtcacttgtaaattttatcatacaaaatctctatacttaattaatctaaaaaactaaagtgcttatatttcggatgaagtgagtggcatatttctatccttttacatgtttgcgtggaaaacaccctggaataagaaatgctttgctccctgccgatcgatcatgcctggctggccgcggcagtgtaaatgcatcatgagatccagatctaagcaatctatggatggatggatatgggtagctatctgcccagcattgcaatcgcttatattgccattgattgtgtttgacattgcttgcatgtcaatgaaagcaaatacagtactgcttcctccgtttcgaaatgtttgacgccgttaactttttatcacatgtttaattgtttatcttattcaaaaaatttaagtaattattaattttttcctatcatttgattcattgttaaatatatttttatgtgggcatataaatttacatatctcacaaaagtttttgaataagacgaacagtcaaacatgtgctaaaaagtcaacggtgtcaaacattttaaaacggagggagtatatactatctgcaatacaggcggtagcggcaggcaaacggcgttggtaggccattcatgtggtcggacagtaggttacctgtttccccacgggccactcgttcgcttcctggattgccctgcatctcagggagatgtatatgcaaagtatatactcctataatttttaaaatactttctccgtaaaatacttatcattctaaataattaaataatttagaactataaattaaggtatagtggaagttagggtagaatagagggaatttaaatgggagatgattgatgggaccaacagtacttgaaagtgataaatattttgagctaatttttgaatcctagaaagataatttgtaacagagatagaaatatatttttcaacaattgaccgctcgttttttttctataaaatgaataatactaaaaaggttttcatattattaaattgtatggcatcctaactataagtccagaactttagtttgtcatggtttaaccaattattggtcaaatgtgaaaccataccgttaacattgtccgttacttgaaaacggagggagtattaatttagctagcttacctcagcggcggcagtggcaggtacgtacggcgatgtccgggcgatagactgaccaggcgtaattaattggtgattatatctctagttattatatactccctccttgacgccgttgacttttttaaacatgtttaaccactcgtcttattcaaaaacttttgtgaaatatgtaaaactatatgtatatataaaagtatatttaacaataaatcaaatgatagaaaaagaattaataattacttaaattttttgaataagacgaacagtcaaatatgtttggaaaagtcaacggcgtcaaatatttagatatggagggagtactacgtagtactaagaattaagtacagtgtcatacaagaaattaacgtaagtacgcgtacgcgttaaacaattgagatagagatatgaattgatcgctaggacgatgattgatgattgtctatcactattactgctatattgctcaatttgttccccatttcggttatttgtgatatgtaaacagctggaatttcgattcggttattatactgcaggaatagttgtgcatcgaacattttaagctgcttcggggtatgcttttacgggtttcccctgatcaagtaagcgcatacacctcgcgaatgcatacccaataactaaatttctattaaagacacatattcatgtgcctaattatttgtataaactaggatttaaaccctacatgaaaattactccaccaccacactttggtatgtgtgctcggtatacatttatatgaaaatatgtggtggaaaccacatatgtagtggaaatttagaaactaccgttggatcgaaaaatggacgtccgagattcgtccacatcatcacgagcacagtaaaatttttacttatgagtaaatccgtgagtaaaatttctactcatgatgacgtggatgaatctcggacgtctatttttcaatccaacggtagttttttagtttttactacatacgttttcatatgtttttcatactatgtaaaactcgccaacaatattcacatgtagtagtagtttgaagttgaagctagtactactacggaattaattttttctgaactatgttctcttcaaattgcaaaaatcgctcccccgggatggtttaagggtgacatgtaaaaatatattttcatagacgtccccttaataggcccatctcgaagatacattatcgtaggcgtacattttaagggactgcacgtgaaacggtcaacttggagagcaagtgagcccacacgtcccaccgtatcactctttttttctctttctcatcctaaaccgcatctctttcccttccactcccgtaccctcacctcacctcatctcttccctttctcttctccactcctggcgtctacggtgtacacggcggtctcaggggcaggcgactgagacagaggcagcctcagggacgttggtgagcggatccactgcccccgccctcgagagcggcgccgacgtgcggatccggtagcctcggggtagctccgccgcccctgccctcaggagcggcagtgggagcgagcggccatggtagcagctatgacaacgacgacgacacgacggcagcggtggccactgcgacaacaacgatggcagtggtggttgcaatgacgatgatgaggaggatgagctagtgttttgagagaatggggatataggggttgggctattttttttagggatttttttcgttgaaattatttttttatacagttggcataggtgatagcatgcgcaaatcctgtctttgcatgtggttgggctacccataagaaaaaatattgatttttgcagacacctaggtgtaggcgggccgccaagccgcatatagaaatcggttttgtctgtctgaaaattgatttatgtactaggtaggtcccacttgaccatggtattacaagataactctatgtatcgagatggaaaattaccatatgaagcggtaagagcttccaaaaaataattaataatatacaatcgtgaaccatctttgtttatcacaatgctgttacactattaagaaatatctgttgaggtggaggcaagtcatggagagtagacatagatcttagttacttcctccgtttcacaatataagtcattctagcatttcccacattcatattgatatatgaatgtggaaaatgctagaacgacttacattgtgaaacggagtgagtaatacactttgctttattatttataccattatatattaatatagaataataatagcggtcaaccagaaactaattaaaaatttgtatttatattatgcaattaaaattatttctcaatatatttgctgctactactatctaatatggtcaaccggtcgtctggcactcacacgaatagagggactaagaaactaactaaaaacttattatggccccccgtaaaattttacacactgtcacatcgaatgtttggacatatgtatggagtattaaatatagacaaaaaaaataactaattacacagattgcgtataaattacgagacgaatcttttaagcctaattgcgccatgatttgataatatggtgctacaataaacatttgctaatgattaattaggtttaatgtattcgtctcgcagtttacaggcggattttgtaatttgttttgttattagattatatttaatacttcaaatgtgtgtccgtatatccgatgtgacacgtcaaaactttacatccctatatctaaacacagcctatgtttagggtttccgttatttttatcgtttagggtgatcggcatatctagtcctatatatatatatatatatatatatatatatatatatatatatatatatagtcatgattaaagacccaatagattggttggagcactatctcttgatggaatccaacaacagccagtttgattccaattttagcaattcggctagttaccagcatttacaatttatatgcagtataaaaatggatttccagcaggggcggatatatagtgttagcgtcggtatcagacgacaccgacgactttcagcaaaacttatgattaaactgcttatgatctatattgtttgtagcataatttggctaatagtttattttatttgggtaagccagattatttagtttagctgtcatgatttgaagtggttggtttgagagccgattaaatgtgtgtgcgtggatggctagggaggcttagcatttatcttagaatggaaatattatggattagctgagcttaaccatagtcaaggaaggtttttgcgttatttagtactatttgcattagcatgcagatagagatcagagaggtgaagactcgtgcagctggttgcaagtggaaatttgctatagtcgacaagcttctggccgggctgatgatcacatacatgcaggcgagcagaaatttgccgtgctctcgcttggctgttttgtgcggctgcgtattgcgcgaaggttggatcagtggcgttggtttggagatgatgaggcgtgattagcgcgtacggctgttaggaagataagggcatgtacaatggttgtcaataatggtctcttagcattgctaattaggaatactttgacatggaagaaagagaaataggagagacaaaacatcgttgttatacataacaacggcttaacaacgactcttgatcattataatatggaaatatggttgcacaagggtaaaaaaaatagaaagaatattaataaaaggaatattttttaagttaataattagagtctttgttgtctcaactattgtaaagatacggtctctaaataattttatattgttaagagaccatactcgtctctaccattgaacatgcctagatagattttctattttatcagttagttttcttttcggttggaccatggtatctgtatatgtacaggtctacggtcgattgaaggacccccgaacaaaattatcaatctactattttccttttctatactttcctgttattttctattttgttttcatggttgagttttggtaaccctagaatttagttaatctttaccgttttgcgctgaaaaacggtcgtgcttctccacgaaagcgagaagattatcctttattagtttgctcggaaactagtcgttcatcgtcacgtaagtacgatatttatcctctttgctaatttgcttgtaaattagtcgtgtgatttcacgaaagtgaattaatctcgaaatcggtttcactagcggattttgatcattccattttgacgactctattatttacaccgtaaatcgttaggtgatcttgtgttggccacgaaaaagtgtcaacacatatattataacactataatctaagtataattaatatattctgataccgatatagacattatgatacaaatgaatcaactttatagatcccctcttcgagtgaggaggcaatgatgatggtggcatcgagcagagacggccggtggtggcctatcggatctaacaatagcggtcttgatcgactcgacggtagatgaatccgcaataggggcctcaaacaatgcagcgatgggcgaacctgatgatgacggtggccaagatgttgggcaataatggcagcttcaagcaagtggactagggctgtgtttagttcagcacaaagtttaaatttggttaaaattagaaatgatgtgactgaaaagttatgtgtatatgataggttgatgtgatggaaaaggactgaagtttgaatccaaactctggttctaaacacacctagggtaccagtggccatcacctcctcccctttagtgtggctcgggaattaaggccacagcgatagctttgatctccatgggccatggcgatggctgggcggctgcgctactggcaacgacgtgatagctacgaccagggtttaaccattcaatttcgaagtaaatacagcttctcacaggtttatcgaaatccgaccgaaaaccgataaaatccgatgatttttggtcaacatcatacaaaaccacctaataccgaccggttgatctaacggtttcatgaaagaagtccggtttttgcaaaatttcatcggttttgtgaaacaccggcaacgggcacaacttaattgtagtcagggtcatggtgttcttttttattactattttatccgtactaaaatataagaaattttggttggatgaaatatatcttaggccgagtttagtttcaaactttttcttcaaacttctaactttttcatcacattaaaactttcctacacacacaaacttccaacttttctatcacatcgttctaatttcaaccaaactttcaattttagcatgaactaaatacacccataatacaatttagataggaagactactcggcttcgtaatactaggatgtgactcatccaaccaaaatatcttccattttagtacgatataaggagtacatatcctttcacgtagattgatcggaaactgtgtatattaatttgtactcgtagccattcatatcgacattttgtatagtagtgacatgccatacagtaaccaggtttatagatgaccattttgaactttgatcatcggacgtttaggaggagaaagaaaaagattaggctgtgttctttccgataacggaacgataaattaacacgtgattaattaagtattaacttaaaaaaatttataaaatggattaataagattttgaaaacaactttcctatataaactttttgcaaaatgtgtactgcttagtagtttaaaaagcgtgtacgcgaaaaagatgtggccggttgggaacccatgagaaagaacacagccttgaagatactaaaacgtggcgagtcattagcgtatgattaattaagtattaattatttaaacttgcaaaaatgggttaatattattttaaaacaacttctctctagaatttttttaagaaaatacatcgtttaacaattcagtaaccatgtacgcagacacagctttgtatttctaaaataatgtcaaattttgcatacactttgaatatgccagtgaaagaaaaaagaatctaaacatgggaaacactaataagtaagtacgatactggcttcatggatatatatatatatatatatatatatatatatatatatatatatatatatatataactcgatctactgtggttcaaatcttgacaactgcacacacgcatatatggttttaatagtaatttagcgaacccttttgaaagtaatgtagtgaagttaataaatgcatttattgttaaacgatttgcactcatgggtgaaaacggtagggaaatttccgagatttttagctgccgtttccagtttgcaccgaccgtttcagtcggtatcggtaatcgacggtgatggaaaaggaaacggtaatatctttcagaaatagtagcggaaatgggatggaggtttttctgaccgtttggtcgataatattatttgtacggtaatttccgtcaaaattccgaaacttctccagcggctaagccaacccaacccatcgaaagcccacgaatgaaggaagcttgatagacttgcagcctatgaaaaaggaaagtgaccaaggaaaatgttgtaaaccctatgacgtggcatgtgtattttgctgaactttggtcttttccaattatcgatgttgaagtattgttgaacttgactatattgttcgtcacacttattatcatatcattaatctaacagtgttatgctgagggtgataatgcaagaataaagttaaaatgtgtgctatgccaggctccgctgattccgacatgaattttcgacttccgaccagtatcggtatattctattctgacggtcccgtttccaatataccgatattaccaatatctttttgggtctaccatttcatttccattttcgagaaaaaaatgaaaataaaatcggtatagggattttccgaccgttttcatctcaactcatgggctactgtgaataaggtgtgtgctgatatgcggtaaccagtacagagaaagaaaattctgaaataagcttgtgcaattacccgtttatatgtccaagttcgaatagctactacccatctcaaaatgtaacatgttctattcaaatacattttaaacattttatattttaaaatggaggttgcatatatttgagaggaagggagcagaacaatttcccttctgtaaattatgtgatgccgttgtgtctctttaaaaaaagaactactggagtacccgtgatttggtaggccttcaattctcctgacagcaacatttgctcacaatatttacgttcagtcaaaggctttgaatgggtcccctttcctaggcatattccacagggttaactagatacatgccattaaaaattcaccggttttgaaatataccattactatttgcgtatttggaacgatgccattgatatttgtttgtaatttcagtggtgccactaagacacgtattttgcatgtattggacgaaaatgccctcatcttctacctctctccctcttctctcatcttcaagctctctctccccgctgcttcaactccggcgccgtcaccgccgctgctgctgctcgacgccgctgctgctcgccactcgcgctgctgctcgccgccgctccgcatgctgctgccgccgcaccgccgctgccgctcaccgctgccgtcgctccaccgccgctgccgctcgccgctcgcgccgctgctgccgttgttactcgccgccgctccgccaccgctgccgccgctgccgttgctgccgccgccgctccgccgctgccgctcgctccgccgccgcctgttctctgagctgtggaagaaaggagaggggagaaaaagaagcaaagaagggtaatttggtctaaattttttcgtaaatggtaggtagtggcatatcttgaatatgtgtaaaattgtaatggcatggttccaaatacgtgaatactgatggtatatttcaaaactgataaatttttaatggtatgtatctaattaaccctattccacatcaggcatatccattttggtggcactgtcataatttctcccatcagtgcgacaggccaattactcgcaaacacacaacagcacaatgagagcgaacacagaccaaactgcaatttgatatatgtttgggctccacatttaagtcttttttacttgagcatgggcatcatctcagtcagatggttttcattgcttaggtggtgtttgatctatgactaaatttaatttagttcccgtcgaattggatatttgacgctaattagaagtattaaatatagactaataataaaactaattatataaataagagctaacttgtgagataaaatttttaagcctaattaatccataattaacatatgtttactgtagcataacataggttaattatagattaattaggctcaatagatttgtctcgtgaattagtccaggttatagaatggattttttatcattagtttacgtttaatacttctaattagtatcaaacatccgatataacaggatctaaaatttaatccttgatctaaacatggccttaaagccacgcaaatactttagcatgggcattgcgaacaactacgcatatcaggtatctacacgataggtttatccgactaccttatatgaccctataagataggactacatataaaatggtatgtaaaattgtctgtattttactagtagttgctaatagtagttggttttttagggactgagagtataccacaactcgattatcatatatcataatacacttaacgaatacaaatcctcaaataacaattgggtattacctctcatcggaagggtttggttctgtctaaatttttgttctagcaatccatttacttttagatctagttcactgtccctttaatacttaccgatatagaacatcaacaggcatccattaatatcttcgaatttattttctgaaatgctttcctattattgtgccccagctcagctcttgtttttgaaatttagtgacaccaaacctcaattttcccacaagttccaccgtccttctgacatttctatatgacccttgtctccttcctttgaaaggtcattattcccttgttacaagcagtcagtttctgagaaattaaagtaggcccttgtttagttctaattttttttttcaaacttccaacttttctatcacattaaaactttcctacacacataaatttcaaacttttccatcacatcgttccaatttaaccaaactttcaattttagcgtgatctagacacacccctagatcatgtagttcggcctcattaacatcggtgaagctcatcatcttgtctggagcccatcgtttccatcggttcctgtatataggagtactatatatagatccgtctcaatcgctactatagatcaacggtgtcaattttagatgttgcttcaagctacattctcgctacttcatcatgaatgagtttagatactccctccgtcccacaatataagggattttgcccttgtcctataatataagggattttagtgtcctacttatcacatccatcaattccaattcaaaattttacccattttaaccctcaactacgcactcacctataagcaaatatcatttaacagggacattctagtattgtcttgctatccttaaacttatccaaaagggaataatccctcatattatgggatggagagggagtatatcaatcgtgctgatggccgtaccataaaaatacaagcaaccgtcaacatcgatcatgtcgacgtttgatatcgcaagtacggtatttggggatcgttggtaccagggtatatgcgagattgaggtaaaagagatggagacaggggtttttatataggttcgggccccatatcttacaggtaatagccctatatcctgttggccgaagccggtgttgctctttattcatctggatcacacaaatacaatatctgggataacctagctaactgtcgtcgacttggcggctagataaccaactcgtagtcgacggcagggtggtcttcctcctcgaatacgaactcggcgagatcagagataacgctagatccctcttgccggcctccgtaggtgccggatggggtatggctaggctaatttctgatgtcgagatctgacggcgtattggtttgtgttggcttgtggctttgtggcgtctatggtgggtgtgtcctctctcctcctagggggcttgtatttatacccgtagatgccttcttgtctaagtaagactaaggagataaatataagtacaatccgagtagtcattgtcgttttcatatagaactcttcttatccttccttatccgaaactccttttatatatgatgtttgtttccgtataagtcatggtatgtggtgggtcctgccgagtttagtcaactactattaggtatgtggtatccataaccctgacagatcaattaatccaacatgtaaaagcactagggataattctatttcttgttccttaaatccggaaatggtttaatttaatatcgtgcctcaattaactcatttaaatcggacaaaacttttctcttcttttttcgtgtcatttggcaaatgaccacatggcgtccatatgggatccaagttgaccgtagagctagctttctataaaacgatttgacttgattatagaaaaaactaaatcccctttattgtaatttttctatctctctctatttccctccattataattaagcgagtgccagtgtgccaccttccacactgtgtaaactccacgtatatagtactctctccgtttcacaatgtaagtcattctagcattttccacattcattttgatgtgctataatgactttaattgtgaaacggaggaagtaggtcaaaaccacaattgaacgaatggaggggcatatttatctgatttgaaagctaaaagatgacacaattagacattggcaagagttaatggacgtatcatctagacgactagactaaaatttgttctcctcttaattatgtttgttcctcaaaacaagtttaaaagtacgtacttcctgttaattgctcgttcattttaattttcatctcttccgtatcatccgaaaatcatatatacaatcttttttatctctatagtgggacgggtctaatatttacctggtagtgaaaatcatctttagtaccggcgcttataacagcttagatatttgcgttttgaaccgttcgacgaaatatcaattctccccgtagtgttatcgattcaaatcatacgcacaaccagtcaacacgataatttgacgcaataataagctacaattatgcacgccgttccatcctagctgtagcttgcatccatgagcgcatggcggcctttcatggaaacggaagggcaagcaaacaagcaaagccggtaacatgccctgacgtaccgtacatcatattgcacacaacgtgaccggcgtgcaggggacccacgcacggaaaaaaggcacacgccaattggctctctcgttaagccgaccatccactctgcgtgtgccagcgacgtaccctagtgccccgtcctatctatctgtaaattaggttatgtgaaaaagctagtactgctcctagctgcaccagtttgattttggtcctttttccttgctagtgttattgcccctttatccttaaaaaaaacttaggatccgattagacattttctaatataaggtatctacacagaaaatatcttatctagtaataagttcttatattttaagatagatgaagtaataaattacaactgtaacgttggagaaataaattatatatatatatatatatatatatatatatatatatatatatatatatatatataagacttaaatgcctctcgttaaacgagtggtggctaggggtaagatgatggtggttgtttgtttttttttctcgtcgtctctataacatgaataagaatgtttttgtatttttttcgtgctagatgatagatggctgctactgcgcaatgtcgagcccatctcaccacgctgctacatcattccatgattccatcgttgactaccgctcgccacccaattgccctctccactaccagtcacaagacatagaacaaccgctctatccttatagcaaaatccagcaaagccaccaagatccaaatttcatgatggatttttggctgaatcatttttttattttctagtttgatttacctgcgagtaattttatcacttgtgtgtgattgagcctgtaattttttcattcgtacggccattttgtgatatagattaacaatactcttagtataagtttttactcttatattgtgtattgaaaacatcagtaaacatattactaaatggtggctatgagatcatgggctatatcgagagaaatgtggtaattgttttactcgcagatcacaaagtctcagtttttactcttatattgtgtattgaacacatcagtaaacatattactacatggtggctatgagatcatgggctatatcgagaggaaggtgtaattattttactcgcagactatgaaatgtaaacaatatttataacactagtaaaagaattactagcattgtaagctagtagtaattcttttacgaccatctaggagtgtcgtataatgttggggtatttatgcaagtaaatttgttacttttgaagggggcattcatgcgagtaaatttgttacttttgaatgagcagatgtgggaggctaggagtaaatggaaaacttaacggagtaaattcgttacttttgaaacgtgagacactagaaaaatggaaaactcggaaagaaaaactagacggtaaatatttttctaaaacgcaaaaactgaaaaactggagagaaggaaaaaaaaggaaaaatctggatggttaatattttactgggccctttgatgaagcatggataagatggaaaagtgaaaagaagtatggaaggtgatgtggtaaaaaatgaaaaaaaaatgaactaggaaaggtgggataagaagtaaacgtggggtagtaaaaaaaggaaaaactagaaggagggagcgttatgcggcactcgaactaatattctgcgcgcaacgtgtggattagcgctaccactaaaatataaacacttttatcactatttacagtcatgtctgtcatccatcaatcacattctatttaagtttcttttcatatcttggatttccctccaaccccaaccatctttcaaaacgagatactccctatatcccacaatataagttattttgggtggatgtgacacatcctaatacaatgaatctagacagacgttttgtccagattcattttactaggatgtgtcacaaccatccaaaatcccccctccatctcataatataaggcgtgagcgtatttcaagattcaaactttaaaacatttgaccaacatatatttaatgtaatatgaaataaattttatttgttaaaaattatatcattaggttgacatttaaatttactttcatatgattataattttgttgctacaaaccttatagcatatgagaaattataagttaaagattagttttggagactgcgtaacttttaccatgtcttatattatgggatggagtattatattgtgggatggagggagtaccaaagtataaatctaaacacttttaatgataaaataaattaaaacaaataatattaatgtaattttgttaaataaaacgaacgatcaaatttcatagttaaagtcaaccgcgccgaatatgtatgactggataggtgtagtttttccgtaggccggctgatgtttatccatgagcacattattaaccgttgatttttgctttttcttaaaaaagatttctctccttcattgcacttaacatgctcaattgcattgctgacatagcaacatgcttttcaataggtgtaatttttaccaatccaagagtcgctttaattctttcactcagattttgcaccggccatgacggccttttctcagctgggataagtacataattcgactgagaaattatgggtcagacaagcagctttctctctagttcgatcatgtcttgaggtcggcacaacatcttttgtctccttaaatgccggcatgcagattgttttcttgagcataggctttttgtttagagaaaatcggtgtccaggttatttcaactgcatcaggatttctctatctcaggatcagacgatcagtcatcgtggtgtaatttaatttcctcgtaagcttttcattgatccatccctgacagattactaaattcacgaactgaggaataacttccctttaaaaattttccttgtgataccactgagacatatactaaggtagtcaaatttttttttctaaagtgtagctattttttcaactatcctattttctcaaccaattacaaccttcttccatttaatttctctgcctacattcttttgttaaccaatcacattccaccactcaatttcatatactttttaaattcccgtaaaatatctaaaagtacttacattttaggactgggtgagtaataaataagctgaacaatatatatacgtgccatatagactaaagggcccggttgcgttttgtagagtttcaactcttaaatttaactcctgtggttagatacttagatctagagtgaaattgtgaagcagcctaaacacagatccatttctctagtttattatatgagaacactccagctatcttcactccctttttaagtggagctaaaaccgcttgattaggctttagctaatagaaaggtggagttggagctagatccgtgtttgggatggagttggagttggatccatgccaaacagtccctttatattgaggagggaaagaagggaggagatcaactccatatgtacgattgttatttggccaagatatcacgtaccatgctccgtatcaagatatattaagttctaatctttgaatggttatcgaggagagtggtattttttttaatcttctggggatagttacgatgttattacattatataatagtattgtaacttatgtctatgtctatgttactgatagaaaaaaagaaccctttgctcggttggctagtagcgtacatgaggtcgctaggtcgaatccttgcatgagcgagctaccattttggctgcaaaaatgcagatctaatagtatacaaatggaaggtttcctttcagaaaatctagcaaaaccattttcttgttcgatcttctattcccaagaaccgaagaaactaagtaatagaagtaggagtaagtccacttgaagtccctcaactttacgtcgagtttgattgatatccctaatcctaaaatcagaaattttcattcttaaactgtacaaaaaaaaaagcatacaacttggtctcacggcagtacataccctattcccccctttattttctcttacatggcatatgtttgggcccacttgtcagtactttgagtcacccgtgctcgtgtttgttctctcttgtccccatttgctgcgatgagccggaccgtcactcttgagccagaccagtcatggagctaggccgcatgcttcggctcgttgtgccgctggtttgtcactcccgtagagttctttttccgcaactgacttgtttctcttcatgtgcgacccgacaaagccgcatccgtgcctcgaggttggagcacaaggccaccataccaccaccacaccgctagtagcgagatggagctggcaagaagagaccccaacagcagacggactagtggtggcaggtacagcgtcgagcagtcgtcatcgccgtcgctgctgcaccacaacgaccccatcgggaacccggaggcctccttcatcccaccacaagcacggaccaagagacgcgccaccgccccctacaccggctcgccgtaccaccgccacactacttatggcgagacgacaccggcaagaagaggccccaatagcggatagaccagcggatgcgggtgcaacatcgaatagtcatcgtcgccgtctgaggaccaactactctgagagcggcaacagctaaggcgggctcgtcgcgcgcggcaacaaaacagtgattgcgctagcaagcttcatgaccatcaatggcagccgacaagggggtcagcggaggctagggccagaggcagtcgttctccatgcactggcagtaggaggtccccgagccattgccgtcatgtccgactaccgcaaatgccgcagggctgcagccagtcgccttgccggcgtggtgaccaaatcagcggtaaaagctgtggcagaagaggatcgacgggagaagaagaggagttcgccgtggaccagtgctgctgctgtctcctcctacgaacgggctcaccggccactgccactcccttggaagaggagatgaggggaagagaggagagtagagttggccacttacatgtgggccctatatgtttttttaaaaaaattttattcttgctgactagaatgcgtaaaaccatctatccatactgccatgtgatctaattttacctggttttacaagtcggagggtcaagattcccggtattgacgttcagggattttatttaaacttgacggacgtgaagtggacttgttccttcaaagtacccccacattagttcacctaaagcccaaatcttccaggccatcgaactacctgcccacccaatgtcaggcaccaaaccaggcccagtcaccaatcaccatgcgccaccgcccactgctcttgtcccgcgtcgctggcttgtggttccacaccagtacaccatcgccttggcaatttggcattgatctcctctccagtctccatgactccagaggctcttgggcttgccaacagcgaggtcagaaaaactgaaaaacctccaccccctatcttgatctggtgtcttgcgatccgtatgatgatttttctaatccgtcgttgcgtgtttgaatttcactgtgagttgttgccaggtttgttttgtaaaaccgtaaaccaaaccgaaacaaaagcaccgtttattcggtgctgtttgtattttcctgaagagtatttctattggcaattttagaaaatcgaaattatgaaaacccaagaaaccaaacagaattatccgtataaaccgtatggccacccctacatcattttttatttttacaatcgccctctaagatgaaaacctaaatgtggtatttttttaaaaatacggtacaaacactggtgctatacatgcatattcaccctgttaacgtgcacatatacgctctatttctatgagtatcttagaaacactggaccgttatatgtttatccttataaacacgttcgaaagactgggccggcatattttgagagtgacaaaattaccacgataactccataagacaggtaagttgtttaacactaaaagaataattagacataatgcgagcatgtttaggacttaaatccggataagctgattcaccccaaagaaactaatcggttaagctcggttgcgttggttttaagaggacttaatagagccctatagctgaaaaaccaaacagtggtgggaagaagggataaaaaaaatgctagtatgccactagtaaaaaacggtttttacatacggtccaaaaggggttcacgcatgcggtatggctaaccgcacacaccaaatggtatgcgaaaatcgctacttttacgtgtgggtggtgcacctatatgtgaaaatcagattttcgtgtacgggcgcataagctgcccgcacggaaaaatggaaaatctcaaaaagaaaaataaaaattccaataaaaaaactaaccctaactctagtcggccgccgccgtcgtcgtcgccagcggatccgcctctcccatcttcgctgccggcggatccacacctctcgtcatcgccggtggccgatcacggtgtgtggaggccggatccacaccaccgccaaatttgcgcggaggaggatgggggagactcgccgccagcctcccactcgagtccgccaccactgtcactatcttccaagcccgccattgatcccgcgccctccgccgccggagagggccaccatgcgcgggggagcatggaggaggccgtcgggaggagcggggagaggaagagtgggtgagggtgggaagaggagaggagcgggtgaggccgggcgagagagagagagagggggggaggagagaataaaaaaaatagtgggaagaggaggggtatttttgcatgtgggtgagttaagagccctatgtgcgaaaatatccttatttttacatgtggacgttataagtggttcatttgaaaaattaatttttgtgtgtgggtattataaagagccgtatacgaaaattgtagacgcggacacttatagcctatttttaacctattagggtgtttgtccataaattttattttactagtgtgccattgccatgtagaactcgtgttctacattgatttgtagaagaggtggctggtgaacgagaatttctcttaaaaagaaaatgaaaaagacataaatgtaacacaactgcacaatgcctccgtggtgcacaccaaatccaaagccctgcacacccacagacctgcagtatcagtaactgtgcgatggaaaccgagggcggaagcggcatgacacgcgctaggattagcaaactgaaaaacaacaaaaaaaacacagtttattccgcacgctctgaacccaattttaataagataatcaagcaaatctcggacattcggtaacacgtataccctggtgccagcgtactaataatcccaaaataccgtgatcggatcaaacccatcgacaatttctaccattcaaatatctactattataaaaatcaaaaatatttttgttagtattttggtacgtcatctatattttgatgtttgagttagttttaagtccgttcgcttttgaaaatacatatccgtgtttgagtcggattttaaattcatttgcttttagaaatatgaaataagtcatataaaaaatctttttttaaaaaacttgcatactaacttgagataaaaatcagactcctaactgcagctcgtgattatcttaaaaaaaatatccaagcgaattcccacagtaaatttcaccatagctaaactgtataacaataataagattaaaataacattcacccgttgcaatgcacggacatcttttcaagttttgtaaaataaatatctgtctttctagttagtagtcacgaaggaacccaacaaatttaaatatgggatatattgcctcctagcctcccatttttccatcccaatctcaaacttcttttgaatcaagtttaggtatgaaatgtgtgcgtgcagtgtgatctcattaaatataactattgtggtcatttgtgtatgctgctaatctgtctctaatttaattttattataggacggatgttgcagttaattaagtgtagtggccccgtccaaacttgggtctttgttgctgggcattatttgcttgcaagctcgcaacacatatacaggtatacaacacgctaacccatcagttgtagggaaaatatggacgtatgagagtagttcacgtcattatgagtaaaaattttactcgtatatttactcatgagtaaaagttttacttggtgatgtagacgaatctcaaacgtccattttacaatccaacggtagtttttaggtttccactatatatgtgatttgcactatattttccctcagtggtatagcacagtaggcaacgacattccagcttctccaagccaatcagcaagcggcagcatcggcgcatcccagccttcgtaggtgggcagcagcaaattgctcagttcgggttacgacacaacaaaaaattgggtgcccaagttttttaaaaaatcggtcgtactagaaaaaaaatattttaccactagataaaaaatgtttcaccttgttaaaatgctgaaacacattcaaatcatcactaaaatatttcattcacaccggagggggagagggaagtgatacaaaggagaaagagatacaaaggagaaagattagggagggaacagtgatgggtgcaaaatgaatggttgagagggcccaatatgtttcttatccgccgggcccccatgagagagaatttttacaaatcgaaacaactacatatcaggcgtttccctaaaaatcgggtgttgtttcactgctattagaaaagtgtttcacctttgttaaaatgctaaaacacattcaaattatgactgaaacatttcattcacaccggtgaagcatcaacagattcgtttgcatcaaggagctagttaagaaacacctctaatagagaaatgtttcgacaataagataaaaatgtttcaatatattaaaatgatgaaacaaagttagatcaaagattgaaatattttgttcttcacaaatgaagcatcaagcttcaaaaactgaaacatctatggatatgcaagaactgaagacaaaaaagtgaaacaatatcaaagtatcccatgcaacattttgatctaaccccaagaacatcaagatgcattagctgaaacatcgaaaaatcacaaattttgccattttagatctagcttattcctcctctccagtgaccaccggtttcttcagtctcatttgcaaatccaagctagggcaccatgggcccttctatctccaccaaagctgttgaccatcaccccgtcattgccagtcctagccctcagctatgtcgttgttgctactcgggcaaacggaagctgcctcagctccagattacggggggcctgtcatcttcctccaagctccccggccttaagctatgttgcgagacctagtcggtgagccacacgggaggacgtccccactgcttgtggcagccaccatgtctgccgctccacaagaaccttagtgggagagggagagaggagcgatacaaaggagaaaaagtagggaggggaaaagtcacgggtgtgaaatgagtggttgagaagacctgatatgtttcttctccgcaggacgtccaagagagagagagcgtttccgcaaaaattagacattctaaaaagtaattaggaaaacaattaatttttaaacgactctttgcggtcgccattccttcgagatgaacgaggctcaccaccttaggaaggggaagtttaggtcatttaattctcagggcttgattatgtgtcgatatttcctattctgcatttagttactgaagatccagaacattatattaccagacttaacacttcttgggcgcatttttaatcaacattatttattgggtccatgattctcacgagcacttctgaagttatgatcgatcatgagatgctttgatgattgtgcagagaagatttgatcgagtgactgatttttagactacattaatagcttaactgatcaagaactaaatatgaaaaatatgttctatgatttgatcgatcgatctcgagttatacgttatgacatgtaaactccagagaaaattgggatcaggatatgaaatctagtattagatattatttaattacatactctagtatgaaaactatcgtgcaaatcgggatactcttgagctggccaggatatttttcctgtaatgcaaaaataattacgaattacagatcaatgacgtgcgcccgtgcagatgcaatggaaatatatatcggccacgttgccacttcttctaatataataaggcaatgtcgttgcctactatgcacgatgtgagctaatcacacgaagtggacaacaagttcgtcatgtgatttgttgtctttctcctttgtgtgtcgaatgacagatctcacaattatccaaaaaattttacaaaaaagcatttcactgagctttgtgcgtactccctccgtcccacaatataagagattttgagtttttgattacaacgtttaaccactcgtcttattcaaatttttttgcaaatataaaaaacgaaaattgtgcttaaagtacggtagataataaagtaagttacaaataaaataaataataatttcaaaattttttgaataagacgagtggtcaaatgttgcaaacaaaaaatcaaaatcccttatattatgggacggagggagtaatagataagccaacatatcgatattacattcgtcttcctaaataaaactaacatttatatttggttgtgaatttttttaatattaaatttggaccatgatatacttttgcacatttccattaaaatttttagtaagataaatgatcatatattacgttaaaaatcatcaccatcaaatatttaaaaactgagagagtagtttggaacacatgtttaagttacagttcatttaaacttgaaatgttggctattattattgatcccgcatcaaaaatcaaaggcgtgatgccacattttagattatccaatttacagtacattgctgatacaaccgtttttatggaccgccacttcgaaaaagcaaatactccatccgtcccaaaatataagtatttttagcacagtgccaagtcaattattttcaaatttgactattaatagcaaaaaaataaaaaaaaagattaatcatgtaaaattgatgttactagatttatcattaatcaaagtattacaatatgcaactctttttatttaaaacattttatatttatagatattgttggtcaaagtagcatctcgaagactttgtcggagtccaaaagctcatagtttgggacggagggagtaatacttatctcaatctctagaaacttatcaggactaaaaaaatcaattttcaaataagtaatgttttttttttgtttcggtaaagcaaagcaaatactggacccatggttttaaggctagctattcactcaatgattcttgccgataaaattcatcacaacaaaacaaattagagtctggaggtatagatttgttgagaaaaaaggaccgtgaataaagtattagacctaattaagtatatacatatgcaacatgtaatatacctacatgtattgaattcagacaacttttgagtatgtacttcaatacccaggagcctccctgtgcccaccccggaagcaagcaaacaaggaagaacaataccaacagcattttgcatgtaaaatgggtagatatgttagcattcctaaacatttctgtaaactctataattcaaatggccaggaagaccaagagcattttgactgtaagatggacagatatgttggcattcttacactacccattttctataactcaaactagaaatgggtcgaggccagttctgaattataaaattagtacaaaaactaaaataactaaaatatatatttctccaaaaacgatttggaaaaatcatacataaatttaattatgataaattgtgatttgttcagatttaagcatgacattgtgcttgtaagttatatgatattatatggagcatgtgatgattttttaggttttcttttaagtcatttactaatgcaaacatagttggggtctagcttgggccaggttgtcaaaaaactagtataaagccacacagccagaagctaaaatttccatccataaacacatcagactgccatctccctcaactagttgcaaaatcacacgtcttctacttccatcagccatgcctggagcagctactgccgcagttgttgacagccgccagtgcaaacagcacgcggaaggccctgctgcggtcctcgccatcggcactgcaaaccccacaaatatcgtctatcaagatgggtttgccgactactacttcggtctaaccaagagcgagcatcttaccgagctgaaggacaaaatgaagagaatatgtaagcacatcgatccttccacttcaatcgttgcactgttcatcattatcatcagttattttctgtcttgttatggaaaatgcttgcataatatcctatatttttgttttgtaaatattcggcaacttaattgaagtgtctcctgttattcttataacctcatagtgctatgaactaattgtaaaagatgttggtatttccttttcaggtcatagatcaggaatagagaaacgctacatccaccttgatgaaaagctcatccgtgagcacccggagatcatcgacaaacacatgccttcccttgaaaatcgcgtagacatcgttaccactgagatcccgaagctcgcggagtctgctgcacgaaaggccatcgccgagtggggccgtccggccactgacattacccacctcattttcagcacctactctgggtgcagtgctcctagtgctgacctcaagctagcatcactacttggcctcaacccttctgtctctcgcaccatccttagcctccacggttgctctggaggtggtagggccctccaacttgccaaggagcttgccgagaacaatcgcgatgcacgcgttctcatagcctgcgccgagttgacgctgatatgcttctcaaacccagatgaaagcaaaatcgtcggccatggactatttggggatggtgccggagcaatcattgtcggcgctgacccattggtcgatggagagcgcccgctgtttgagatggtccttgcctcgcaaacaacgataccaggtactgagcatgcacttggcatgcagaccacctgcagcggcatagatttccacctctctatccaggtgccaatgctgatcaaggacaacatccggcagtgcttgctcgacacattccgatcggttggaaacatgaatcctaattggaatgacctcttttgggcggtgcaccctggtggccgtgcgatccttgacaacatagaaggcgagcttcagctgcagccaacaaagcttgcagcaagccgccatgtgctgagcgagtacgggaatatgagtggcacgacgattgcgttcgttctggatgacttgcgtcgccgtcaggagaaggagggagatgagcatgaacaacctgagtggggagtaatgctagcctttggaccgggtatcacaatagaggcaatggtgctgcgtaacccgctctcttgaagtcttgtggaaaattaattgccactatcttatgcttctctggtatcttattacggtatatggcaataaattaatgcatgacactatatcaattgtccatgcttaagtgggattatgacctaccagtgatgtattgatgttgtggaattcctaccgaatgtttgtgaagatatttgagttgtcaactactcaactctagtatatgttgtaattaaactctttattgctttaatatgctctttgattgttaagttttctggatttgtaaaaaaatgtaataccatgtgtatatttaaaacaccatattgtttatatggtttgcttcaatccgagttttgatcaattgagatgtatttttaaagagaacacttcgaaagtgcatccaggccttaattattttggtggttaataattacagttctaaattattaaagagtaaattgcattagctgtacatgaacttgacaggtaggtgcaatttagtatatgaacttgtaaaatgctcgttttggtgcataaacttgtctgatacatgcaaactaaggctaaaatggcatgacaagaccgatttttctatgttgaacattataaattataaattagtagatgacgtgcatgcacatagtagaaaggttatatttataaacttagtttccactttatctttctttgtttctatcctttacatcattactcagttttttatttttttatgcaatcattatgccttattatgtgtttatccttcttcgatacatatttacatagagtttaaatcaacaacaaaatcaacaagattaaccttgccatgcgattttgaccttgttcgcatgcaccaaacaagtttgtgcacccaaacgagtgttctacaagttcttgtacaagattgcacccacctaacaattcgtgtaccgctgatgcaatttactcattattaaactagcgacggaactaaaataaatatttctccaaaaatgaattggacaaattagaacttccataaattttgttttctcattaaaatgtgattttttttatatttaagcatgatattatgtttgtaagttatatttgaacttccataaatttagttttctacatgatcattgtattgcttgagatagaaatagaagaaaaatatattcaattgtgtgctagatatcgtgactctaatgatatggcttgttatgttgttcttactacacaagttgataatgatactgttgaaccatgttctaattctaaagccatctcatgtgaaaattcttctaagtggttgactgctataagtgaagaaattgagagtcttcataaaaatcatacatgggatttggaaaagctttccaaattcttcgaagtgcaaatggattgataagaaggattgtatttctagagttaaatctgcaagacttcaatgaggtattaacttcattgatgttttgaccaaagggaaggtattaacttcaatgaagtttttttatctgttgtacgccacttctccattcgggtgatgattgcttttgttgctttatttgacttggaattagagcaacttggtgttaaaactttcttacatgttgatttagaagagaagatttttatgatacaacctgaaggttttgctattctaggaaaaaaacatttaatttgtcatttgaagaaatctctttatggtcttaaacaagctcctagggagtggtataaaataatggattcttttatgattgcacaacaatattcatgaagcaattatgataattgtgtttacttaatgaaatttccccatggatctttcatttatttgttgttttatgctgatgatatgctcattgcttcttatgagaagtcaccgattaatcagtgtaaggctcaatttagatatgaattggagatgaaagatcttggtctcacaaagaaaattattggcacgaaaattcagcatgactgcaaggctggtaattatttccatatcagaaaagatacaggtataagatagttgactaatttaatctgcgtaattgcaagcttgtttctacaccttttgtttcacattataaattatcttcaagccagtgttctattaatgaagatgacaaagattacaaatcgcatgttccatatgccagtgctgttggcaatcttatgcatggtatgatttccatttgcgcagatttagctcatgaagttagtgtggttagcacattcatgcataatcctggcaaagaacattgaaatgttgttaagtggattcttcgttatttaaaaggtacttctaattttggcttaatgtttgatatgaataaggtgaagatagatgatgttgtttggtttgttcttaataaaaggtctatttccggatattctctttgtgtggttctgctgtaagttggaaagcttcaattcagtctgttactgctctttccaccatagaagcagaatatatttctactactgaaggtgtctaggaagctatttggttgtgaggtcttattcctgaagttggtattcagtaggatgttaatattgtttattatgatagacagggtgctatttgtttgaccaagaatcatatgtttcatgccaagaccaagcacattgatattaagcaccattttattcgtgatattgttgctcaagggcaagtttttatgaggaagatacatactgatgacaatcccgtagatatgcttacaaagttactctcagtaactaagttcaattattgcctatacttagtaggtatttgtggtacttagcagcccttcagggttttggagacattttcttctacaacatatcctatatacctatacaaatcatccccaccactagaaattctctgcttcctggtgcttccacgtcatcattttttcctcatcattttttcctaaccgttggatctaatctaattgatccacaccccatcccggcatcccgcatccgcgtacgtcttccttcccccgcgtctcgctccgccggccccaccgcattgctactctctcacgcgagcgcacccacatcggctccctctcccgcatctctctccgccgcccccactgcatctccctcccagcgattccttgcccaatcactcctccctgtctccttggctcggccccgcctcccttggactcccgcagctgccatggaatccaaatcgatccactacgatgcagtgtctttatcacttttcatccccacggcacaccatgcagtgtcattgtgtcgcttcttctcctaacccctgcaacaaatcgatggggccatggtggcgactcgagttcggcctagcgcggcgcggctcagggatttgggtcgcttcttttctttcatccgccgtaaaagccacctggaagacgaactgcgaggaaaaaaccgtcaccaccatcaataatgggcttaattccatttattccctccctacaattcatcctccgtttagatgaacctcaagcaccatcccctccagctcagaaggcagcgtcaacagtcgggaaatcctctttctgtattttcatattttgctaatttcaatttgtgcttgcctgcaacgcagggggttccgggctactggtctctcttgcctcgcctctttggagtaggttacagcatcgacgattggacggcataattaacgaagcaagagacgagcaggtggtggagagcggaggaggcatgcatgctatggtcgatgggcttcttgcgcgagacagacgaagcaaagtgcgaggtatgaagcgggttttctttgctacgctcttacggctattgaagcttaggcaaacttagcaggctttcaacgaaattatgactatcagacagtcaggctgtaaaatatatatattctcttttgccctacactcctactgtacaacacacatccttctccacatcgattatgtttggattttactattggtaaggtaagcaacccaacatatcgatctactgagggatagcaaaccgtaaagataatcaaactatgttttcattaaacatgcgcttggcattttgccttgctgtaggtttctgtcatttgattttctactgtattgacacctgaaatgtgctgctctccttctttcaggtcatgttactaccgtgcaaacaactactttgttgcctaaataggtgtgttttctttttttggataaatatagcattcatatatttctatgtgaagttaattagttttattcaactaaaataggatagctaaatgtacattcaaagagatcatcatggttgtctctgaaggtagagagaatcccttatatgccactctaaattaaccagctcccttatatgccacttcaaattggcttctctcttttatgccaccggttcaagtttctcctcccttttatgccattgccgtcagtccaccgtcagttgaccgttaacttcattgtaaaaagacgcatttgccctttagaattagtatacaaccaataataggtattttagtactaatatagctactagatacaacatatgaaaattgatttttttctgcatcacatgcaattttagccattaccatcacaaataaattttcaatgtaagcatgaaacatgcagttttccaataatatttttaatataaagagcatttttcactgattctgacaaaattttcttcactcaaaaaggatttaaaataaattagttatgaatttttgaagtttacacattttttagttgagagggcatattggtcatttacgaaaaaaactaacctttgactaacagtcaactaacactatagtggtgggagtggcataaaatgttggaaaaacttgaactagtggtatataagggggaagccaatttttagtggcatacaagggaactggtcaaattctagtggcatataagggattctctccaaaaaagaaggtaactcgaacaattttttattctagttatcgatttactttcgctgagcattgtgaatccatccctctttgttgcaccattttgttttgtagctaggtgcttttacataatcaaccatgccaggatgtatacatgtgtgttttgcttcctttcttctttcttttagttaacaatcttatgttacattcctagaaattattttgtcatttagaaagttctgctgcaacgcgcagggtatcatctagtttatagggtttttgagtcaaggaaaggttgttggataatgactcaaatatatttagtcctagggtcttgttcaatatgtgtctaaatatatgggccacccttctacatgtaaccctgaaccatcatagttgattttgtcttctatggttattttctctctatattagagggatgttttcacataaaattatgtatctcttttgcatctattttccctatcaataacattggagcgattggagaggataatggtgtggagatgtatatgaatcgaactaggacatttaattatttgccacttttaagatgtgccaattaatgatttgccactcgctgtgtatgatgtgtgggccctcatgtatctatctcatgtgtctatgatatgttggtcaagtggcaaatcctatataaccactcgtaagagtggaaaatatttaattattttgaatccaccgagcataattccacgaacaagagtaaaattccaattttcatttgcttggtaaatcaactaatatgcaagaggataaattggacaaagtggctgaactaaaagaaggataggaggataagaaaagggagagggagtggacgtggtgtgggtggagggtgcgatgcagtgcagtacaaagggcgatgtgatgtggtgtgcatggttgatcacccgattgagatccaatggctaggataaaatgaggtgacgtggaagcacgagaaagtagaaagttgctattaactacactaagtgcgaatgacttgtatacccgcatatcatctcccatcaacttaatttttctccatgcgttttataggttgtattacaaatccatcaaacttatgcatgctgatctataacaaaaagacaaaatttgctacaggacattgaaaaaccatggcctttgctgagggatatcgtaagaacatgaatttgcttagggacactcaaaaaatgtggtaatttattggtagacaacatacacattattttatgactttttgctattttggagggagaattttcacaacatgggagatttgcccctaggaccaattagtacaaagagttttgttttctttacaaatcaagtccctggtgctttgatggagtggagcccgtgtgtcattgtctcgaggagggagagagcagtagctgaggcagagccttgccggctggcactccttcacggcgacgctgacagtgaatggcagctccttggacgatgcggccaaatagagaaagatgtgcaggcttcttgcgaacccgacggtggtcgtcttttagccggaggtggccagaattgacgacggtgctagtccggtcgagccaaggagcttatagttcgatgctaccaagatgtttgtagagacgtagagacgctacattcatgaggaattgagagacggaatcgaagatggcagcggttggccagagtttgggaagacgatgacgatctcatgattcacgacatctcatgtcaattgcttgggtcggagggctcctagggtctcggcgatgacgatggcgcgatggatggcccgaccatgcgccatggtgcccagaatgtggagatggtcttgactgtgacacagagagctcgctccggagtcacgtcggcatgacggctttcttgtcgatccgctgcatgacagagggtgaggtcaaaagttaaaacattcgacatgatgaggtgaataaggaacagggaagagatgatggagagcacggcttgacgactagcggcaacacctccttctgggcggccgacttgggaagaagaaatacgagggtaaaatagacaatttacgtggtttctccctcctcacataagtaaatattatattttaatgcttattgtgtcctttagcaaattaccgtgttttatgagtattctcggacaaattcacgttcttacgatgtccctcagcaaatatcacatttttggagtgttctgtcgtaaatttttcctaactaaaatatatccgctttcatctccaacgtttttgtataagtatttttactgcatgtatttttgtgagggttatattaataacacagtatgaactgttcactctgaagtgggattatcacctactggtggagtaatgaagtttcatgtgttgtagaactctttattactatgtcttcttattagtatgctgtaaaacttttagagcaattggtttggacattggttggactggcggtgtgcggcggcaatgggcaggtagcaaggcagtgggggcaccaccggagctgtgaggatggaggccgacaatgggcagggttggcagcaacctgagcgagggaggccatatggtaactgtgcggtcggtgacaacaattccgacagcatacgggaatgacactaccgctggattatggagaaagagacggaggatggcagggatgaggaaaaggctgaggattatatggttttgtgggcctcacctgcgccgttgactccttttggcaagccgacaagccaagagtagcatcgtcgtgcagggaggagtcagcagcaacccatcatacatgtgtgcataggtgaaacggggttgaggagggaagaagtgataaggggagagagaaagagtccacccaattcttgcaatcctaaatggtcaaaaaaaattgatttttttttggggggggggggcaactgagaattagacactcccaaaaattaattaggaaaactgagccacccctgtaggacgacccagccaaacttgccgctctccatgatcaccgttcctttgagatgcatggggccaccttaggaaggggatgtttaggtcatttaattgtcagagcatgatgattatgtgtcgatgtcctcctattctgcatttaaccactcaagatccagagtactgttgccagacttaacacatctcgggcgcgatttgatccatattccttaatttattgggtccttgattatcacgatcacttatggtcgatcatgagacgtgggtgattgtgcagcacaaataattattttaagggattgtatagattatattaattttggacttgttcggcgggaaggaggcggtggtgatgtatatcagcggttgtgatacatcatgcatgtgtgcgtgcttgaaacagggataagaagtgtagaagagatagggcgagatagaaatagtctacacgaacctcgatgcaattctaggcgtttaaaaagtgacagtcttttaggcaaaacttagacaatctaaaaagttaattaggaaaacagttactttttaaacgactctccacaatcgacattcctttgagatgcacgaggcccactatcgtaggttgaggaagtttaggccatttaattgtcagggcatgattatgtgttgatatcttcctattctgcatttaatcactgaagatccaaaacattatattaccagacttaagatttcttgggcgcgatttgatcaatattatttattaggtccttgattctcacgagtcacgaccacttacgaagttatgatcgatcaagagatgattgtgcagggaagattaatatttgagtgagtcaattttggactacatgtctacattaatagcttgacgatcaagaacgaaataagaaaaatatgctctatgatttgatcgatcgatctcgaattatacgttatgatatgtaaacaccagagaaaattgggatcgggatatgcaatctagtactagatattatttaattacatactctagtatgaaaactatcgtgcaaatcgggatactcttgagctggccggaatatttttcctggaatgcaaaaataattacgaattacagatcaatgccgtgcgcccgtgcagatgcaatggatatatatatcggccacgttgctgcttcttctaatataataaggcaatctcgttgcctactttgcacgatgtgagctaatcacacgaagtggacaacaagttcgtcatgtgatttgttgtctttctcctttgtgctttgtgcatcgaatggcatcccacaattatccaaaaaaatttacaaaaagcatttcactgagcttttgtacgtacgttatttatactacctccgtttttatgtaataaatacataagcctgttaacatttcgatattacatttgtcttcctaaataaaactaacatttatatttggtgttgaacttttttaataattaaatgtacttggaccattatatacttttgcacatttccattaaagtttttaataagataaatgatcaaatatcacgttaaaaattaacagcatcaaatatttaaaaaccgagagagtagtttggaacacatgtttaagttacagtcatttaaacttgaaatattggctattattattgaacctaggaacaagatagtagttccaaaatttaaggtgtgatatcatattttgtattatccattttacaatatattgttgatactatctttttatggaccgccacttcgaaaaagcaaataatacttatctcagtctccagaaagttaccaggaccaaataaataaattttcaaataagtaatcttatttttcagtaaagcaaagcaataatgaacttatgattttaaggcttgctattcactctataattatatattgccgataaaattcatcacaacaaaacaaaatagtgtcaggaggagtagatttgttgagaaaaaaaagaccgagaataacgtatttggcccaattaagtatatacatatgtaatgcgtaatatacctacatgtgttgaattattttcggacaacttttgagtattcactccaatacccaagagcctccctgtgtcccaccctgaagcaaacaaaccaggaagaacaataacaacagcatgggtagatatgttggcatccctgtaaactctataactcaaacttgaaatcggcagctctaaattatttaattagtaactggactaaaatatatatttctcgaaaaacgaagtggacaaattagaacttccataaatttagttttctcattaaaataagattttgttcagatttaagcatgatattctgctggtaagttatatgatattatatggagcatgtgatgatttttttaaatattcttttaagtcatttactaatgcaaacatagttgggggttaacttggaccaggttgtcgaaaaactagtataaagccacacagccacaagctagaatatccatcaataaacacatcatactgccatctccctcaactagttgcaaaagcacacgttcttccaatattccatcagccatgcctggagcagctgctgccgctgttgttgacagccgcctgtgcacacagcacgcggaaggccctgctgcggtcctcgccatcggcactgcaaacccggcaaatatcgtctatcaagatgggtttgccgactactactttggtctaaccaagagcgagcatcttattgagctgaaggacaaaatgaagaggatatgtaagtagaacaatcctttcatttcgatcgttgcattgatcatcattatcgttagttgtttttcataaactctaatgagaataaattatgcaagcgcttaaatttttaggacactcctgccataattcattataaaccatacaaatatttatactatactacgtagaaagaagagtgaaatgatgttggagttcagccaaattttctttatttcgcgtgtgggatgcaatgtggatgcatggggtgtggttgcatcccaaaatttttgaaaaaaaatctactatatacagtatatacttggtacatatacgcagtatgctcaatacgaggcccacttaaggtcatccaggactatatgctccatttgaatttctacattatttatgtcattgtatttgtactcgctatatttaagtgttttgctagtatatttttttcactttatctcttatcttgaatcataacagtaaagttttgcatctccatctctgaaatcctggatccaccactaatacctcgttaaatatgatagtttgtcatataatgtccctcctgctcatcaggctaccatctcgcacccatgccactgtactcgtatagatttaaagactacgcttttaacaaaaatacaagagatctacagagtagtcatagcaataaatccgtggatcttaataaatttgtactgaaaaatagcacttacttgtctatatgttggcaccgggaattgagtcttagtggatagagttatgcacccacaagtacatcattagaccatgtttgaacgaaacatatgtgctaatccaatctttcagaacattaaactcatgattatcttcctaaaaataggacatatataaaccatttttgttttattacggaaaatgcttgcataatatcatatattcttgttttgtaaatattcggcatcttaattgaaatgtctcatgttattcttataatctcttagtgctatgtactaattgtaagagatgtgggtgcatccttttccatttcaggtcacagatcgggaatagagaaacgctacatccaccttgatgacaagctcatctgtgagcacccggagatcatcgacaaacacatgccctcccttgaaactcgtgtagacatcgtctctactgaggtcccgaagctcgccgagtcagccacacggaaggccatcgccgagtggggccgtccggccattgacattacgcacctcatcttcagcacctactccgggtgcagtgctcctagcgctgacctcaagctggcatcactactcggcctcaacccttctgtttctcgcaccatccttagcctccacggttgctctggaggcggtagggcacttcaacttgccaaggagctcaccgagaacaaccgtgatgcacgcgttctcgtagcctgtgccgagctgacgctaatatgcttctcaaacccagatgaaagcaaaattgtcggccatggactgtttggggatggtgccggagcaatcattgtcggcgctggcccactggtcgatgaagagcgcccactattcgagatggtcctcgcctcgcaaacaacgataccaagtactgagcatgcacttggcatgcagaccaccgccagtggcatagatttccacctctctatccaggtgccaacactgatcaaggacaacatccggcagtgcttgcttgacacattccgatcggttggaaacatggatcctaattggaatgacctcttctgggcagtgcaccctggtggccgtgcgatccttgacaacatagaaggcgagcttcagctgcaaccagcaaagcttgcggcaagccgccatgtgttgaacgagtatgggaatatgagcggcacgacgatcgcgtttgttcttgatgacttgcgtcgccgtcgggagaaggaaggagatcagcatcaacaacttgagtggggagtaatgctagcctttggaccaggtatcacaatagaggcaatggtgctgcgtaacccactctcatgaagtcttaaggaaaattaattgccactatcttatgcttgtctggtatcttattacggtatatgttaattaatcaatgcatgacactaaatcaattctgcatgcttaagtggaattatgacctaccggtgatgtattgatgttgtggagttcctatctaatgtttattgctgttttttctgtatttgtaacaaaatttgtaataccctgtgtataattgaaaaagcatattgcttatatgagttgcttcaatccgagtttggatcaattgagatgtatctttcaagaaaacacttgaataagatcaagtcagtattttgcaagtgaaaaaatgttccaaaacaagataaaaagatgcaatcaatttcaacttaatctttagtaattaagattgtttttcttctcaaatatacatgagatgttgtgtatcattgcattaatggaagaacggaggcgtaagatgcaaatacaaataatcagaaaagacaaaaagtgagaaaacaaaacacgagcaaaagaagaacaaagtgcctaaccgaggctctcccaacaacctgaatcatgggccttcttaaccgggatctataatcaacgaaattcccctaggctcaataggtgagcctcgtcactcgctagaactagtcgagaagatgattggagcagcctcgttgaaaacacaggcgtttcgatgcttccaaatagaacatgccctaagaatgatcatattatttatacccttccttatagcccgttttaccaaattcttgtgtcttagctagggagatcgatctgctttcagaaccggcggcgcgttcatcttctcgtcgttcgatctgatcagcgagaacaattctgacaccggtgtgttcttcgatagatccatctgatcggcggcagcatacgcgcttcatcccacggcgagttctttgatgaatctggttggtggcggcaggcgtgcgtcctcctgtcgtctcatcgagttaatcggctcgacgtgattgagttttcggcgcagcaatccgaagcggagttcttttttgctaccacgcatccaccgaaaaagcagcagcgcatagctgcacggctctggaggaggaagaaaaatcaattgaagatactgctcgcttcgtgtttatgtgaagttccaaattcctgttggatttttgtacgtccacaaagactttatatcagggaatttcttttcttttggaatctattatatatattttttgatctggaattgtttctccaacatgtcatgtatcaaatttgacattgagaagtttgatggcaagattagtttttgcatatggcaggttcaaatgaaagttgttcctacacaagttgatgttcggaagcgaatatgattgatcaaggggaagataggctgtgttatctgtgtgaatggtaccgtatacaggttcttaagaaggaatcacaaataccgttccaaagcagcatatttcgacaacactgaatagcttgatgatccaccaggaccatgcaagggtgatagagtgttccaaatgacgaaaaatctcaaagtttttttttgagaaggcaaaaaagaaggaaaccaagcggaagcgaaatgcggaaggaccaagcgttctattcaatagatatatagatacatcattttatcggtgtcatgcacctagagaaaaatgtgttctatagaaccattgggactttagtagccataccaagcaagacaaatgatggactgaagtcacataatgtaacagcccgtcctccagaaccgcgtagcctagaccatccaatgggcgggcccacttacacataccactcccgtacacgtttatcctcgctttgtataaaagtgttaaccctggagtgatatggttggagggacaagcccactcttgctaaactagcaagatggtactaaatatacgcacacaggtcttattggccacacatgccatgtcctaattataccaggatgtcacacaccctcctcaaaggacccgacatccccgttggcccaatttacccatatagtcacacacaggcatataggtaaatgtctaggaacacaccccctcttaatgcttagtgcagtccgccttacatagagcccacatgtgccatatacccgcacactgacccatacaagcaaccgcgagggtcggaactgataccattttgtaatggcccgccctccagaatcgtgtagcccagctcgtccaacgggcggtcccacttacagataccactccacttacactttcgtcattgcttcgtgtaatagggttaaccagggagtgatatggttgaagggacaagcaaaactagcaaggtggtactaaacatgctcacacagctatcatgtactccttccaaaaatctgagacctatttcattctttggtttttctcaaaatctaagtcctatttgtagtcactatgtactaaattgaattgttgatcagaaaccaataagtcattctaataattattggttgcatgctcattggttttgccatatggtgagtgagttaattgcttcttggtattgatgcaaaaagaaataggtctcatatttttggaaggagggagtaccacataggccatatcttaattgggccaggttgtcacatgtaaggaccttgtgaatacgcagataacagaagagcttcacctgcggatgaaggtaatggaagagttgtaacatcccgcctctcctaggccaggcctacttacatctggtagcttatcttggacatagactaccctcacagaccaacacaagtcttttctgcatactttgtcctcactcgtgtgcacccgggaagaattttccggtcggtcacccatcccaaaattgctctacgccaagcacgcttaacctctgagttatttggagatcggttaaggaaaataagttgcaacctgatggtatgagtattctattaatcctattaagccctaggccaggatgtcacaagagtgcacctttcgctgacttattacaccttgacaaattatgagaaaatggcattgtacaaatccctacacgaggtgagagtccctaccggtttctcctcaaacataaagcggctagtgtcgatgaaggatttatagcttttgggctacatttctcatgactgtcatgtaatgctcataatattcattgctattgcaatcaaagtaatcaaactagtacacgtaaagatggttgtcacaaaactgtgttatttcttcaatgcaatctcacataaagtaattgaccttgaagagttaggtcatctccgtgttttcgctatagagaccttgtgcaagcttgagatgtgtttccctctgtcatttttcaatatgatgcaacacctcatggttcatatcgtgcctcagatacttgtgcttgggcccttgtaccttcatcagatgtggacattcgaacagtatatgtccaatctaaaaaggctatgtacggaaccgtgcccacccagagggttcgatgatagagggatacactaccaagaaagtcattgagtgttgcattggttacttgcaagatgggaaagcaattggtttactagtacctcgacataaaggtaggttatctggaagagggacaaaaaggaaaaaagaatcctcgacaatgactacaaagcagtgaaagatgctcatttcattgtcctgtaacagcttgtgatagtggagctgtacatagagcagcacctaaaggaattacaagcaagaaatgtcaggcgctctgaagcatggatcatgaaatggcacaaatctgactttaccgaatggttaaaggacctcggccgaccatatggtgatagcacgaaggaaaaaactatgaaaagtttggctgacgggcattcaagagtgtacacctcatggtgagcgtatatctgaatgggtacacattttataccaaagcaagagacaaaaggagtgcatctcaaaataatggcgttcaagtataggaaatcgacacaacaggtcaaaagagcacatactatgaattcatagaagaaatttgggaacgggactacgaacccaatatgcagattccaccgtttcggtgtcaatgagtgaaacacccagctggcgtgtttgtggacaaatttagacggacaattgctgaccttgacaacgtaagccacaagaataacccattggtacttgccgatcgagccacccaagttttttacgtgactaaccccatctcagttgaagaaacacatagttatttccggaaaacaaaggattttgggagttggtgatgttgaagatgttgaggcatacaatcaatacgagaacatgacactattcatggattttggaaactacattaagcttgtagaagaaacaattagtgaatcgccgaaggcgtacatgaggaataaaggagtaaggaagaatgtgaacggctaataaatgtagtcgctgttcaatataaatatgaatcaatgaatatttacatatgaatgtgtgacatgatggacgatgaattttttatggatggtgaattttatattatttgttctcatggtttttggtgtttaaaaaaagagaaaagaactaaaatttataaaataagaaaataatgatatattagttactgatggtgacatcatggagactctgatagaaaaacctgtggtttacgttttggggtgagggttgggctgggtgggggcactactagagccacagggatggaggctggcagtcggcatggttggtagtaggggcgagggaggctgtgtagttaggaggaggcgattggcggtggtgattttgaaagctatggcagtgcgccactgctgttcaatcaagaaggaagagagggagggacgtgggattggggaacgggaaggaggcttgtctggtgggcctcgctggcaccgttgaccccttccggccatccggcgagccaggggtggtacgttcggcgggaaggtggcggcgatgatgtatatcagcggtaatccatcctgcatgtgtgcgtgcttgaaatagggacaagaagagcaaaagagatagggtgagatagaaatactctacacaaatgtcgatacaattctaggcgtttaaaaagtgactgtcttttaggcaaaaatcaattaggaaaactgttattttttaaatgactctccacgatcgccattccttcgagatgcacgaggcccactaccttaggaagaggaagtttatatcatttaattgtcagggcatgattatgtgtcaatatcttagtattctgcatttaatcaataaaggtctagaacattatattagcagacttaccacttcttgggcgcgatttgatcaaatattatttattgggaacttgattcgaccacttatgaagttatgatcggtcatgagatgctgtgtggattgtgcagagaagattaatatttgagtgactgaattttggactacatgtctacattaatagcttgacgatcaagaacgaaataagaaaaatatgctctatgatttgatcgatcgacctcgagttatacgttatgatatgcaaactccagagaaaattggaatcaggatatgcaatctagtattagatattatttaattacatactctagtatacaaactatcgtgcaaatcgggatactcttgagctggccggaatatttttcctgtaatgcaaaaataattacgaattacagatcaaaaatatatccgccacgttgctgcttcttctaatataataaggcaatctcgttgcctactttgcacgatgtgagctaatcacacgaagtgaagttcgtcatgtcatttttgttgtctttgtcctaatttgtgcatcgaatgactgatctcacaattatccaaaaatatttacaagaaacatttcacagagctatgtacgtaatttatactacctatgtttttaaatacataagcctgttgacatttccacattacattcgtcttcctaaataaaactaacatttatattggttgtgatttttttaataattaaatgtatttggaccatgatatacttttgcacatttccattaaaatttttaataatataaatgatcaaatatcaccttaaaaatcaacatcatcaaatattttaaaaccgagagagtagtttggaacgcacgtttaaattacagttcatttaaacctgaaatgttggcagttattattgaaccttgcaataaaatagtagttgcaaaacttaagacgtgattatccattttacagtacattgctgatacaatcgtttttatggacagccactttgaaaaggcaaataatacttatcccagtctcgagaaagttacccggactaaaaacatatcaattttcattttcaaataagtgttttttgtttcagtaaagcaaagcaacaatgaactcatgattttaaggctagctattcactcaataattattgccgataaagttcatcacaacaaaacaaaatagtgtcgggaggagtagatgtgttgagaaaagaagaccgagaataaagtattaggcccaaataagtatatacgtatgtaatatgtaatatgaaaaagtatatatacatccctaaactttatattgaagtctgtctagcacattgcactttaaaatcgaacatccaaccccctgaactttgccataccatccatattaccgttaaggtggttttggatgatggttttgcatattttagaagcttaaactgttgagttgtgatccaaatttatttacacttaataaaggctagattctgccgtagtgaagcggaggcccgtcgccggtaggcttggttcagagccttttagggttccaccttttacggtacggatcgtaataccttttagggttctacctcatatatatatatatatatctcttgtaagccgccgtgcggcattgtaacctcacccaatatagtgaagatattttactggctagcgcccgtggctttttctctcctgctttgggagggttttccacgttaaatctcatgtcttctgtgattgatctgtattgttctttatcgtttatttgcctatcgtttcctaacataaatgacaattttgaataactaatgtaacatatttacgtatcatcagttataaatcatcaatttatcattatatagtgatatcatgatattattatattggtgcttgtttgttagtgagagcaaataaaaggcaaaaagaatgatttaagtcaaaatttttgtatatatgtccaaagtatatgacatgtgatcaaactcatccaacttatatacaaattagattaaaaaaaccactatgcaaaaccatcttagggggttacatcaacggtattctaaagtttagggggttgaacgtccagttttaaagttcagggtgctagacggaattccatcagaagtatagggggttattaggattggaaaaagtttacatgtgttgaattattttcggacaacttttgagtattcacttgaatacccacgaatctccctgtgtccacccctgaagcaagcaaaccaggaagaacaataccaacagcatgggtacacattttggcctccctgtaaactctataactcaaacaagaaatcggcagttctaaattattaaattagaaactgacctaatatatatatttctccaaaaatgaattggacaaattaaaacttccataaatttaattttatcattaaaatgagattttgttcagatttaagcatgataatctgcttgtaagttatatgatgttatatggaccatgtgatgattttttaaatattcttttaagtgatttactaatgcaaacatagttgggggtttccttgggctaggttgtccaaaaactagtataaagccacacaaccagaagctagaatatccatccataaacgcatcatactgccacctccctcaactagttgcaaaagcacacgttcttccggtcatcagccatgcctggaacagctactgccgctgttgttgacagccgcctgtgcacacagcacgcagaaggccctgctgcggtcctcgccatcggcactgcaaaccccgcaaatatcgtctatcaagatgggtttgccgattactacttcggtctaaccaagagcgagtatcttactgagctgaaggataaaatgaagagaatatgtaagcagatcaatccttccactttgatcgttgcactgatcatcattatctctagttatttttcataaactctaatgagaataaattatgcatgcacttaaattttcaggacactcctgccatagttcattgtaatgatgttggagttcggtcaaattgaaatatgtcctgccattataacctcggagagctatgtactaaatgtaagagatgtgggtgcttccttttccatttcaggtcacagataaggaatagagaaacgctacatccaccttgatgaaaagctcatctgtgagcacccggagatcattgacaaacacatgccctcccttgaaactcgcgtagacatcgtcaccactgagatcccgaagcttgccgagtccgccgcacgtaaggccatcgccaagtggggccgtccagccactgacattacccacctcatcttcagcacctattccgggtgcaatgctccaagcgctgacctcaagctggcatcactactcggcctcaacccttcagtctcttgcaccatcctcagcctccacggttgctctggaggcggtagggcactccaacttgccaaggagctcgccgagaacaaccgtgaggcacgcgttcctgtagcctgcgccgagctgacgctaatatgcttctcaaacccagatgaaagaaaaatcgtcggtcatggactgtttggggatggtgccggagcaatcattgtcggcactggcccattggtcaatgcagagcgtccactattcgagatgatcgttgcctcgcaaacaacgataccaggttatgagcaagcacttggcatgcagaccaccggtagcggcatagatttccacctctctatccaggtgccaacactgatcaagaacaacatccgacagtgcttgcttgacacattccaatcggttggaaacgtggatcctaattgaaatgacctcttctgggcagtgcaccctggtggccgtgcgatccttgacaacatagaaggcgagcttcagctgcagccagcaaagcttgcggcaagccgccatgtgttgagtgagtatgggaatatgagtggcacgacgatagcgttcgttcttgatgacttgcgtcgccgtcgggagaaggaaggagatgagcatcaacaacctgagtggggagtaatgctagcctttggaccgggaatcacaatagaggcaatggtgctacgtaacccactctcatgaagtcttaaggagaattaattgtcactatcttatacttctccagtatcttattacagtatatggtaattaattaatgcatgacactaaatcaattgttcatgcttcagtgggattatgacctacttggtgatgtattgatgttgtggagttcctatataatgtttgtgaagatatttgagttgtcaattgctcaactctagtacatgttgtaattaaactctttatttctttcatatgccctctgattgttaagttttttttttgttttgtaataaaatttgtaataccttgtgtataattaaaacaccatattgcttatatggtttgcttcaatcattttgatcaattgagagtatttttaaagaaaacatttgaataagatgaagtcaacactgtaagaaaatgatattttacaagtgaaaaactgttcaaaaacaagataaaaagaggcaatcaatatcaacttaatatttactaattaagattatttttcttctcgaatatgcatgagagttatgtagcattgcattaatggaagaacggaggaatacgatgcaaatacaaagattcagaaaacacgaaaagagagaaaacataacacgagcaaaagaagaacaaagtgcctcaccaaggttctcctaccaacctgaatcacaggccttcttaactgggatccataatcaacggaagtccctatggccccgcctaaactccataggtgagcctcgtcactcgcaagaactactcaagccaaaatgcttgaggcagcctcgttgaaaacataattgttttgatgcttccaaatagtccatgcaccaagaatgatcagattatttatacccttccttatagccccttttaccaaattgttggccctgctccacctatcggagaagtgggaacaggggttccctttcccccaaggtgctcggggcgctatgcgccccaccaagccttacaagatctacatctttaaggtttcaagaagagtatggagacctacaatatctacatcttcaaggtgcagaagcaggcactggtgtgtactagtgtctcgtcgaaagtcatgcccatcatgaactccttatttatcaatatttttgagaagctcatctaatataccaacgaaatatactttcggcaatgcaaatgcgcccgaatatgtagggttgccccgaggacttggcctgccttgaggacaaggggtgacccaaacatggcggccaaccggtgacaagattgtaatccctcaagaacccgaggactccccgctcaatcaatggagaggttcaccacattaaggaaagctactcgggtccagaaatcacatttaaaccaccactttacattaattatgatggtcctattgatctaaagtgctgtcatccacaagcgacttatgagattgatctcatcgggagtggatcgggcaatatggaactcggattattggttctgtgagcttcaggaatatcacgaattcggctctggcttcctccagattgtttctcaatgtggatttgtctacggcttctcaatgtggccctccttgaacacagtggccatgtgacgggctatagtttaggcccgttagagatgagagtcatccgtgacgggcttttgtgttggcccaattgagatgcgtcatccgtgatggccggatgcctgattgagatattttctcacatcacggacctttgcttagtgacgagggccctgcccgaaagagatgatgatttaagcccgttagagatagccgatcccgttctagtgattttatgtggagtacaatgatgcaaataaatattaaaaataatatgtaatttaaaatatataagtcattaaagggttaaaaaagacatacaccatatgctaaagaggatttatatatgggatagagtggtctccggttagaactaaagcactatagtgcactatctagtcacgtcctatcctaaatggtaaaaaaaagtgacagaacttcttattttggggcatctgaattagacacttccaaaaaattaattaggaaaactagaggcacccctgaaggtcgtgccagccgaacttgccactctccatgatcaccgttcctttgagatgcatgaggccaccttaggaaagggatgtttagctcatttaattgtcatggcatgatgattatatgtgtctatgtcctcctattctgcatttaatcactcaagatccacaatgttaccagacttaacacatctcgggcgcgatttgatccatgttacttaatttatttattgggtcattgattctcatgatcacttatgatcgattatgagacgcggggtgattgtgcaaagcagataattattttaagaatgtataaattacattaattttggactaagtacattaatagcttcacgatcaaaaactaaatatgaaaatatgctctatgattcagtcgaccgatctcgcgttatacatagtgatatgtaatctccagagaaattggggtcggtatatgtattctagaattagatattatttaatggcatattctaatttaaaaactatcgtgcaaatcgggacacttttgagcaggctgggatattttcttgtaaaatccaaatacagaaaaataattagtacgaattacataccaatgccatgcgctgcaggtgcaattgaaatatcatgatatggcaatatcggccacgttgcagcgtcttctaatataataagtgtttattgcctactttgcacgatcttggagctaatcacacgaagtggacaacaagttcgtcgtccagataccacattagctgctttgttatctttctttgtgtgcatcgcatggcagatctcgagacaataatcgtcttcttaaataaatctatacgagtatcatgaaagtacattaaccattatattacttatatttttcatatttacattaaaacttttcataagacaaatgatcaagcataatattaaaaattaacagcattatattaacatttcaaaacagagtgagtgagtagtttggaacgcacataagtaactagtattaattttaaacaactattaattttaaactttgaaaattattatagaaccggcgaaacaagatagtattagtaaaattaaaggcatagtatcactttttgggttatccatcttacagtacattgctgatacaattgtttttttaccgccactttgaaaaggcaattaatatttatctaaatctttggagaattatcaaaactaaaaagatcaatattcaagtaagacattaatatgtttcggtaaagcaacgccagtaacagacacgggacttcaagactagatattcactcaacaaatactgataaaattcaatagaacagaacaaaataatgtcagaagtagattctgagaaaaaagactgagaataaaatattagacccaattaagcatacacatatataatgtaaatgcatatattgaattattttcagtgaacttttgagtgtctgctccagaagcaaaggaccaggaacaacaataccaacagcattttgaccataagatgggtagatatgttggcattcctacacatttatgtaaactctataattcaaatgaccaggaacaataccaggagcattttgactgtaagatagatatatatgttagcaatcttcacattttctgtaaactctacaacgcaaactagaaatgggtcgaggccagttcagaattacaaaattagtacctgcactaaaatatatatttctccaaaaacgatttggacaagtcatacaaaaatttaattttatgatcaaatgtgattttgttcagatttaagcatgatattctgcttgtaagttatatgatattatatggagcatgttttgattttttttaaatattcttttaagtcatttactaatgcaaacatagttgggggctagcttgcgccaggttgtcgaaaaactagtataaagccacacagccagaagctagaatatccatccataaacacatcatacagccatctccttcaactagttgcaaaagcacacgttcttccagttccatcagccatgcctggaacagctactgccgctgttgttgacagccgcccgtgcacacagcacgcggaaggccctgctgcggtcctcgccatcggcactgcaaaccccacaaatatcgtctatcaagatgggtttaccgactactacttcggtctaaccgagagcgagcatcttactgagctgaaggacaaaatgaagagaatatgtaagcagatcgatccttccactttgatcgttgcactgatcatcattttcactagttattttttcataaactctgatgagaataagttatgcaagcgcttaaattttcaggacactcctgccatagttcattataaaccatacaaatatttatactatgtagaaagaagagtataatgatgttggagttcagtcaaattttatatacctcgtgtgtctgatgcaatgtggatgcacggggtgacgttgcatcccaaaattttggaaaaaaatctactatacacacagtatatacttggcatatgtacgcagtatgctcaatacgaggcccacttaaggtcatccatgactattgatctgctccacttgaatttctacgttatttatgtcattgtatttgtactagctatttatgtactgttttgctagtatatttttttcactttatctgttatcttcaatcataacactaaagttttgcatcccatctcagaaatcctggatccaccactaatacctcgttaaatatgatagtgtgtcatatactgtctctcctgctcatcagactaccatctcgcacccatgcctctgtactcatatagatttcaacagtctacgcttttaacaaaaatacaagagatctacagagtagtcatagtaacaaatccatggatcttaataaatttgtatagaaaaatagcactcacatgtctatatgttggcaccaggaattgagtcttagtggatagagttatgtccccacgttacgagaaaatcataagatcatgtttgaacaaaacatatgatgtgctaatccaatctttcagaaaattaaacacatgttcatcttcctaaatataggacatatataaaccaattttttgtcttgttatggaaaatgcttgcaaaatctcatattttttttgtatttattcggcaacttaattgaaatatgtcctatcattcttataacctcagagtgctatgtactaattgtaagagatgtgggtgcttccttttccatttcaggtcacaggtcaggaatagagaaacgctacatccaccttgatgaaaagctcatccgtgagcacccggagatcatcgacaaacacatgccctcccttgaaactcgtgtagacatcgtcaccactgagatcccaaagctcgctgagtccgccgcacggaaggccatcgccgagtggggccgtcctgccattgatattacccacctcatcttcagcacctactccgggtgcagtgctcctagcgctgacctcaagctggcatcactactcgggctcaacccttctgtctctcgcaccatcctcagcctccacggttgctctggaggcggtagggccctccaacttgccaaggagcttgccgagaacaaccgcgatgcacgcgttctcatagcctgcgccgagctgacgctgatatgcttctcaaaccagatgaaagcaaaatcgtcggccatggactatttggggatggtgccggagcaatcattgtcggcgctgacccattggtcgatggagaacgcccgctgtttgagatggtccttgcctcgcaaacaacgataccaggtactgagcatgcacttggcatgcagaccaccagcaatggcatagatttccacctctctatccaggtgccgacgctaatcaaggacaacatccgacaatgcttgctcaacacattccgatcggttggaaacatggatcctaattggaatgacctcttctgggcggtgcaccctggtggccgtgcaatccttgacaacatagaaggtgagcttcagctgcaaccagcaaagcttgcggcaagccgccatgtgcttagcgagtacgggaatatgagtggcacgacgatcgcgtttgttcttgatgagttgcgttgtcgtcgggagaaggaaggagatgagcatcaacaacctgagtggggagtaatgctagcctttggaccaggtatcacaatagaggcaatggtgttgcgtaacccactctcatgaagtcttgatgaaaattaatggccacaatcttatgcttctccggtattttattacagtgtatggtaactaattaatgcatgacagtaaatcaattgttcatgcttaagtgggattatgtcctagcggtgatgtattgatgttgtggagttcctttctaatgtttgtgaagatatttgagctgtcaactactcaactctagtacatgttgtaagtaaactctttattgctttcatatgccctctgattgttaagttttttggatttgtaacaaaatttgtaataccctatgtataattaaaacaccatattgcttatacggttttcttcagcccgaggtttgatcaattgagatgcatttttaaagaaaatacttgaataagatgaagtccgcacggtaagaaaatggtattttgcatgtgaaaaactgttgaaaaataagataaaaagaggcaatcaatatcaacttaatatttcctaattaagattatttttcttctagaatatgcatgagagttgtgtatcattgtattaatggaagaccggaggcgtaagatgcaaatacaaagaatccgaaaacacaaaaggagaaaaaacaaaacacgagcaaaagaagaacaaagtgcctcaccaaggttctcccaacaacctgaatcatgagccttcttaattgggatcgattatcaatgaaagtccccttggcctcgcctaaactctataggagggccttctcactcacaagaactagtcaagccaaattgcttggggcagcctcgttgaacgcaatcgtttcaatgcttccatatagtccatgcaccaagaatgatcagattatttatacatttccctatagccactttttaccaaattgttggcccagctccacctgtcggagaagtggaaacaagggttccctttccccctaggtgctcatggcgctgtgggccccaccaagcactacaagatctacaccttcaaggtttcaagaagaatatggagacttcaaagtatataagcgggcattggtgtgtaccagtgtctcgtctaaagtcatgcctatcatgaactccttctttatcgatatcttcaagaagctcgtccaatataccaacgaaatctactttcggcaatggcaccgtgcctgagtgtgtaggggtgccccaaggacttgcccaccctatggacacggggtgacccgacacacggcagccaaccggttacaagcttttaatccctcagggcccgaggacgctccgttcaatcaatgaagaggttcaccccattaaggacagctgctcgggtctgatgctcacatttaaaccaccactttacattaattgtgaggtgaactcatacacaacttgggagacgtggtagcacatgcaaccccttgcatgcccacgttaccccggagaacacaaggcgtgcgacatggcgcgtccacagcaaccatccccaagttccacccctgttggctacggtcgcttatgggtagcccgtggacaattggaacgaagacttttgattcatctctccacttgttagttggtaggcatggctttcacatctggtcagctggcttggagggactactacaagactaagcatattaagtttagaggagtaggccccactcgtacatgcatgcaatggcattgtggactccccttcatgtgtaaaatgaggatccgtgccatagagaaaagggttcacactctcatctaaattagattagccaaacatccagtgatcaagtaacttctcctcacacttcttcttttcccgcatcactttgtgattcccttcaacatccatagtccacacacagaagtaaggtattatgcacccgtgcgtcttgaacctatgtactcgcttggaaatttggagcaaaagactttcacatctcaatgttctaatctcaaattcaaacaattccattgtaatgttggacaatctaaaagaacaaaaaccactttccattcaaaatggaacttctggctaatcctgagagaacacatcctaaagctactacactatagaagtacattttggaaaaaaaaaaggtgtagtatcatatgggtgaaatttggagacgataataaaaaaaattcatgctgctaccacaaaaagatatagaagtaacaagatttctcaccttcatctccatgatgggattgtgatttcctcacatgcagacaaagcacttgctttcttagcacttttaaaaataaaatgggcacctcaaagcaaaatcaaatgattaagcaaaatcaaatcattatcaatttgcaggagttatttacaccttaggagggactctctacctggcttctatgatgaaatgctcgaaatcatcaattcaatgccttgagatagagatcatgggcctgatggtttcaatgggatgttcctcgaaaaatgctggcaaattatctctgatgatatctattccttgcagattcagttttgttttggcattatatctgtgggcagtcttaatagttcactagatgaataccacgccgcgttgctgcggaaaattaagttacataatatgtacaaataaaatatatttttattatcaaaactaaaacaatttgatacaattttgagcctaaaaataattgagattgcatgtttttatgagagatgaaagacgagacaatttagatcatagatctatcatccaaatgctagaaataattggggtgatatgacttaatgggagaagagagaaatagcattaactatacttagtgtggaagaactatataagtatataggattcgtcactctaattcctaagaagccaaccctggaaacaacaaatgattagttaagattcttaaaaactagttaagcatattagatacatacaatattattaatatgtcatgataattactagcaaataatgcaaaatttataaataatatatatcacagaacgtgcacaaacgaactggctgatagtgttcagctaccaagtttagtgaccacaaaatagcaatatcattatcgaaaataaacaccgccagagaaagcatttgtaaccccggtttgtaacccctttagtcctgggtagcaaaccggggctacgaatccgggactaaagatcgctgtctttagtcccggttcaaatacctgggactaaaggttttttttttctactttaatattgatttcaaaccgtcctcattcataaaatcatccacaaattcaataacaaaatcatccacatttacaaaaacatcacaaaatcatccacaaatttacatcacaaaatcattcaaaaaaaacatctaaaaatcatccactgttcttctactttttctactccacgacggccgcgcttgccaactacccagagggcaccaccgtgctgcgggagctcatccagaactccgacgacgcgggagtgttccacgtccgcctctgcctcgaccgccgcatgcatggcgcaggctacgctgccgctggccgccctccgcaatggcagggcccccgcgcggccacgccgccacgcccgccgccacccccggctccggtgccgggcgccgcgcaccgccaccgccaccggctgcccgcccgctgccgatgttagggtagagggaaaggggaagccgggaaggggaggaggggaggaaaagatagaggatgtgagggagagaaagagatagaagaagataaggatgagaggaggagggaatctctgaaatttttctctctccccctctcatgcgcgccttttgttttctctagcccgcacacgatttttttaatctttagtcccggttgttgacaccaaccaggactaaagatattgggggggggcctgacacgtcctgacaatgaatgaaccgggactaaagatgaagattaaaaatacctttgaacttataacccgggactaaaaatggcttttagtcccggtttttgttcatccgagactattgtggtttttgcccaactcacgaaagatggtttctctagtagtgaaagaagaactgtataacaagaagatggaatatcgcaagaaatgctgaacaaaaattttcagttttaccttgcatcgtggtaaacaacaaaaatttgttaaaaattatgaaattttaataatgttaatacaatattgatgaataggagtatttaaatacttcaaaccagctgggatttgcggctcgaaatggcttttgccctggcgtggccctcgctgggtgccgacacgtcatccggcactggattttggctgggtttcgagtcatgtggttgcttggttcatacgccgttcgatcatcatcgtgtggctctggcaatcatcgatacgggcagtgcaatggaccaatggcagacatactcaacaaggcccaccatggcaagcgaatggttgacgaaagagcacgcaagcaggtgaccaaaaacacaagcagctaataagttgttgctttgtttttgggtgggcgtggtgtatggctcgctctcgctgttgctgtgtacagccagccagtgtttgatgcacatagtgagaatatgtccatgtcgttcccttgtccttgtgtgacaacatttttttttgtttatgggtggattttaatgggtgctttgaagaccacgtctgtagtgggagcactgtgcacccactccactactgcaagagtatgcaagatgctattggctagattactcctggtctattcggtcatatcgttcctatacggtggacattgcctatacatccttcgtctgtgtattgtgggcccgaactttgttctagtccattagtgttggtctagggatgatatatgctacagtttacgttatcgattttattcggtgctacagttgagtagacacagctgtttggctgattggtgggccggtctgccattggacgcttaggtgcttgttgcttattggtgggtgtaaatttgtagggtctgaattaatttttttcccttgctccacggcactctagaaaattgttgctttcttttcattttttccttccctttcgcttttccagtctcgtcggtttcttcacattttctgttcttcgtttatttcgtgccaaagctctatccattttgcctctactcaatcgtccatccatcatggcaaggtaaaagttggttcgatgcatcaccaaaagttttgctaaattccatccaaaaaaaactgatcttgggaattctaaatgaaatttaatgtgtaaaattttttattcctccaagagattaggtaagattaaatccctataacaaaaaagtgagtccgatgtaaagctaccaatagaaatcagcttatttgtcctgctgcgtgccgacgatattgttgacgtgtagaggtccatgagaccatgggtgacttaggtggtgtttggttggagggactaaagtggggctaaactttagtccctctcacaaaaacataagtccctaccatagggacttatacttttgtgagagggactaaatttagtccctatttcccaaacacccccttaacgctctctgagcaagaaaaaaagctgatacagcagcaatactttgatatatgtccaacgcatagcaggttcca

SEQ ID NO: 66019 - DNA, 11688 bp, Oryza sativa
ttcagcgtatttctccaactcgtgatgtctattgtcctattcacaagacaaagaatcatgacctctcaagctgcaaggtctttctcagcgccatgaaggcgccatctcctaaggtccaacagtcacacgtccccatcagggataaagacaaggaacgaggagcgacgccaacttcagatcaatttgttggggtaatcgacatcgatccccacgaaccgtcagtcttgcacctcctcgaagactatggatcatcgacaacgagcgcgccgcgggaggtattggctatcgatgatgtcggcacgtcagcgcgcaccaatgcagaagcagagaatcaaatcgccactccggcccagcacatcagagccgtcaacgctatactgagggaaaccccctacgatcccgttctgaacgacgatctcacgcattggacagaacgactatgggaataagtgaccaaccatagtaacgcgttcgaagaggccgctgccgcagcgcacccggagcagccaccaactagcgatgccaatggtgaaaaccctgaacagagggaatcgcctcatcgagccacccctccacctcgcggcactggcgatctccgagatcacctcaacggccgccgagaggcacgacgcacacgagacaacgagaaccgttcccggcgtcatgtctcttcacggcgccatgataacgaagatcgaggagaccgttcaaacgaagaccaagaccgtgataaccgccacgatcacaacgatcgcgaacggcgggtgccaagcgatactggtcgaggacgttgccataatgacgacgatgatggagaccggcgccgagacaacagcgggagacgacgacaggattctcgagagccaggccaacatcctcgtaatcatacgccggaaccaagcgacccatcgtcatcgtcatcatcctcgtcttcctcatcatcagatagacatccacgaaggacacacgatcgccgacaacccagcgctgggtgtagagctttcagtcgttccctgcgtgatgtccgatggcctgagagattccgacccggagcaatagaaaagtacgatgggagcaccgacccagaagagttccttcaagtctactccacagtactctacgctgccggagcagacgacaacgcattggcgaattatttgccaactgcgttaaaaggctctgcacgttcatggctgatgcatctcctgccttactcaatctcttcggggccagacctgtggcagcagttcgtcgccaacttccaaggaacctacaagcgccacgcgatcgaagacgacctacacgcgttaacacagaactcgggtgaatccttgagggaatatgttcggcgcttcaacgagtgcagaaatacaatccccgaaatcactgatgcttctgtaattcgcgccttcaagtccggtgtcagagatcgctatactacccaggagttggcaacaagaagcatcacaactactcggagattgttcgagattgttgagcgatgcgcccacgcagatgatgcgctaagacgcaagaatgataagccgaagaccgggggagagaagaaaccagccacggacgcacctgagtcaagcaagaagaaaaatcgcaaaaatgggaaaaggaaagctcaagcggaagtcctcgcaatagaatacgcgaaccctcccaaacgcccagacccacaaagtagcgacacaaagaaagcatggtgcctcatacacaagacggacagacattctttggaagattgccttgttttgaaaaaatcgctcgagaaacacattgcatttgaaaaaggcaagcgagtacgcgtggtcgaaaaggatgtggaggcggctccccaagaatcggattcagcatatccagtctctgacctccacgtttcacacatcttcagaggttccacaacgtactcctcaaagcgagaatacaagaaagtggaacgcgaaatctgttcgacatggcagggggctgcacccaagatgaagtggtctgaacagaagatagaattctcggaagaagaccaccccaagaccgccgtcatcccaggacgatatccgatcgtggtcgaaccctctattcggaacatcaaggtcgcacgggttctcatcgatggtggcagctcaatcaaccttcttttcgccagcactttggacgcaatgggaattccgcaaagcgagttgacaccaaccgatcaaccctttcatggaattactccccaatcctcgtccaggccattggacaagattacgttgcctgtgactttcggccaagctaacaacttccgaacagagcatatcacctttgatgtcgttgaattcgatatagcttacaacgccatcaacgggagaactgcacttgcgaagtttatggctgcatctcactacgcgtatcaagtgctcaagatgctgggaccgaagggaacaattactattcaagggaacgcaaagctggcgatgcaatgcgacaaacggagtttcgacatggtcgagcaaacacccagcccacctgccacgactgagccacccaagaaagtgagcaagacaaacaagaagccgaaaccggacggcgcaatcaagatcgttccactctccagtgccaaccccgacaagaccgtcaagatcggggcgacactaagcgagaaataggaactcgcgctcatcaccttcctccgtgacaatgctgacgtgttcgcttggcagccgtccgacatgccgggggtccccagggaggtgattgagcacaaactcatggtgcgacccgatgccaagccagtaaagcaaagactgcggagatttgcaccagaccgaaaataagtcatacgagaagagcttgacaaacttctcaaagctggcttcatcagagaagtacttcatccagagtggctagccaatccagtcatggtgcggaaggccaacggaaaatggagaatgtgcgtcgacttcaccgacctcaacaacgcgtgtcccaagaatcacttccctcttcctcgaatagatcaactggtggactcaacagccggctgtgagctgttgagctttctcgacgcttactctggctaccaccaaatcagcatggcaaaagaggacgaagagaagacagcattcatcacgccgttcggggtattttgctatgttaagatgccgtcggactgataaccgcagggaatactttccagcgtacggtccagggcgcacttagcgaccagctcggcaacaatgtcgaggcatacgtcgacgacatcgttgtcaggacaaagacaggcgactcattgattgacgatctgcgggaaaccttcgacaacctccgacgatatcgcctcatgctcaatccagagaagtgcacgttcggagtaccgtcgggcaagctgttcggtttccttgtctctagcagaggaatagaagcaaatcccgagaagatcaaggcaatcgagaacatgaagtcgcccacaagactcaaggaagtacaaaagctaaccggatgcatggcaacactgagcaggttcgtcgctaggatgggagaacgagggcaacctttcttcgctctgctgaagaaacaagacaaatttgtatggacacaggaagccgaagaggcattcgttgcactcaagcgctacctatcaaacccccctgtacttgttgctccccaacctaatgaagaattattcctctatattgccgccacgccatattccattagcaccgtcattgttgtcgagagagagaaagtacaacgaccagtctattacgtcagcgaagctctccacgacgcaaagacaagatatccacagatccaaaagctgctttacgcggtcatcatgacatcaaggaagctacgccactactttcaagcccacagagtcacagttgtctcctctttccccctcggtgaagttgtgagaaacaaagacgttgttggccgcattgcaaaatgggtagtcgagctgagccagtttgatgtccactttgtgccacgaacagccatcatgtcccaggtactcgccgacttcgtagccgattggactatgcctgataacaaatcagacaaccaagtcgacaacgaaacatggacaatggcgttcgatggtgcactcaacagccaaggagcaggggcaggatttatcttgacgtctccttccagagatcaattcaagcacgcaatccatctcaacttcagggcgaccaataacacagctgaatacgagggattactcgccgggataagagccacagccgcacttggggtcaagcgactaatcgtgaaaggggactccgagctagtcgcgaaccaggtgcacaaagattataaatgctctaaccccgagttatccaagtatatcgcagaagtcaggaagctagagaaaaggttcgatgggatcgaggtccgacacgtctaccgcaaggacaacatcgagccaaatgacctagcacgacgcgcgtccagacaagaaccgctcgagcccggcacttttctggacatcctgacgaagccattagtaaaagaggttagcggcgaagttagcccggccgcccccgacattagctcggaggccacaaaggcagaacgcgccgttgccgatattgagaccacagatgactggcgcatcccactaatcaaattcatcaacagcgaggatttgcccaaggacgatacagaggccgagaaaataacccgtaaagcaaaaatctactgtatggtcggcagcgatctatacaagaaagcgccaaacggggtacttctcaaatgcgtctcgtccgacgacggcagacacctcctccttgatatacatgaaggcatctgtgggtcacacgccgccggtcggacattggtcgggaaagcttttcgacaagggtttttctggccaaccgccctcaaagacgcatgcgacatggtccagtgatgtgaagcctatcaattccacagtaaacacacaaagctacctgcgcaagcgctccagactatccctcttacttggccgttctcgtgctggggctagatatactcgagccattcccatgaggacagggcggctacaggttcctattcgtggcgatcgacaaattcactaagtggatcgaagcagtacctacgggggaaatcaaggccaacaacgccatcaaattcatcaaggagatattttgcagatacgtactaccgcaccgcatcataaccgacaacggctcccagttcatcagcgccgatttccaggattactgcatcgggctgggagtcaagatatgcttcgcctcggtctctcaccctcaaagcaacggacaagtcgagaaggcaaacggcatagtactacaagggatcaaaacccgcatctacgacaggctcatgtcacatgacaaaaaatgggccgtacacaccacaccgacaacgtctaacaaggaaacacccttcttcctcgtgtacagctccggggccatgctcccagcaagctacgacatcagagtacacgagtacagaagcattccgacgaggaccaggaggagcagcgaaacgtcgacgtgaatctactcaaggaacatcgcgaacgagttgtcgtccgagcaggcagctatcaacaggccctccgccattaccacgagaagcgcatccgagcacgcatactttcgatcggtgactacgtcctccgacgggttcaaagccaagcagggcgaaacaagctctcacccaaatgggaaggaccttacacgatcacacaagtcttgcggccaggcgcattcaaaattgcaaatggtgatggtcgcgagttggcaaattcttggaacattgaccaactacgtaaattctatgtatgagtcaatatcatccataccagtaagacaccttacagtatcaataaagcctattcttaggcccatattataatcaaagtgttcctgcccgatgatcccttatcctgatgacacctagcgttgaaacctatcctcatgtccctttacgccgtcttgacaaggcctccgaggaacctaagggatcttcggctagggacgcctagagccgataaagacgaaagaccatgtaagatctggtcgtgtaagagttctcgtcgtgcgtattaaccaagccgcgaaatcggaaattaactttccaacttcacggctgggggctaggatctgagcttattcaaccaaggcaagtcaaagtccaagagccttatcctccgagaaaattcctccgacgacaaggctaggggctagggagagtgtacgactcaaacgacggactaaagtcgtgaactgagaacacactcttacacacgacatccggagtaagaaagatttgttaagatagatttcttttctatttcacaaaatactccttacaattttttacacaagtctaaaactatattacacttcttcctaagatatctatcacagggtacgaagactaccaagaaggccaacgccagtccatagactggaagaccttctccgccaacggcgccatcgacttcgccaggtggtctatctccgtctgagtcctccgagaacgagaaaaaccttcacggagaaaatcgaggtccaggcgcgggcgatgatctcgtaggcaagccaacacgtgccctccagcatattagctcgatcgacgacactcctgcttcaaggcctcgtcgatgcgtttgccgacgccatcgaactgagcacaggccccgttcagccacgagatgtatccggccgccgactccttgggatccccacggggtactcggagctctctacaaaccttggccatggatgtgcagcaactcttcaagtacgagttgaaccacacctcacgacctcggagcgtttccacagcctgctctttcttcactgcaagcatggttctctcgagttccactacttcaaactttgtcttccaatattggatacgacgatcttgaccagcaagagcaatctcgagatctgttcaatgtgggaacaactaagtcaagctgtactcctctttcgagaacatagctgatctagtcggaggagcaaaagggatgaatggaccactaacctaaggaagtcgtcgccatccccgtccccgtagctaggatctggtctacattgtctggcgacgcatgtggttcaaacgcgagagccagaatgatcgccggtgactcaggttgcccacgctgctggacattctcgtcatcaacatctctacaagggacaaaaagtactcaaaatcaacatgcaagagtaagctaggataataactgcacgcacaaaggcggttgagatccatcaaagttttacacaacatgtctaaggagtacaagagatcctactcttcaaaaagagggagaacagattcccccagatcgccgacttcttccagcacccccttacgcgtgtcgctagccgccccctgatccaagatctcgcgcagatcgagttcaggatgcgccagcctcacacatgcaaggacgtggcacgccccggtgtagatcccgttggacgtctcctccccgatcctagccgcatgcttggaggggatctcctccatcgccgccgccagctccgcaaaagaagatgtcagcgagaactcatcgggattcgccgggatggtggaattaatgccgcactccccggaagctggtgcagaccagtataggtgacccgcaacgagccacggatttccgacagattgttcccgagcttcgacatgcggtgctcgagcccctgtcgttgtcgctcgttgccggccaccaactccctcatcttcttgaggtcttcacgagcctccgccaactcgtgtgccagccggtcagcgcgctcggtcgccgatgccgccgccaaccttgcctcagcaatcttgcaaccaatgccgcgagcaccagcttcgaggagacgccccatctcgacctggagctcctcccaggtgaggacagcagccgatggaccacgaccagccgcgagatcgctggctgggccacttggtgtcgcctcgcggctcccggggcaagcacgacatccgtcgaggtcacagcgggagatgcgccgaaagtccctccggactcatcttgcaccgccttcgcccgcgccgccctatgagatagccatggttcagacaacgctcgaacaaaagcacgaacacttagattcatccacttacttctcgccatgtgtcacaagttgttgtcgtcgtggaggcgggggagacgcgtccgaggcctggagaacggttgatgcgaagtaaggcgaaattgttctggctgtaagatcagacaacaggatagcttactgagggggtagatgccttgcgacgatgtccgcttacagaggagaacttcctcccctttgtcggaacattgccaccacttgtagtagcagcagtagcagcagcagcatcggatgcctccttggcgactttctctttcaatgacgccgccacctgatggtccacgagcggcccgacgatgtcagtcagaggaagagcctacgcttcataaagtcacaaagtgatctcagaagaaaaacgcagaatgtctattgagtacacttacattgatggcagcgtcgtgttcggccgcccccttctcacaaaggggaacggggatgttactcgccgttgtcgggccactgatcatcacctggccgacacgacgtcccacggtttcattgttcagacctgtaaatcgagaaccaaatttcgataaatcaggaggaacgtgcacacgagcatgtcaagataaatgcaagaaagataccccgaggagaaacccgggtcgcgtcctccggtccggaatagtcaaaggctagatggactcgagcctggagcggctggatccgtctaccaacgaagtcagcagcgatttcatacctcgacaaacctcgtactcggagatcgtcgacaatatcgatgaacgattgaagagaaggggtcaaagggggctttgcggtccaagacaaaatcttgtccggttgttccttagaacgatgaagacaggatccaaatcttcgatctgaagatagaaccacctcgtctaccatttgctgcaagaggaagggcactggaaggggatataacgcgacttcaggccatcccgaagtcggaacccgacgcatccagataccctgttggactccatccaacgcagctcatagtagaagcgaaagagatcaagaaagggctctaccccaatgtaggccgtcacaaagatgtgaaaaaatactaaggaaggcgatagaattggggttcagatagagcaaagaaagaccatagaagttcaaaaccaagagaagaaattcggaaggcggagggagaaaaccgcagagaatgtagtcctcgatcgcaaccatgcgacctaagacgggctggggttcagtacctcctgcttccctttccatggttccacgactgggaagggcgccgtcctcctgaagcttctttagcgacgcgttggtggaggatgatttgccaagatccatcgccgatcggagatcgccggagaaagggctaaggtcgacgagctagggtttcttgtgggagcggagaagacgaagaacgcttgcaggcgggatgttttcttcacagtaggcggacttcaaaatggatccccaaaattcctttaaatagacgcactactgacggtgcgaattccaaggaaaggagagagatggccgccggaaatttctgggtccgttacgcgtggtagtttcttggacttcagtttaaattcactcgtgaccgttgggcttcacatggtgttctcgactacgtcctatctctacggtcctcacaccgggaacaacaacaatctcgacacaagaagtcgcaaatggttacacgagttcatttaagcagaagtcgggggctactatcagggttacgagttaggtataccctttaccctttgatatacgtcgcatatcggtatggcatacccacgcgcatacggataccctccgcatgcattaaggaaatccttcacggaatttacggatggaaagagtcctactcggaccagactgggtcgtcaacgtatcatgtgaggtttgatgtctccgagttctacttggaaaccgcctgacctgcgatataaaagggaccccccaaggaggacctaaggcatcgaatctcagagccaacacaacccccacagcctacaaagtcggagcctgcaggagccaaatcgccggggatttagtcgaaccaactcgactacgatctcgccagatccatcgagttccattgttccctttgtaacctgtgttttccatcatataatcccacatcaactggattagggctattacctatcaaggggcctgaaccagtataatcttcgtcttttgtctgcttgatgtcgtactacgtagacccttgtaccaacgtaccccaataccctctatatccggtctacgggtatcacccgtcgacagccacccttttactttcgtttatttctacgagttcttgctttcgggttgagctgcatcgattcgatcttcaactagaagtaaaacttgttatggcggcttgcgttatcgaggttaatgcttccatctctatgatactttaaccctgtttatgtaatccatcgagttatcatatacatgttgcaatctatgctagtggcgctatataacttgttatcggctggttcttatcgttaggaaacaatcggtagagttatgttttattattaatttagattgtatcatatatctaccatctcttgtagattttcatcatcctgcttagatctcatacttgtctttatgtttaatgctgcatcggttgagttcgatctattaagtagaattcataattgtgatatctagcttgttttatgatcatcgagagagatagtatcggggtttcagccgatcttacctgacttagctttatgttttatatgcttaactaatatgctaagtctgccctttatattaagattttatcgcaataaagtatatcagacttctgtttgatatattctatctgttttaatatctgtaacgtagagtagtatcggagtactagccgatacatgctagatctatctgatcggctatgctataagcgtttataatcttcatgttaatgtgtattttgatctaagtgatttatactatctcggcatggcgaccgatctatcccaatcacttgatttaaatatacatcgacagaaagattatgtagcgttaatatctatagccgattgagtagatttagtcttactttgcttatttacaattgccgattgattcacatgtgacacatcggctcgagaataataatatgtcggcggcggctggccaatcagctatcatttatggattcaaccacggtttttcttgtctctctttctggttgattgcaggatcaaatcaactggcacgctcacgatcctaaaggcaagattttggacctgcactgaagttaagcaaatcttctaggccaatgtatgtttttcgcatcaacagcggctcacttaagcgcccgtaggccacttaaggagccgtatgcgaaaaaaaatttgaaaaaattgaaactagtttatctcactcatatgaaatccaaattagatggtttttttcctaaatgtttctaaaatcatgctctatcatgttattgtgttcttacttctattatttgggtcatttttcttgtgactttatttaattatcaattaaaaatttgaatttcaaaacttcaaataatattttgaagcagtaa

SEQ ID NO: 66020 - DNA, 1950 bp, Oryza sativa
agcatgtgacagaacctcatttagcaaattagcagactgatcctccagaaatgtcattattagacagctaaattcagaattagtaagaattaagggaggagcagtctaagaatgttctaaaaatgcaggcttgcaacaacgtgaggaggacaagaaagtgcaatatatcgctgattaccaatctgggattttctgtattactaatgatgtaatagtagctactgacgtgtggacctggacccatatgtcagtgactgttactacaccaacaatactggagaggatgatatatgccgctaactacttttaggatacttgcatgtcccatttgatagatgaagacaagatgaagagctttttttcttgtgatgtatattagctatggtggttcatctccctcatgggcacattggcagtggttcagacaccattgcctcctttgagccagcactttcacaccaaactgtaacaaccaagaacatgaaggtgagcctccagatcagtgaaaaagaacaagaagaagtgagtgctaacctctgaagtttctttcctaaatttcccctttttgatcacttgcaggttctcttcaaaggtagaagcaccaaaataggcttaggaaaaacaaagaagatgggagaaacaagctgcatatatgtgtggggcccacaagcaagagagaaagagagagtagaaaaagaaaaggaaaggaagaaaaggctaatatgctcatcttttttcatagattatactccatatcagtagtatattgtgtcataaagaataaaagagatatcagactgccccccctctctctctcccctttctcttgcacacaatatcatgatcacactatatttttagtcataggaagagatatttgagaattttgacagcttcctgatcttaggtttctttattgaactgatcttcttttatcagtgggataaaatgttgccctatagctatatttacaaggacaaaccaaatgttttagtatataccagaatcaaacatgcaacaattaattaagtattatagaactaaaaccactttgttaaaagcaaggtctaaattatctggagaaagtaagaagcaacatgtgatatattataatattgtctagtttttgtactaaggtgtgtgttgcaattgatgcaagtggggtgtagcataatccatacaagtaagatgccaagaatggggaggagagactgtgattatggcaggaacatgctcttaatcagtatacagaagtactactactaactacttgcaattactccaatctctctcttttctcattaactgcaatgcataatccgtactatcccgtgcaagtaactcaaaacttaaggcctcggttagggctactaaatgaactatctgcaaatcccgttgttctcccgttgacaatcatatacttagcatattactcattgcttgtttgttagcttatcaagcacatcaaaaaaataaaatttttaaacttagttttaagttatcttgaatcatcgtttattgtcaatattatctttttgaaccgtcaataaaaaatataaaaaattatctatgaactttcctttttctgcttcattcttttttatggcttatcagccatagttcaaacgatccaccgtagctcaaatatcctactactaattatttttcagctaaaaaagttagcttccattttccaaccttacaatcaagctaacacagtcactgtcatataaatagtatactcaccctaatcaagctaaatcttttattttcctaatgactgaactccgaaataatattaaattagaaatctaatgatctagaagatgaaaaccacctcttttctaatcaagctctcttttgtaaccacccaccaccacagccatcaacaccaccaacagtccaacactgcccaattgcccatgctccagacttctttctactcctaca

SEQ ID NO: 66021 - DNA, 508 bp, Oryza sativa
ccacaccaacttttgccagatgttcacccaattgtgggtagtaggtattaaatggagcaacctgttggtacagaaaaggagaaatttgactatagtaaaaggttaaaatcaaagcacagtatgttattaatagcacatcaataagttcagcattggacaaacttcatactttcttccagctgtaacccaacaacctaaaaactatgtaagaataagtttagagcaagtttaatagtagagctaactgctagttataaacccacattagagttaacatgtataatagattagctataaggttggctaaatttttcatctcctctctcttaggctgcgttcgtttctccaacaagagttggatgaaattttggatacttgtggcatgcttttcaaactactaaacggtgcgtttcgtgcaaaaattttctatatgaaagttgctctacaaaatcagattaatccatttttcaaatttgtaataattaaaactcaattaatcacacattat

SEQ ID NO: 66022 - DNA, 1268 bp, Oryza sativa
atacgtacacatgcatcatcgtgtactgtactaaattcacaatacacaaggaataagtaggcaatctaatactctctctgtttcaaaatgtttgacaccattgactttttaagtacgtgtttgaccattcgtcttattcaaaaaatttaagtaattatttattcttttcatatcatttgattcattgttaaatatactttcatatacacatatagttttacatattttataaatttttttaataagacgaacggttaaacacgtgctgaaaagtcaacggtgtcaaacattttgaaacggagggagtatatactatctctgtcacaccaaccgtataaggcataacaagacttgacatgatatccaaactaatctttaaattttaatttcttcgtatacgacaatatacgaaatcataacaataagaaagtatattcaaatgctaaaaaatactccctctgtttcacaatataagtcattctagcatttctcacattcatattgatgttaatgaatctagacatatatatctatctagattcattaatatcaatatgaatatggaaaatactaaaatgacttacattgtgaaacggaggaagtaatatttttgtcaaataaaatttaatttatattagattagtggtcagctaaatattttaagaaccgaatcttaaaatatgtacatatctctgcttaaaaaaatatgtacatatcgtgcattatggggcggagagggtaccgctcattttaatttttttttctcgtggcatagcctgtgccggcgtcacgatcatggccaggccagccagtagtttgattttaaccgaataatgtcgaggacaacccgtgcgattcaattcaaccataattatcgcgcttgcatttgcattggcagagatttggctgattttattattgccgcatgtatcgtgaaaacggtcggaatcggtagcattccttcgaaaacgatgctcgatcgaccggtaattaaccatatttatcatttaaactattcaatatcaacattaatatggtacagaaagaaattagaaaaaataaaatttaaaaaatagtcaaaaaaacgttatgatcggaactcggaaacgatactccttgaaggaaacggcgcccggtcgatcggaatctccctgaccgttttcaccccccaccccccctccccccaaatcgatctgctactgaatgtacgtgtacgccgaaatttccattccttttttgcctttttattagctagctgtccacgttca

SEQ ID NO: 66023 - DNA, 821 bp, Oryza sativa
ccttacatgtgccatattttggccaacaaccaacgttggattgctagagctatcaactcttcttgccatgtctgaaactacaaaacccatttatcctatcttactataaagttatcccccactaactccttaagcttaacatgcaaagatgccacatcatcatctactaatccactaattaacaagatgtcacatcatcatccactaacaatcatcacatttaaacatcatgcaaacatgctatatatttatagtttttataatttaagagcttttcaaatacaaacatgttaaattatcattcaacacaattcacataatgtttcaatgtatatttttattatgttttatgatatcctatatacttatatagttcatcctcacttagttagtgcttaaatgattaatctatggtccaaattatctttctccttttttcctctaattaagtcatatcacatcaattatttttagcctttagatgattaatttacggtccaaactatctccctacttttcttctttcataaagtcataccaccttactttttacgtttgaataaccattctacatactatttaaatttaaattatcataaaccacattaatttacttaatctgatgttatctagttattttacacgttattttttttgttatcatattaaattcccgcagcaatgcgcggggtttcacctagttattactatgggcatatttggtgcagctccagatatagcaacatctctcttggatcttaagcctaaccaaacaaaaaaagtttcatctaaattggagtggagctggctagagcgctctc

SEQ ID NO: 66024 - DNA, 2938 bp, Oryza sativa
tgatatccctctctctctctcacacacatctctttttgcaagatctcttcttgttcatcatcttcttctttttttctcccccttttgcttcaccaatccatcttttgtcacgagatgtggccgagctgaagctagtagtagtggagcagcgaaagcaagtacgccaagaaaaaaaaaaggaagaagaaagaagaaagaaagaaagaaaaaaacgccagcttgagggcagagggcaaaagcggcgacgaggagcagtggccaaagctcagattcttcccgtgggctatttttaccacccgcatcccctctctttgagccccttggccgattcattcaccgacgcaaagatccaacccctcttcaggtgtcggcagatgccgcctttgtgaggtttccagtggggggatttctcgtcgtttcttgcgtgcggttgcgttcttgatccagtgagcgcacggatatatccgccctggtttagtagagagagagagagagagagagagagagagagagagaggttcttgattgagttccaagtgttggattgggttcttggagctgttggattgggtttttttgggagagagatgggggtttggaggtgtgtgggttgaccgaattggatcaagattattgcgggaggggggggggggggttgcaatggcggatttggggctgtggaagcaagggtggaggtgggtggtgtcccagaagcacatcctgacatgggcgcacatggcggcgagcggcggcaccgagaggctggccttcctggtcgaccggcattggcccgccgtgtcccgggcctgcgtgagctccggccgcctcgcgctcgccgcgctgcggcaatggcgcggctgcgcggcgcgcgggatcctggagatggctagcctgggccctgcgtccgtgttcgtcatcctctggagcttcttcgtgtgcatcacctcgccggcgtgcgccctctacgcgctcctgggcatggtacggcatgcaagtcttgcttgctttgcgctttcgccttgatgatgtagtggattatggataacgatttgtgcgcgttctaaatcttgtcatgtgctcgtctttctttttttcttctttttatcaagggtggattgcatgttaggttacctttcttttcgaaaagtatagttaaagtggtaattggtggtacaaaagtagtatgtcattacactttcatgagattgatcagtttgatgtgtttctagattcatttatgctttagttattgcaagtttatactacacttcagtaattcacacgtgctgtttctagatgttattttggaaccgttcacagtattttaagcagagaaagttttatctagtttgtcttgctagaggaaggagcacatggaaactaacacttgcatatttagggataagcactactggttctattcctattttgtgtatgttagctaatgtgtttcttgctgagtggttcagtttcaggttcattagcagattatcttattggttgatttatgtcaaaatacttaaggtcaattcgtagtttgcacagtgtacttcaataacatgaatgcaactcgtttctttgttcagcctgatatttatgaaaaatcttataatgtgatactgtgtttaatatgtatgaacctgtctagagaattactagctagtgaaattctacttgtttcatttcacacaaagtcaactatgggtagactggttcatgaccatttatttaggctctggtacacctgtaactactgctgtagttgactatatgacttacttctgctggttttctactgtggtatgagtttctccctttgggataccacctgtgttcagtggaatgtcaggtagtatctgaccttttcagctagattgcactggataaattatactgaaataagcaataggaatgaattccaggactatgtctcctcttgttctctccttgcaattcctcttattgcaatgcagactgaaccacttgtttttactatcatctggcatacttgttcagttagtaacttctacttgcgagtaaggatgcaagatttcccatgtaagatggatactataaatatcattttgtctaattgcttaatacctttcttttttcagggagctgctggggcagtcattcattacatgggctatacgcctggtcttttcattgtaggattatttggaatattgattatgtggatgtatggctatttctggattacaggaatgcttctgattgctggaggtttgttttatcttaatatttaagtctgttcataatgataattttgtgtttttgtttgtcaaatccataaatttttcttcctccctagttgcatccgtttgattcttttgacctaaaggaggatcctctctggtaatgcaggctgtatgtgctctttgaaacatgcacgatttgtgatacctgtgttggctatgtatgctgtttattgtgtggctgttcgtgttggatcgcttggtgtcttcttgacattgaatctttctttcctgacaaatgatcttctgaataagttgctgcaaggatacgagggaagcacagaagaaagacagtttgaagagccaaaacattctgatcctgtcatggatgagttctatcgcagttgtgaatttccctctgctcctgatagtgaacctgagactgtttcttctgcaaagcccttttgctcaacacccgtccaggatgtgttgcatgtacagaaagaggcatctcctagcaaagtagtgaaatcggattctgtttcattggatgagatgaagaggatcatggatggtttgacccattatgaagttttgggtattcctcggaatagaagtattgatcaaaagattctgaaaaaggagtaccacagaatggtaataaaccacggccttctatacaagggaaaatgagaaattcatgttacaattacttcatt

SEQ ID NO: 66025 - DNA, 1668 bp, Oryza sativa
tatatatatatatatatatatatatatatatatatatatatatatatatatatatatatatatatatatatatatatatatatatatatatgacactcatatggggcaccatggtgcccgggcaccatggtatctaatgcacaaaatcactcaaatttttcaaaattttcaaattgtgagtatatacctagttataataatttgattcatacctatacttatcaacaaaacaactcaaatttaactttatttcacactccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatataaaagctttattgtacacccctcccttagaataattattctacaccccctccactcaactcccccaatccggcccagcccaccccacgcgcgtgcctccctcttcagcccccacgcgcgtctctccctctttttttccttctcttcctccgcgcgccgatctctctcgatctctccctcccttctttttttttctcttctccctccctgccgatctctcttgatctctccctcccctcctcccgatctctccctcccttctccttttttctctttaaattggtaaattcaagactagaacacatgatctcatggtataacaaactctcctaaccaattcaccctataacactatgtgatttgggatcattgtttgctttctctatatatctgttcagattttatgaacataaacctgttatgtttactgtaggaatcataccttgttactgtgattcggtagtaatattatcgcagaagtgcagtaacacgatacattactgtgaaatttataggtcgttactgtgaaatttataggtcgttactgcattttttcaataacattatgatgaaattgcagtaacagagagcatatgatagtaacggtactactacagtaccacaacttgtgcatagcaaaagttttaaatctcaatcttgtgcaaaatacaagtgctaaaaaagtgcatgtgcatggtcacaagttaacacaagtgctaaagtaattctctttacccatacaaagatacatacatagtagcaagcttagtacaagtaaacttttataattataatctttaaacaataatatctcttacatcgcatattattttttagaatcgttttcaccataatgctttaaaacgatgttacagcgagacaatagtcatgttactacacaatgatcgagacaaaaatgcttttataacattgttactgtagaaagtagtcgtgctactgcacaatgatcgtcgcgttactatatcgttccagcgagacgagaactttaaaaaagtaaatctcaatatttagagagtaatatctctcacgttatatagtatttttctaatccgtttacaccatgatgttcgtaaaaaagtgtttaacaaaactagatccatcatgactatttttcga

SEQ ID NO: 66026 - DNA, 1845 bp, Oryza sativa
cacaaaagaaaatcccaaagatttctcagatctaagcactcccccagtgagtgaactatcactaccaccactagctcaccgctcactctccaagaaccgggtcaaacaagcaaaggcacccggaaaatcccaaacccccaaaacctcaaaaccagagagatccaagaactcctcaaccgaggcaaaagaaaacacgaaaccctccgtcgatctcaggataatccggggggttttaagaggggttttagctttgaggttaagggcgggaaagggagaggagggggatttgttggctgtgggaggagaaaggggtaagacgaggtggaggatatatttatggcacaggtggataccactaccactgtagtaccactgttcttgatcttatcacgcttggggaaattactgttttgcccacctgctaggtccagctggaccgcgctgagagtgaaaccgagtgcaggggacagtgtgggcttcggttcatgtgttcagtggaagtttacttctttgcccctccctgtctggttcatttattgttttttttttatttcccaaaagaaacgtgtgtggttttgaatttgaagttgcttgaattcaacttgatgatgtattgatgttcataaccatgatccttcatggtgtaataataaaatccacttcaatcaaggtgtacttgttagtactcctgtttaaaagacatgatcacggggaagtttcacatgtgctcgagggattttccgtgtgcttcacctcgttttttgatggcttgttcacatacaatggcttgaaacttttgtgttaggtaagtgactggattggcatgattggtgagtttacaataaaataattaagtgacagttgtttctttttttaaatactatcaatatcgtaggctgaaccggtaaatataattaacgaataggtgaaaaagttatatgtgtacagcaagtcaataatttcacgagtaaaatggccattagtgcaaccagaggcacaagaggcacaagacccaaatgtacttctactaagaccctgtttctttcagcttggtattattataatctagattattaagccagattactataagctatattgttataatctgtagtagaataagcgactagttgtttttttttctaaattattatagcctagattattgggtttgcaagtctaaacagtgagtggggtggcatggtgggtaatttttcaccaataatctggaaaaagcttacctaaatgagcttatcagattataataagctgggctccagattataataagctacttcaataagttgtgtgtttctttcagcttactcccaataatctggattataataatcccaagctgaaagaaacagggcctaaataattactccatttttcagttcttgatataacgtttgacttttcgtcttatttaaaaattttctatgattagtatttttattgttattagataattagataataaaatatgaatagtattttatgtgttactaattttttaaaaaaaaattatataagacggatggtgaaacgttggacataaaaaactaaaaatgaagtcagacggagggagtaactatcatcaaatataaattctttaagccccatcgttttgcttatccttatacttatccgcaccacttattagcaaattaaaaaaagagtagttttgtagcaaactgaaacatatgtcgctattgttgtagcaaaccgatagttttgtcactaaaattgtagttttctaaaaattactaaaaaaattgtaagtaaaactttcatacgtctccttagtggtataatagcaaatgttgtaaaataaacatgatg

SEQ ID NO: 66027 - DNA, 707 bp, Oryza sativa
ttcctgcacccctgtttgacttagtgcttatactcatataagtcaaaatttaaattttacagcttaatctgaatttgagcttttggttttctggtcgtagtttattttaccgtatctgtcttttagacactaatgacacgtatataaaaacttcacccacaataatcttttatatcgggtgtgtttagttcacgcaaaaattgaaagtttgattgaaattgaaacaatgtgatggaaaagttgaaagtttgtatgtgtaggaaagttttgatgtgatggaaaagttggaaatttaaataaaaagtttgaaactaaggctgtgtttagatccaaagtttttcagtcctttttccatcacaatgatcacatcaacctgtcatacacacaatttttcagtcacatcatctctaattttaaaaaaatctaaactttacgctgaattaaacacagcctaaactcggccatgataataaacgattgggataaacatataaataagaaacaacgagactcttgatgtaccaagccgagtctgaagaagagaaaagagagagagttcagaaaaaggaaacgaccctattctgatcagaaaaattcaatctttctctctctttctctcagaaaaggtcgagagagaaagtggatgtcttcatgtgaagaccagagagaagacgagaggcgatcgcagtggagtggagtgaagtact

SEQ ID NO: 66028 - DNA, 6098 bp, Oryza sativa
atatatatatatatatatatatatgaaaatcgctagtctataatagtagctgatattgatcgacgcaatatcatgactagctacgaaaaattacgttctctttgttctaaaccattggaagaacgtcattaatttacgaccgaagagcagggatagatatccatggatgaacagaggaactcttttgatcctttgaatggatttcacctcgtttgatcaaacaccatctaactagttactccatattaaaaatatatattttaatgaacagtctaccaattacttcagcttgcgcattcaaaacacacacacacaaaaaaaaatttgaaacaccattacttagcttagctgtgtatgcatgtaccatgtaccatagttgtccttgttacctggcaaaagtccttgcagagtgccattgttattgcacaccaactcaaagcagcaagagagccatgcatattaatggaccatcatatataaaatcccagaaagaaaatcaatagatacaagctgctggggtaagctgtagtacacatgcatgcagatacagtaccacttcaatgtccttttaaaaagatatgttttttttaaaaagagagacaattttctcaaatttcttgtatacatttaaaatcttcctgtaaaagtggaaggccacatgcatgcatgcacatccaaataccagatcctcttcctttttcttttggaggttacacaaagtacacacttgctgttacttgtcatatatatgtacaccctgagcagtattccttctttctgctgcagtgtgccatatacatatatgcatgcatgtggcctaaacatgtacaggtaagttaatacatatccacaggcaaaaatatataccaaagggataagagatacacaaaaaaacgaaattgtaataacacataaaaccacaaaaaaataccgtataaacaccgtacatacagtcccttacacacagcctgtgtgacgattgttttcaagttttaacagttgagtcaattctgactgtagtttcttaattttgacggcttaattaactaagaaaccacagtcagaactgctatatgtattatacggattcatggtagtaataataaattgagtataaattaatcagtactaccagtaatagtaataattaattaaaagaagggaaatgcgcctccctgaccctggctgggaaggtcgttgacccagccgaacttctccatgtaagggttgaccaagttcgccggcgggtagtcgtggatgcaatcttcccaggcgccggcgtcggcgaggtccttggtcaccacccagtagctgctgttgcacttgaaccccgacccgaaggtcaccatgagcacccggtcgccggcgttgagccgccgcttcgcctccatgtaggacagcacgtaccagaggctgctcgccgacgtgttcccccaccggtgcaacgccatcctcgccggctccacgtcgtagctgtccagcccgaggctcttcctcaccgcctcgatcaccgccgtcccgccggggtggagacagaagtggtcgacgccggtcttgaagttgatcttggcggcggcgccggcggcggccttgcggcggagaagcttgcggaggaggaggcgggcggcgaagcgggcgagctcgccggcggggaggatgcgcggcgccaggcgctggaggttctcggtgaaggcgcgcacggcggccttcgggagcgccttgctgaggctgaccccgaggcggccgtcggcgtcctcgcggtgcacggcggcggcgtgggcgtcgtcgtgggcgccgatgtgcgcgcgcacgaggcagcggagctccatcttggcgcgcgaccggaacgccgggtcgttggtgagcagcgcggcggcgccgccgcaccggaagaggcagttgcccagcatcatggacttgtcggtccccgtgtaccagttgggggcgcacgactcggaggtgaggacgagtgccatggtgcgcgggcgcgtgagcatgacgttgcgggcgaggtcgacggagacgagcccggcgctgcaccccatcccggagaggttgtacgccatgacgtcgtcccgcaacccgaaccgcctgacgaccctgtcggcgagcgacggcgagggcgagaaggagccgacgttgatgacgagcaggtcgacgtcgcgcggcgagacggcggccctggcgaggacggcggcgacggcgtcgtcgaagaagtcgtccatctcgtcgagggcgtcgcgcagggtggggcagtcctcgcgggcgtcgaggacgttgcggggggagtaggtgtgctcgccgatgccggagttgacgatgaccttgaggaggaagcggtactcggggaggccgaggcgcttgttgcgctcgatgatggcgccggcgagctccgtcgtgaccttgcggtcgtcggagggcttgtggcacgcgtagtcgaggaggtagcaggtcgcccgccgccgccgcgccgccgcctgccacgccacccacgccgccgcgtgcgccagcagcagcagcgtcaccagcggcagcaaatccattacgtactactgataccgtgatactccacgtacgtgcaattgtggaagaaaatgcgttggatcgtggtggtgtgtggcggggggtggaggaggtatatatagagtggtcagtggtggggttggggttggcacgcgagaggcgcgacacaacggctacgtattcttctggggggcggacggggagttttggagaaaaaagcgcgtgacgatgcatggatggatgggcgcggatctgtacgggcggtgacccctggatttctcatgtgttttgctctctggtcgatctggtcgtatggcggccaacgcccaaccagattggtcgctcgctgcagcctgcaggcaggcgcaggcagccaatagttacgatagaaggctataagacgaactgcaaacatattttaaaaatataaataaagagagagaagagagcgagctatagatttatagccagctgtagcacggattaccagacacaatgtgtgtatgacaggtgggaccaggtattaatagtgtagtatataactattgtatgaatgagctattagattgactatagatgaattagagctaatagttagctatactagagtattaaacttgctctcacggagtattagccattgttcgagaatcgagaggacattattggagaaaattgataaagatgcaaaactagctgaaccattaacttaggattaatctagtattagttattttaaacttggaaaataaattaatatattttttaaaacatatttttttaaaataaaatcatactccactatttaactgttcgagaaactttcacgttaaaaacgaaagggactgactatacatttgtcgacaaattttctcttaaaactttatcaaatataaatataatataattatattataattacactgtaaatttatttttttttcactcaatctacttctgcccatcacagcctaattatttaagttttttgcctttttgtcgtagttaagctgcatgccccgtgcgagccgtgcacagatcgaaatgaaccgaagtacacacctctgctccatctccgtccgtccgtaatccaaacggcaccaatccggccgcagatttctacaccttgatgattgatacgacgctaatgatttctatattcccagttttcaccttcaacttttaccggacacacacgtgacgtacctgacgtacctgatcgatgtacttgtgcttaatttttctgcttttcaccgtgcactcacctgctgactgatgcacacagctcacacgagattagagagacgactttcccgctaactctacgttcactcatatttaaattttttccaaagttaaattttagaaaattaaacactaaattagttttattgtatctaacattaaatatattttgataattcatttgttttatattgaaactattattattatattttataaatttgataaaagattgactaagaaaaaaaaattcaaaacgactctatggaacggtgggagtatgacactgttgctctcaattatatatatgctctctttgtccctaaattaacatacagtacgttaattaacaccgctcatgctagctagctagctagttgcgcttcttcaatggatcaacgggacaacaattctacgtgcgcatgcatatatattggcagaacttaattgatctctggctggttatcacgctactatatgtttgggtatcggtagtttttttggtaccggtttaaaaaccgttacttctttttcacagccctgatgaggacattaatttctttcttggcactaatgagggagctcactagtgtctgaaataaaattgcaagagtaagaaaaaaaaaacaacgtctcaatcaatcggttttgaattcattaagtcaatgcttagagcggccccaagagaagactcacatacatatgccaggaatagatcaagaattcttcaacagaacaataatttcaatatcaaacagattaatactccctccattttttaatagatgacgccgttgacttttaaacatatgtttaaccattcgtcttattcaaaaattttatacaaatgtataagatataaatcatgcttaaaatactttgagtgataaaacaactcacaccatgataaattttaattacgtaaattttttgaataagacgaataatcaaacacaagataaaaagtcaacggcgtcatctatttaaaaaaaacggaggtaggaacaattcatccaacacgttatattgcagttgacgtttccgtacgttcctcttgctgtgagctgatctccgcacaagtacacaacgataccggcttcaccacatgcaggctcgccgggttttactgttgccactccactccacagcagtttaccatcgtgccctccttttccccttctcctttcaaacgcagggtcgtcgtggctccaaagctccttccattggatccgagcagatggagctcaggagccaccggatctactggcccctatatatgttagagatgaaatggagaggcgtgcgagtgcgaatgagaggtaggtacgaatgttataaaagttagtcgatatagtggaaagacgactaaccctcccgatcgcttcagtcattgatgacccaagacatgccagatgacgacacaggaacacatgatatttgttaacgaggttcagccgaatcctacatccccggggctctgattatgggcgctcctccccaaccaatatagctcctagccgctacgagtccatggctacgccgccatcctctccctgcgtgtctatgctacattgtagtcgccattcttacattgtggtgcccccctctctatttaagagagatgacgggttacagagtccgactctaactccaccccctaacacctattacaactccaagtccaactgtaactaaataggactagtatattcgacacctattctaacaacgaagacaaaagggagaggctggtgtccatcggtgaaagaataaggttgtttagagaggagatggaaatagtgatcgaggagacaactgaaccagcttaaagatctttcatcgatcgagagagcaagggggctggtctttttggctaaccggtagatgtggtgttccgtggaccgtgcatgatgtatttttgtcaagaccgtatgtaagctggatatatctgtgtttatgtatatatgtacatatatttagcaggcacgcacgtagtaaaaatgaactaattaagacctgcatatatatacgtatgcacgtacacaacgcggtcagatattgatggcacttgacagtaagtaggtggagataacattgaattaattggaaagtaataaggcatgtgcacgactattaacaacgtgggcttacggcgagctccctgtacatatatacacgcacaatgcatgttacctgctgcgatctcccacgtctggctagtactgtattactgtattcctttcaaaatttatcacttgggtacgtgtaggaacagatgagctagctagctactccctccatcccataatattgcaacctagaatgggatg

SEQ ID NO: 66029 - DNA, 5313 bp, Oryza sativa
ggtgaactgtcctcatataaaacttattttattttgttttcaaaacaagtataaacgcagaagctcatctgcacgtgtgcacacactgaaccttatgaaagcacaccctgtaaatttatagctatgaaagaggacataactgagaaaatattattcgcttgatttcaaacaaccaccatcgctgtctaatttttttaactttgaccataattaaattttaaattattatatcattatgtatgaaaattttcaggactggaatgcgacctatttcgttgacatgaaatatttttcagtatttatatattctcttcaataaaaaaaattcgagcagacaatggtcgaagacaaatgggagtcctatctaggagtagcaacaagtatttaaagacggacataccagtgagttaccacagagtatagtgctgccgttctaaacacaacaatatatgtgcactcaaacatgaaaaagaaaattaaaaaaaattgatatgtgcaacataatgccatgtaccatcattaaataaaatcaactcaaaattaaatttacatatatacaaagaaacacagattaatttcaggctcgaagcggtgcacaacacacaccacatattcatcccaaaggaaaaaaaacagcacatattactgttaataaaaacacatttttttttatttttaccagctacgttcaaaaatacttcatctctggttattcacctcacaagtgcttgtccatgtgcatattcatagaaatccttttagaaaaattggtaatatatcaataagttgtaacacgtcatataatggcatagttccaattttccctatccgtttcatgtatactaactttgggacaattatctatttgaccctactttgaagcttaactaccaatttgacatcgtttttcccagtttgcttatttgacctcgtttttcaaaattgaagttaccgtttcaccctgtttccaaaaaccgtcagggttccatttagaacaaattaaaaaaaataaatttacaagcctaaataactaaaatgcccttatttactcatttcttatgctctgtatcctctctcaccagagcacaaatggctggaggtgcgacggtcatcgcggctgcagctgcggcggctacgttggctccacggcggcggcacgatgaggaggaccgccagcggcagcggcggctgcagaggggcgacgagggctggcagaccatcgcagtggttgtgtcagctcggggggcagctgggctcgacggcagcggcgcgacgaggaggaccaccggcagcacgacggctacagaggggcgaggcgacgagggcaggaggaccaccggcggcggcgaccgcggcgacacgcggtgggagcagcggcggaggcgataaaccacggtgggagcgcgacggcagtgcgtagtgggaacagaggcggcctcggcgatggtggggagcgggagagacggcgtgagcggcgaaggggttgacccgcggtgggagcggcggcgacggcgtcggcgtgcggtttgagcagggacggccgtggcgacggcgggagctttggaggcgccgacccgcgatgggagcggcggtgacagcgccggcgcacggtgggagcatgggcggtcgtgtcggcgcacggcagtgaccgcgtggagcatggtgtgggagctcgttggcgcgcggaggccaaatggttgccgacagcggtacatgcgagggcgggcggcggcgcgggagcttgtcggcccgaggaggctgggcggcggcacgagagctcgccagcgtgtggagggcagagcttggcggctcgggagcacgccggcgcgtgaaaaaaaaaatgttgaataaacaattttagaaactagggtcaaatgagcaagggtataaacgtctatttttccctgaagttaacactgttagcttgcccttcacataatacggttagatccgaccttcattttttaaaataagggtcaaatgagcaaacttgaaaaattagggttaaattggtagttacactccaaatcaggggcaaatacgcagcaaatacgcaattaccctaactaactttttatttttcatgtttgagtgcacttgatgtatatcggtgtagtagcacgcgcgtgagattctcaccgtcagacatgacgcacctcgactttggggctgttcaaattgatgacagtttcaaccataccattatttggtaaaattgataattatgtggttatatttagtttgttactaattattggcaatacatatagaattttggcaacactattgaactaatcctaccaaaattttgacaatgttattaatttgccaaaattttggcattactaaattttggtagcgttcattttggcacaaactgaacaaaccctttattttaagagcaagggttttgtcgaatgtttatttaaatcaagattgttcttaaggggtgtttagatcccaccccaaaattgtacgctatgtcacatcgaacgtttgaacacctgcatgaaatattaaatataggctaaaaaataactaattgcacaaattgtgactaatttgcgagacgaatcttttaagcctaatagctccatgatttgataatatggtgctacagtaaatatttgctaatgatggattaattatgcttaataaattcgtctcgcgatttactggcagattctgtaatcagtttttttattagtgcctgaacaccctatgcgacaccctatataataaccgatgtgacacgccaaaactttacacccctggctctaaacaccccctaaatgcaactagtgcatgtgcattcatgcataaatatcacccgtaccacaggcgaagccgacaatgaaactcgccaatatcatagggtgctaatgccaccatctcaaaataagcaaacttttatatattatcagattcatacataaaaactagttaaaatcaatccacaaatcttatcgattttggatcactaaatgtgctttacgatccgtgctctagacccttctcctctatatctgatgacctcatcttcttctccagtgtcagtaacgtcccaaactctcacggaggaacagattaagatcctaagttggaataggggtgaaaggggatgggaggaggaggagttcaccagctttaaaggatgaccatgagagacgctgtacgatggtggacgcgcggcagaacgggccggtagttagacggcgacatcactgttgaagttgtaggggtcgatggtggatgttgggatggtgtttgcgacggggataaagtggggcgaaaaggttaggagacaatgacccatggtggcgaatttggtagcggggagtcatcggagacgaaaacgatgagatgcgggtatatcgcgggcgtcagctcgaggaggatgagaggtggggaatgagaagaaaggagagggaaagggaggccttaccggcacggcttgcacctttccggcgttggcgaggaggagaagggatcacgaaaacggtgttgcatagtcggtggtgttatgcaagggaagtgtgacacacgctacaaatctcaagacaacttcaacagttaaaaattatataatttaaattaggattttctgtcatgtcatataggtactcatagtataaagtgaacatcgtgatgaactggatcgagaaattaggaattctgaaagaacgaaaacattttcggataatcgagatcgttaattcgttatccactagaggggacgtacgtgcatgtaaacgtggaagcgcactaggcccgtcgtacaggagaagcacggaagctacggaagctggagcagtgcattaacacgctccaattacttctcgtgtgggtactaattaaatacggatcagtactccaatattaatagggatcgatcaaagatcacacggcacgtacgcgcgtaccctgcactgcatctgtaccgtctggcttgggatgccctcgatccatgcatccatcgatcgatcgggtccggccggtccggactgcctgcttgtacctgcacaggatatatgagcagtgactgtaactgtattggctacaaatgacctggccggtttcattaaccctcccatcacatgtgaatcagtaagtgcgtattacatgtgcagtagtaaaatcgatggcgccgtgttagaagcccaaaacaaagcttgattttgtctctttgtaaccacattttcggcacatgtcctgaatgcatatatattatattgatatatatcatgttaagatgtactggtacgtgctttcaagcctaattaacaatgatacgataaaaacaggtgtaagacctctttacctactccctccatacctaggaaagcttataattaatattataagaatttgctggttggtaacccgtttttataatctaaagaagtttgattttttagttttctttaagtttattttctgtattctacaactataagtgtttatattaatacttaatttccattccgaattacttacatagaaccattatatcaatttttaagatgaaatatggagttgtgataaattatggagctgcccctattaattacaacattagtacgcctttgagctggaggagtggattacaataaaaaagcagatgcattgataaggcgcagagagagaagatattagccaaatgttttgaaacatgggaatgagaggtattttgaaaaaaaaaaggaatgtaatttgagaccgacggagtagcatttcacaattcctttttactaatttcacatatatgtattcatttgggctaaaaaaaattaataatttgccactagttcacatcaccataattttttgggcaaacacgattaattctcatggtggagttataggcatataactctattcatcaggattgaaatcctaatatctaaaaataaattgcgtgtatttttagttggtgcacgtattgaaagtgatactccatatatatatatatatatatatatatatatatatatatatatatatatatttgcacggtcttcaataatatatttgactataaatttatttcatgttatatccccacaaatatgaaattaccatcacatgaaagtaatttaaaatataaatctaatgatataataagtataatactgttagtatgattattacttaaaagttattgagtttataatttaagacggaaggagtattgtcattattaataaaaaaccgaaaaaaagattgaggacacaaagcactaggatagccagcaggtcagccatgtttgagaggactctcgcggtgcatgttttcatggatcgggggattaga

SEQ ID NO: 66030 - DNA, 521 bp, Oryza sativa
atggttgatcacttgacctcagttaaccgagcgaagtggactcttttacatccaagtcacgcgtggctagatgtattaggaaccgtttaactccacaagtttggactcaaatgagccggcgtgagcatggagatgctgctcggaatgctctttctagtgaactctaacaggcaggtcaagccttatcttcccctgactaatcactttgtgcctttgtggtcggctccaatacccttatctttcctaaccgtcttgcattctaaaaagatacgcatcctggcagtgtatcagcttagctgtatagttcgttgtctggaaccccgggggtaacgatgttcgttagccagtgaccaatgaactataaacacgatgccatgctggtcctgatcaactcacaatgctgctcgattcagtcacatgcatgacatgcctgttctactgtgagtatattttcttggatgatatgtgctgaatccagcagatcccatccgtccgcatgacatactgccaatttctagaaa

SEQ ID NO: 66031 - DNA, 7360 bp, Oryza sativa
catcattgggtgagggcgacgacttgaagctgaactgcggtagccactaggtgaaggagagcactgaatgggggagaatcaatctagaatattctcatgggagagagcaaagcacactcatctgtgcttaataaaattggatacaaactcatccttagatagatgggatgacttggcacttaataaataagctcctactcaaaccacaaaataaacctaagacataagaatccaaaccaccaaaatagcaaattaacctattccctaaaggaaaccaaatgtcatgtgaacagtgcaccgtgaataatactgtatgctacagtgcgccgtacgggtactgtttctctgggaggccctatcctctgtattagctctttccctgttattatgcgtcgtacagggcctcccaaaaaaagagactttacaaagtaatatttctttgaaatacacctgaaaaagttatcacactttgctataatgctattagaagcctcttgccattttattgtttttctccaattctagcaggtctattggacatgatacctctggaattatccaaacaaaacatctccttctgtcagctcagactttgtagtagctttttgaaagagccaataaatcaacatcatattggaatcgctagagatttccactacctagattgaacagatcacaatatggcaatgacaaactgcctattggatcctcacacaatgcatatcaataattatggctttttttattttaaatagaaattttattgtccttgaggtaccaaattttagaccagaaaatgtggaccgtaaaaccactctattctaaaagattcaacacattcacaactattgctttcaaattcttcatagcaatcatacatcaagaagtattgcaaatgtgagtgccaatttgcagtctattttttttttgtaagtaaatgaaatcatacatgttgtatcaaaattagagaagactatgtaacatgccaacataaatggacgcatataaaaaagccactaacctcccaagatccaattcttagaacagaaccagggaaattggaagccttcaatttctctgaggcactagcggttccactatgctggacatctttggccttaccagcctgcacaagcttcatttggatcaaatccaccagagaggggctcttcttcagccgcaagcccaatgggctaggctcatcaaggaaaccatgttgggatgactgttgattggacacactaccaccgtctgtgctccagtgctgcatgacaccatgagaaaacacaatatatgattaaacgcggaacattaaagcaaggtaaccaatagtatatctcatttctcacttttaaatttgaactatttgtactataagaactaatttacaatttcatagtacaacgttatgaactaatatataacatttacttttccaatcaagttttatgtactaagtggcaaaaaatggaaaaagtgtgtttctcagatagggaaaattacaatattcctgtaagatcaattaactaaacacaaaaaaaggattggttcatttgttagatggacagaggaatcagtaacagtaacggagaacagagctctataagtgaaaagctcagcatgccaattattaaatccaaatgatgaatgcatgtgattagaagtaacaatatcataggaagaacggaaaccagttccagtaatgcaccaagaaagatttgtgatttgatttgaagcagcacatcttcagatcttcttgtgtatttatgccatttacatgcagggaaagtatcaggtgcaacttctcaattgggcggaaacatgcaacctatttatatgcaaatagcccctatcttgcgatgttgttcagaatgtttgcatgacaacaagtgaaaaggaacaaacagatatagaaactataataaagagcaaatagatataggaacagtaatttctcccattgctaaaagaatattaggtgaagtacgcaaaaaaaaaaaaagattacaagcaaagaaaagcaaccaatgaaaatgatagatcagctttttaaaaccaaagcagcattaatttttctgaggtgaaatcaaatagtacagctactggtttcgcacaaacacacacaaaaaatgagaaaaggtccagcaagtgggctgctccccagaagattagacagatcaacattttaatgttagtaataagttttaattgacaggaaaaaatctaaggtaaatttgaattcacgaggagaaaagctaaagtaaagtttaatcactaccaatccaaatccaaaaaggactctgtagtatgaagtgaccgccgatggagacctgtatagtgagagacataatacccaaattggaagactccgcacgtcaatatctaagccaactatggatggataaattggtaatacaggtaaatatcttggctaggtacagaaatcgaatcttattcgaaggagtttgattggataaagtcacaaataccctttcacttggactcaccaagttcagaattatcatctaatataatgagcaaaaatgatgaacaagacaaattgcccacggaaaaaaaaagaaaaggatgtatcatgcgaatcaaactttgaactaataatcatttttgttttcggaacgaactgagccaataataaattaacagcacggcgagaaaatgttaattgatcgtcacttgctcgtacgaatttcttcaaaacaagctgcccctccggccgctgagtcacaaaataatactccgctccaataataaattactcatcaacagtagtactagaaatagtagcagagagaataaatcaaattcctcctgtatgcggaatttcctcctagagaaacgagaggaacaccgaagcaacaggaaggagagcgaacccacctgtagagcaaggcgggacctcttgtggaacggcgacgcctctgcctgtgccgccgcgtcgccgtcgtccagcgcctcctccttgacatcccgccgcagcttcccctggtgcggcagatgaaccatcgtctctccgccgccggcgtcgttacttgtttcccaaccagaagggcaaaagagaaggaacagaggagaaaatactctcttcttgttcagttgtggtggtttctggtttgtttgtaccgtacggagagcgagagtgcgagacaaaccagcgagagatgaagcaataaatatctcggagatggtaaagcactgatggattagattggtttttcgtttcgaagcgcgtgccaactggatctggattttactctagtgtgtgtggtactgtggtgctccaccgcgaatttaccagactgcccccaccttcggccctgctgctttggcggcttatccgccaccgtagtctattgatagttaatgctcctatatcagtagtcgtatttaggatctatttaagggagtttttagctgctgcagctttttttaaatctccaactcttctaaacagttttggttgtcacctaatatgtaattgtagaatctaaaaaatgaactagaacctcaaaactggaaaatctcaaaaaaaaaatgaactaggacccatatagattctcataagctagctaccaactagcaaattctcagaatgttaagctccccaaatagagcctttatctcatcccaggctactaaatttttggacgaagggaataaagggatgttcgattgtcgaccatactttgtcacatgttgccacgttaaaaaaaaaggcaagtttgaggctgtttggttataatgatagttgtgacaagttgtctttcaataaattgggtttcatatatcaatgactcaaaaaagatattaataacgtttataactttaactatcaataacttcaaaactatttagtttaaaggcactaaaacaacatatatagatttgtctacaaaatctctactattataaaaattgaagatgtttttgtcgttactttggtacatcatctgtgttttgagttggtttttaagtttattcgcttctagaaatacaaatccgtgtttgagtcgattttcaagtttgttcgcttttaaaaatacagaaggagccgcataagaaatctctttagaaaaactcgcatgctaacctgagacaaccggaccagggttcacgattccgatgaaaaccggtcgaattccgcgaaattttgatattttgacaaggctcggaattaaatttcgattggaatttcgaaggttaaaaagtaaatttggtcaaaattcagtcgaagtttatcgaaaatcgtgataccgatggggctcgaaatttagtggttaactggtaatataaaccctggaccggactcctaattgcagctcatgattttatataaaaaatccaagcaaattcccgcagtgaatttcaccttagctaagccgcacaataataataagattaaaataactttcacccattgccacgcacgagcatttttctagtactataataaaagtgaaagatatatttttttattatattataataaaaaagtaaagatatattttcaaaacgtgctattatccaaaacaccaagaattacaaaatcggaggaggaaataaggaaaattgtctatatgcatgcatacagactcaattttgcatagatataataatattgtccatcaaacaaacaaaagatcaagagatatatgatggttaattttttttaaaaaaaagaaatctgatttttggttataggagtactggggtatggagtgaaggaagcaagggcttgtttggtttgcaaccatgctaaactattggcaatgccaaatcatgggtaagtttttgccaatgccaatattttagcaacatttatgtggtattgacaagtattggtagcaaactaaacattgccaaaattactgtttaaaatgctaatattttggtatggcaacttttggcttcaaacaaatcagccctaagggtgtgtttggataatgggaaatgagaggtgggattgggattgggaaatgaatgaagggttaggattaaatgaaagggggagaatgaatggttagcatttaaagatgtcttttggtgggtgggaaatcatttccctatcccatttgccaaacatggcctaactttgtacctctaggggcaaaagcgtcagacgaccgactcggcaattcgcacgaggcaggagtgggcccgggggggctcgccttgcgaagttgcgccgccggccgcaccgtgagcagctggggcacaacacgtggacgctgcccgctcttgttgtgacgtggttggtggacgtgacatggacgctccgcttcggtactatccgttccgtttgagggagtatactactgctactagtaggtggcttggcttgtggataaggtcgtggccggctgctaccaccatccataaagcgacaaattattgggggagaaaggaaaccagacttgggagtagtcgtcgtttccttctttcctgcctttgaatttattcttttttctgttgtaaaatgtcaagattttttctattggaaatacagcacctacgataagtactcaaatttagtactagataattttatcacaggaaacctaatcagttaactaagctaattgaactatgctcactttattatggtataaattttaaatcccggaaatacttatggttcgaaacggagaaaatagttaattttaggacaggggagtagttggtaattatctatactatctatattctttaaaaaataatctcaaaatttcaaattataactaccccaccttaaaatataacaacctctagggttgaaaatttctcctaaaatagaatagtttctctaccaatcaaaaccttctccaatttaatttcacatactttggtaataatacatgtgtccaaccgtaaacatcgcttatattttgtaacagaggtagtaagaggctaaaaaatattactccgggatttaatacgtgaaaattatattaatagaatttatggggaaaaaattttatatatttacttttttaataaatttaaaaatatataattacaaaaggtagtgataaaaatatatccatggtttgagtaatacttttttttatgaaaaatatggtactcactccatacatacatacatacatacatatatatatatatatatatatatatatatatatatatatatatatatatatatatatatatatatatatatatataggtttttagtgagttcttgttgacggtcgttaagtacaaaactttaaccatcaattcatgcataaaagatatcaaatatattatcaaaacttagtggtacgagtttaactactaaccacttctgctaatattagtaaatagatatatgcatgttatttaagaagaaaaatgcacccgacatgtgacgaaaatgaacctccggccaaccaagcgcgagtacaaggagggccgacaagtcaatcgaaaccgacttaaaagtaagaccaaccagtcctaactgccataagggcctagctagaggagaggctaggaggtgggggccacaatttggctgaaccaaccaccatagtggcgccccatcctggccttccacatggagtgtcctgatgaagtcccaatgacggttgtaaggggaaaaatgtcatttaactattgttggcagttataaaggaggtcttcacatacttgaaacacacacaactttgagctcaagtacagtacaactcacttgtagtttcatattctctccgtcgcacaaaaaactaacctagtactgaatgtaacacatcctagtactacgaatctggatatacatatgtccagattcatggtactagaatatgtcacatccggtactagattcgttttttatgggactgagggagtatttagtaatgttagtttggtagaaagtgaggggaagctctggaaggagtgtcctgaaaaattggtgttcctccaagaattttatggagtgcatgagtgttggcattctttcaacggagttccagggaaatccaggattgtcggccttcttctctcgcttgtacctcagcggatagttatttattaaaataagtatttgagtttctgtatgttctttaattagtttatttaagtgagatatattctcatcagtgcagattcgtcgcttagtgtgcaactgagtgatctagtactaggactcttggataaataaggaagtacctacgcaaggctagagtaataattaataagttaggcatggtgtttaggttagaaattatcttcgttagttgtgtgctccaccgaaagtgaggtaggcggaaggtagtgatagccctgtccgttctttgtattcctccacatttgggtacatcatgcatagagctcaagg

SEQ ID NO: 66032 - DNA, 754 bp, Oryza sativa
tgggctcttcctttcggttcttgtgcttatcatcagttcatctatttctgtttgtaaccgtcagttcatcttctgaagatcaacggtcacaccgcaaacttggttactctacaattcaatgtgaatacaagtgttttttctcatggattttgttggacaacatacaattcttaactctgactgggacgagtgtttctctgtcagatttgcatacttcatgtctttatttctttgttacaatttttctgagttttctagagattttgttcttcgtttctgctctctgggctcacagcaaggagaaacacaagaaaagagacggtgtgtcttttcttccttgagggcatgagttttgcccttttttcttgaaattactctagaaagagaaaagtaggttcattgtgtagaatttttcaacaaagtactacattatctcaatctctttttatcgatcgattattttctctcaggtttatacttttataccaagagtacttttacggtgatctctacatgatattctgaagatatagctgaagagtcctagaagaaaaaccctgaattacagtaatgacttgctttcctgcgttctggagaaacaaaaaatccaggagtcaaattgtgcagcatgacaaaggtaaaccctcacatttcatcaaattttcttcttctgaaacatccagatgccttcttctgattgatcttgttctttcccagatacaccgatcatcagaaatgtgaagatctactcctc

SEQ ID NO: 66033 - DNA, 873 bp, Oryza sativa
ttaggcgatatatatatatatatatatatatcgatattgacgatgtcaccacgaactctcgttatcgatgggtgtgttccctatcgctgaaagaataattagtcgtaaatattgtaaatgtaagcatccatgctaaatttataacttgaacatttgtggacaaatccatcacaacaaaactagcatgttgaatcaccctcacttcacggctcacaaaatttattttttttgaacgactcgcacgagacgatgcgaagttctattgatagagcaggaaaaaattacaagattacaaccctggagggtcgtaaccaggaaaaggaaaaaaaaccacctcccacacaccgacagcgccaacacacaacccgggagaaggctagcaccggaccggccgccgctaagcgtgaccgaccgccgctagaccaacaaaggaacacagataagatcgccctctctgcgaatccttggctgacgcaccgatgctccaccacctctccagctctgtcgacatgcgggacccctacaccggcggcctccgccggccagtctttgtgcgccgaaaaccgcaccacacccaccggcaactcctcctcgcaccgaggtcgcctcctccaccgccggccgcgcctctcgcgccaaaccgattaagttcaatgaacagaggtggagaatgaaatacctcagtactcatcatcaccttacaaaactgacaacaacggaagctagctaattaattcccacttctaaaagaatgtaaaagctgaataaaaagtgtggaaacatccagatcgaaacagcgctgcagctaggtttctggtcatctcacttaacagctgggtttctggttgcaggacctccatctcatgcaaaatt

SEQ ID NO: 66034 - DNA, 12625 bp, Oryza sativa
actcaagaaatacttatattttgggatgaaagagtacacaaattccatatgatttgtacatagagatggattcagacggagacaaggacaaccaaaaaaatcacagggggcaacacagcccacagcactaataattaagcaagcaaggtggcgtgtggacggcggaataattttggacgctgcaaaaagccctcccctttgaaccacaatcatatcccaacacgccacaaaaacacaagtggccaaagaagatacaattttgtacacaaactactacaaagactcatgtcgaccgtgtagagcttctctggaccaccaccggttgcggactcggcgaaaattatcatctcacaaacacacagaaaatgattgactttgcactataaaattcccagctaggactctagctaggaggcttaaatcacaagtgataagctctggctgctgtgcagaggaattttgtaatgagttggttcgcttgtttctgaagccagaccggattaccaggatgttagtctcctccaaatggcaaggatctgaaaagcagaaggaagtgaatagcgcggttaaatgttgcaaatgtgagcacagatttacctggtacaggaaagcattgagattgcataacacagttctgacaaacaatggtacattgcctggaaattttggataactatttagaaatacctgtagaaaagagtaatggagttgtatgtaaaaccatgcttgataataggatgactgctgtacagcacatcctatatattttggtcctatgatcagtatacacaagggtagtttaggtgcaggttcatgcgaactttgccaatgaatcattgtcactgctactatactgtcctcaaattttcatcgtgattatctggatagtgtcataattatcatcttgcaaataaacttgtggtgcatacaattctatcgaagatattcagcaacaatagtgaaaatcaacaaataacttatggggcgaattattgtctaacagaagtttaggggctatttctaggtattgatcatgaaaatgtctaacacaagtatgtttaatatcattactgcaaggacaagcaaggcattgaattcatattcagctcattacctaaattatgactcaagactcaagagcaaatgatcagatagaggctcagtcattcaattctccttctacatcatttgccttttcttgaacaaagtagagaacctaccccccacgtaattacagaacaacaaggacattagcctttttcccaggcgagttgggataagcttatttcccaacttaattatcgaacatatttcaaatgccaagtttgcagacataacatatacctgaattatatcatcctaatatgcaagtcacaccagagctaaaaagaattttatccaaatatcattgaacatccaagattttacacatgaactgaggtggcataatactattgcattgcaactaagtcagatttttttttatgcatgagtatgtgtatcatttcattaagaaggaagaaatgacaggggagtggctaaagcgccttccacccccaaacaacaacagcagattgctacacaaacacaactcacttgaactgaccttacccaactggagtaagcgactttctaaggaactcgccgagcttagaggcctcggccagaaatggcatcattcttacccaaaaaactgtgggaacaaaattggcatccaacattgtcttgaatccatgtattactgatcatctgcgatatcctgtcacaaaacgtttgatgtctgcaaagtctaaaactgcttcaacatcacgaaaagaagaatcccacttagtctgtatgaaatcgacaagaaactctgactgtttgttgccgtttgtctgcatcatagacaagagatctttgtcatgttacatcttttggagcaacatgtcaaaaactgaacatcaatgcaagtccttcaggacttgcaaagcaaccaaagcaaaaggaacaaggtacatctgtcccatggaaggaatgttagtcaaggctcgctggggtcactcaggtgggatagacaagaatcttaatagatgtaggatcaatccttttactgtttcatgtcatgtgagatcataatgaacaccactctctctaagaaaatgtaccagacacttgtactgagtaaccaattgcgagtcataagaaacaaatttttcccttcagcttaagatgaaagcatcttggtagaaaattaaagtttcaagtaaccgaaacatcttgaatttatctagtgatatttgcagcggtaaggtacaatacccagcagtaaacaaacatatatacataagcaataaaagactaacaacacaaaatctaagacatgccatcaatagatattttacctcaaaaacaaagaaaccaccaggcttaagtactgatgacaatccttcacaaagatgaagcagatgctcaagtccatctttgcctccatcaagtgccagctttggttcatgccacccaacttcaggttgcaggccaggtagatcttcagttggtatatatggagggttactaatcacacccatgagctttcccttcagatcttctagaggctcaaaccatgagccatgccttatctcaactttatcctaattataaacatggacaaactcaagatcaccaatgagtgtctttgcatttaaaaattgaaaactatcaactcaattatttttaaaagaaaactttgtctgtttcaattgcaaagctcctcacctgcatcccgtatctctgaacgttgagccgagctacgtcaatggcgacctcgctgacatcagtggcgaacaccctcccctccgggccgagcatcctcgccacggccacggcgatggcgccgctgcccgtcccgaggtcggcccaccacccggcctcgaacccttgcaccttcgcgaccatgtccaccaccgcctccgtctcggggcgcgggatgagcacgccttcccggacggcgaccaccaggtccctccagtgctcgttcccgacgacgtactggaacgggcggcggtcccggacgtggcggagccagagggactcgaggtcgccgagcggcgcgcggaggagcgccgggtcggcgcccgcgtcgcgggcggcggcgtcggcgaggagccagcggaggtggcggtggaggtgcggcgcggagtccggcacgagctccgccgcgcggcgccggaacgcggcgagggaggccgccgcgaccgggtgcgccgccgggcggaggaagagcggcgtggtgtccgcctccgcctccacccccgcgccgccgctccgggggctcggcggcgtcgacgcggaggacgaggcggtggcgaggcgcttgagaaggcggggcgtcggcttgggcttgagccgccccgggagcaacgcggcgacgccaacggcggcggcggcggaggcgagcatggcggcggccagtgaggagtggccgccatgtgcaatatagatgggcctcaatttggaacgaaatgggccggcccaatgcagtacagataggcctccatttgaagcaaaatgggccggggccaactgcaaagtgagtacttcagcaaagagcataaattttaatacctatatagaagatcgattttgctatatctcactcgaaagattttttcttatctctcactcgattttctcactcaaatttacagtgcattttcttgtaagttacagtgtaattaatgaaacttacactgtaacttttgtaagttacactgtaatttttgaatcttcgcatgtaaattttaaattttgtattggatttggtctttttcttgaggatatggtaatttagtgtccattatggtgtttcttaattgctttttgctttttattatatctatcggattttaatccaaagattaaaaatctgtgtgatacgatcataaaaatctttcgaaagatgtataggtactcccatagaagatatagatttgcgtatgaagaatagggaggctagtaggaatcggacgccggatttttgggtgaaaaatcggactcccacgtcagcatgacgtcatcaagcatgcacgtatgcaaaaccattttaaactatttcatatcttaaattatttatccaaatcatgatccgattacaccattaaattcgttgcaattaaatcttaaaaacaagaccacgcatggatatattccgatagaaaacaaatcagcttattattgaattatttttaaatgttgcacgctgttccaccgagtatatcgaaattgtttcactaggtagataaaaaatgtttcaatcgtttaaattaggcgttatttcaccttatataaaagtaatgtttcagtaaatagcgaaaaaatgtttcaagtcactgcaacatttgatccatacaaagtttgatccatacaaagtgaaacattaaaagtatactaggagaaacattttggtggaacaaaaaatgaaacgaattcccttaaaaaagggtttccataatatgtgggtgatttattgcaaaagattgtttcaattcactgtaacattaaatttatacatagtaaaacattgtgaatacactaggtgaaatatttttaatggaagaaaaaatgaaatggattagggtttacaaaatatgtgggtgatttgttttaacggaatatgtggtgcggacacgtgacagcacgaaggcgcgcgtgggagagacgtggacgatacagtatgcggcgtggtggcccctggaggcagcaacccggcggctggcattctccgtccgatttttacctcgggcccgacgtccgacagaaagcattcccgaacaattattgtgtaattacccaaaaagagtaataactagactagtactccctccgttttttaatagaagacgccgttgactttttctcacatgtttaaccattcgtcttattcaaaaaatttacgtaattataatttattttgttatgagttattttatcactcatattactttaagtgtgatttatatcttatacatttgcataaaatttttgaataagacgaatggtcaaacatgtgaaaaaaagtcaatggcgtcatctattaaaaaacggaggtagtataaattaaaatgatcgaagcttaataatttatctagctataggtagtagtaagcttggatttagcgtagaaggtttcggccaggttcttgatgactaaaactgcgaacaaaagttcaggaccagcttctccaatagctccaacggcgccggcgtagacggcgagcccaccgacggcgaagccaccgacggcggcggccgccgcgatgacacggtcgatccgacggctagtctcgtcccacacgaagtatcccgttccgatcacccgcgtcctgaactccctcgccgacgagcgcgacgcctcggcccaggccatggagaggagcgtgcacgacgcgacgacgaacacgctatggatcagcagctcgtggatcaggccgggatccaccagcagcttcgacggcggcgtgacgtagtagacgaggccgcccaccgggtaggcggcgccgccgccggcgtccttccacctgccgagcaggttgacgacgaaaccgccgccgccgccgccgctgctgtggaggtggagctggtgcgagacgtacgacgcagaacgccgagacggcggaggcgtgcagcatgatgggcatcgcggaggtgtagagcagcttgattgggacgaactcgtcggtgccgcggcgcggtctggagcggtacagccgccggaggtgggtctcgtcgaggcgcacggcgaggacgaacataacgcaggtggtcatgtagttggagaggttggggaggtccaggcggagcagcgtgaagaggagcgccccggccttgtgccgccacgacggcggcgcggcggccacgcggtgggtgacggcgaacacgggcccctcgaactccgggccggcgccggcgaggcggagcttcacggggctgaacaggtgcgacaccgcgcgctcgcaggcgttggtggcgatgagcaaggaggcggcggagacgccctccacgccgtagcccgtctcgtggaggaggtcggccagcacgacgaccacgccgccggcgaagagctggagcacgacgagcgccgcgttgcccgctccgccgctcccgcacatcccaagcgccgccgcgatcccgatcaccaaccgcgacgcgttcctacgagagaccgtgacgtgtgtaaagccggagagaacgtgacgtgacgtaagcgaggcatcgagctagtaactcacaggaggccacggtggttgaggagtcggagtcgaagaggagggcggcgaggaggcgcaccaccacccacgacgtgacgacgggggcgacgccgagctccatcactgtgccgcggggcgcggcgaggaggggccgcgcccagaacagcgggtcggggtcggcgtcgccggcgccggcgtagagcgggacgtggctcagcgagagcaggagcagcagcgacgccgccgccgtgttccgcacctggccgcggaacggcaccgccgcttccctcctcctctgcatccgcggccccagcacggcaagcggccggagcagccgccacagcgccgtgccgcgagcccgtgacttctcctccgccgtgcgagccatatccgccgccgcgatggctcgccggcgatctcttctgcctcgtcgttgattcggactgttcgatcgataggccgagttgatataacatgacatccgcgcatgtgcgtaggccgagttgggctgcaattgggcccaaggaggggaataagttcaatttttgaccctcaaaagtggtcgaaatctaatccgtgaccccaaactacaaaactggatatctcgaccccctaactctcgaaatcggtacaatttgactccctgggtggttttagagcgcggtttcgctgacgtggcacctacgtaacggtgttggctcggtcttctttccacgtggcgcttacgtgacattagaaataaaaaatatttgggacccatttgtcatacacacaggaaaaatgtgggagtcactgttatgtggagcccacataatcctctcctccccgtcttcctcctcccttctctcctctccacggacgatggagtctgcgccgactcgccgccggccaccgccttggccgccgtcacagacggcatcaccaacgcccctcccccgcgggttgtcgtcggcctcccccacccctccccgcggagccgttgctagcgcacccggcggcgggcgggagggcgggcgctggagctgctgcgacgacgaccccttgtctcttgctctccttccttcttcaagcggtgtggcgacgaggagcagccgcggagcatgattcctgcggcggagatggcgatgacgcggtggaggccggtcggcctcgaggtagcgcgccgtggcggcgcacggggtgaggcaggcgtggaggacacggtggaccgggtggaggaagaggtggaacgcgtgcgggggcgcaggaggaagcgaccagcatcaattatcacgacgagctgctttgggtgtccgtccacgccgacatcggctactgcttttctgactcgcgccgcctcagcctgccataactccaatccaacatccaggtacagctcttactatacaattaaattaaatctgccattagttagtaactaagcttgataatatttgataatcagcgagatgtacagaggatcttggccatctccgagatatacagcggtgacgcctgcatgacaatcatcggtgagatgaatcaactgatatagaatttctccggtatctgcgccacagctcagagaaaggcacccgcccgccgccgccggaatcatgctccgcggctgctcctcgtcgccacaccgctcctactcgtcgtttctgtttcgccggaacatctccgccgctgacccccgtcccacggccgcagctcgccaacggaagagagaggggggagaggatgatttatgtgggccccacatatcagtgggttccacccatacttttggtgaatgacaaatgagttccacgtatatttttttatttctaatgccacctaagcgccacgtcaacgccacatgaaaagaagtccgagtcaataccaccacgtaggctatcagcgaaaccgccctccaaaaccactaagcgagttaaattgcaccggtttcgagagttagggggtcgagatatccggttttgtgatttacggttacggattagatttcgatcacttttgagggtcacgaagtgaacttattccccaaggaggacgcgaccgttggatcctattcgcagcccagctcggcgaagcaaatggattatttatttatttatttatttttattattactacaataaaaatgcccgtgcgttgcaatggatgaatgctattttaattttattattgttgtacggtttagctagaatgaaattcactttggcaattcgcctagatatttgatgaactaagtctgattttcattttaagttagcagtatttttaaagagatttttatatttccaaaagtaaacgaatttaaaatccgactcaaacacggatctgtattttaaaaagcgaacgaaattaaaaaccgactcaaatacggatgacgtacgaaaataccagcaaaaacatattcaatttttataatagtagagatagagattggattgtaatgagaaacgtaaagctattcttttgttatctgaaaagtatgtctcatattttcattgctcgttggcttattaattgcagcccaattttaaaatatgaaacttaattttagagttgtttttctcattgtaatttgtttttcaacgttggctttaaattattaagaacacgacataaaattgtactcataaattattttcgattgattatctattaattgccgcctccgcctccacgccctcggcgaagcgctccaccaccttctcctcctcctcgctgctgctcatgtcttcttcttggcattcttcctcctccagctgctgatctgtgtccatggcagagatcgccggagaagagatcgctcgacttgaggcccgcggcgtcggcgtcagcgccggctgcgaggcaggaggtggtggatcgacagacatccgcgcacgtgcgtgggccggtgataggctgagttgggctgcaactgggcccaaacaagacacgattctattcgtggccgagatcagtgagcaggacgtagcactgagaaaagtctatttgggctccctcaactatgtaccacaatcagcaaaggataatggtttaagctgagagcataatgagccggttttgataggtagaaacgcttttgttttagtttaacggtggaggaatacgaatcacattcagcaaatacttccttcagctacatatgcatcaacaatggttcagcacggcataaaccaaccaaggtaactcaatgccgattgctcaaagcatacacacatcacacaattcatagcattagcatagatagatagagatacataggtcctgaaacttgttcatccacacagcagcagaaaaaaaaaaaccagggttctaaaattttaagcttcaaacatggagagaccatacacacaggtgctagcactagctaggataaagcaagcaccatgcatgtatggacgcatatgtttaatacaatacggtggtggtattcaggtctttgttcagtttgccacaatggcacaaaagcaaaagcactagctggaagctggaaaccatggatggtggatcacatgaaggtccagttgacgagcatgaaggcgaggcagtgcggcgcgtcgtcgtcgctaagaaccttccacgccaccgcctgctcatacgatgcctgccgccccatgctcgacttgcagacgcctccagggagataggtgaaaccctgaaagaagatagacagaccccaaacaggcttgatcaggaacattgctcatggtctggtagtactctgatggatgcgtcaccgattgtcgcgaggcagggacacggtggttttacctgctgcatgatcttggggaactccgagcacagcgccttccggccctcgtcatccaggatcatctcgagcgagatgtcctggaggttgaccagcgtcgtctcaaggatgtcgaggccggcattgttggcgaaggtgaacataggagcaggctgccagtagataaccaaactgaccattagcaaggtttccagaacatgcatgtgatgaaatgagcataaaattagtgggcagcactactaaccttcagagaacagcacagtattgcgtcgctgtgcttccacaggagcgccaggggagaatcggcatcttcggtatcagaccaacggatatctgctccggtgtgagccctgaaagatccacggaaataactagtgcattaacatcattgatcacaacttcagatgtggcaatgtgtaggtggttctgatgatgaagaacctgagatagacttttgctaaaaataagtattttacttacctatagctcctaccaatccagctagcaagtgtaagcgcctcaggagaggctggagggtgcttcattccgatctggggtccaagtcgagaaggagctattgccacagccaccctctgcacggatgccatcacagctctgacataactcctagccattgccgccacgctctcacgaaggtggttctcgtatgagaattggaaagcaatggtcaggactgatctgttacatgtgccagatgcttcaactgaagcacgcgaagctccacctggtccaacctcaagggcggatgcaaggtcgagcgtgcgtgttgcagatggcccatcctgcaggtttgagtgcataacggttaattggtgagccaacatgggaaagacaaggcctctggaataagattatggaccagtcataccatttttgtatctagtggtatcacacggaatcctgagggtaaaagtggtgcatcatcagcaaaagattcgtcaataggagcaaagacaagctgtgcagatgcactagtagcattctcatcaaccccgctgcaaagctgcatagaaagcaatctctcagaaccaggaaaatgcaacaaacaggtacaacttaaggcaattgtcatgagcaaggattatgtggagaagaatcgggatgaatggggatagattggattatagtagatgaaataacaaggaatacggtcctgaacctaaacggcgcgacgctctccgtcgcactgagaaggcaggccgatgggcactaagataaatcttgatctaatgcctaattgacctgagataggatccctccttatatagatggaggactccttaatctaatcctaacaaaccttatctaatcctaacaaaccctaatcctatccaatggacctaggacgcccggcccaaagcccatgacattactcccccctttttgagcagctcgtcctcgagctgcagcacaccctgctagacttaacgaagcaccataacctaaactaagactcttaaaccttttacatctcagcttttattatgaacaaaaataaaaaataattcatgcgcaggaggacctgatccaccagaaaccctgagcagaaggttaggcccatacggtggccaagaacagcagcatgcctcccaccgaagcccacttgtccagcccaacagcaaaggaataaatagttgactcggatggtccacaatacctgtagaaggtacatatcccgtgatagaagcacctcatcatggctgaaaccatgtccttcgagcctaataacctccaagaactgcaattcagaatgccaggttgatgcattaatatttgccattcattgtggaaaaggagctacaagcctacaaggactcaattacaacattacctcttcatgctctaaggtatgagcgaggggtagtataacctgactgcccataaacccgctggtccttaagcctggaactgcatatgggctggctcgcaaagaagcagcagaataagcatcaacaccaggatcagcccattcagaacgatgctccctcagaaatcgcacaagtagagcaggaggtacattctacattataaaaaaaatgacattttgtaaagcttaattctttgatttggaacaattttggtcaaagtgaaacaaagatagagacaatctataattagctgagcaactaaatagagcctatgtcaacctgaagtagcattgatgcctttgcgcacaagatgccacctccaacagtagaaaacagagggttcgggctgacatgggatccaacaagcttgtttggagacgagtttactgaaattgtaatgtcctcactaccatcactgctcaacaaagaccacccatcatctggaaatccactaacagcatcattgaaacctctgcaaattagagtatggagttcagatgcgtgagcaatgagacatgcatggaactgtgtcatatgacagtatgccaattggttctaatacatgggaaccctcaaatagctacagacctgctgagcctttgactgaaggtcctgaaaacagcaggctggcgaccagcaccgtaggggatttcaccgcttgactcatgcgcaatttgcctaatgtgtcgcaatgcctgaacagaatgaaccatgtcattggtgat

SEQ ID NO: 66035 - DNA, 8234 bp, Oryza sativa
cgagaacagtagtcgtccttaattaatttgtctgcagctgagctggttgaaatcgattgtctaaacaagataggataaacgactagttaacttctactagtagctactacttgtagtcttgtctgcattgtacgtgtttttagccaatcgatcacacatctagctagttagatagtcatgtacgttactgcttcaactgcttgtcatacaggagtattcatgaaattcatcagtgctgatgatcaatctgcagtgcattgttcagaatattggatttaggagaaaaaagacatactcctatatatgcatgcgtggttggaaattattaatagtggcgtcgaaatgaagggaacgaactagctagacaacctctacgacgactcatgatgacaacgtagatgtagtcatatctagatcatcattaatccatgcatggacattatttctctgaactaataaatcatgcatgattaagaagttaggatgaattaatccaggccggcaagaggctgcaggttggccgtgagttccctacttccctagcttagttccacatgtacctgaaagctttgcttctgcaggtaggcaagctatcagctgttgtgctttaagttgcctcacgaggaaaagcaagcctttttaggccaatataatttgctcatgcgcatttgctccgccaaccatactgttggtagcgagcaagaacaacatgcatgttcaattatatatattgatgttaaattgttcatcgatcgtttcatctctgtacgatccgtcggtgatcgacgcatggatggccgttgtgctttttgcagtttttgcatggtacttcactgctttgcatcacgcatggcatatgcatcacatcggcaactatctatagtacatatatattggacgatatatctcgtcaattaattattgctccctattccgtatttctagctataaatctgaacacatatttatatagattcatagctattaattattatattttgagacgaaggtaggactaatttgctggatcggtcgttaggcgttaggcctggcatacatgcatatacatcgatcattgatcaatgcctgcattgatgatcgatgagatcgatcgaagcatatggccatatgggagatgtgatggactgtacaacgaagaagctgcagtagcaaaattttcagtggatctcgtgggagatcgccgaacttttctggtcggtcgagctaatagatcgaaatatgtataggaaatgagtgcagatctctagctagtttgcaattttcagacgagttatgaaattagttttttcattcgtgtctgaaaactttttccgacatccgatcaaacgtctaatgtgacacctaaaaattttcttttcgcgaactaaatacgcccgatcagcatcctcaccaacctgctgcttgtttattaatggctactagtagtactgtaggactagacgtactgcaggctggcgtgcaagcttaattcactaattatctcttgatactcattccgtcctaaaatataagtattttttattactctgacatagtcttcgagatacactttgaccaacaatatctataaaatagataagatgttttaaataaaaagagttacatattatgatagattgtttaataataaatctagtaacatcaattttacatgattgatattttttttgttattaatagataaagtttaaaatatttgacttgtcactatgctaaaaattcctatattttaaggcagatggagtatataattttcgtcatgtatgtaggcatctgcttcatggaggaattttatttgaacacgcatagctaccgagtactacctctgtttcaggttacaagactttttagcattatctacattcatataaatattaatgaatctagacacacatatatgtctatattcattaatatatatatatgaatgtaggcaatactgaaaagtcttatataatataaaacggaggaagtagctagagtagtatattgaacacgcatattattgatcgatcgtctttttctataaaaaaagagagatgaaaatccggcctgtagatagcttaaggcggtttcccgctaaaaagttacttctacatccgatctaaaaatatgtacctaaattaattcatattcagatatatattttggggtgacaatagctagtacaaaagttcagcattcaagctgtacatcacacaacgtgatggtgaaagagctaaacccaatagtaagaccacattgtttagatgcaaaaataccatgcatgcatgcaggccttcttctgtggttaattatacattatatactggcatctctatgcactggtataatttagattcctcataatcaacatgtaaaacaatctctctttttcccctcatcaattaacctagaaacgtacgtagctttttcgcgttttatatgttgttttaacaatatatagtgtattacattattggcaaacgagagtacacaataacgactgagaaaaaaaccgtggaacaataattgacaggtcactgtcaactgtgttgaccagcaaaatgggtagtaagacctcctgattaagttttgctacagtcagtatatataaaaaaagcttagctattcatccttgcatacgtaactaattaattgccctgtactcgatccagggggcaacgactgtgatatgtacataatctccattgcatgctatattaattattagttttatctccatgaatgcagtgtttgtatattaattttttttggaggaaatatttacatgttaacaatgttgttcctatctatcagcagtgtggcatttacatattatactgtctaaagttcagtttttctttttgcgatggtccaaagtccaaatttgctagaactggaacactcaattattgcttgtcaaacaaagtggtcacagggactaaaattataccacatgctaaagtcaaggcaatttaatactttccttttcatgcatggcttaatttattagttatctaccaactaaaacaacgatctaaaccatgcataatatatcgtggctaaaacgttcatatatctccagctgactctgtttgactttacgttttcatagctgatgatgcgtcccccatatatatatatatatatatatatatatatatatatattaaggacacgtttccttctctagagtgaattagatcaaattaagattttcagtgagttgcttatatacgcgcacatacgaattcaaaaaaaaaaaatctactgttcctgttaggcatgttccaagcacgtttttgagaatttttagtaaactttgcttgtatgcgactgtcttgatgatttcttttactcctagggaccaaaaatgcatggttagttgcggctaccaagagttccagaaacagaattaaatgtgctacccaaccattgttaacttgaccttttttcgttgacctcatatattcatgcctaacgcgtacgactatcttagcttgctcagtgtactcaatttgacaatttgagtgtcttgacaactctttacttgtacgctaggtcagccagatcagcttgaggagcattcattcgttaatgcagtagggccgggacaatctaattcctactcttatctctctcgatcggatctcgtctactgctagcttaatcaagtatacagtacagttagagtcgggaagacgtcgtctcctaacttatataactagagcaaatacaatagtgaactaataatctgcttacatcacattttaacatacatagtagagagagagaaagagcggagagagaaaagcgaacgactatattatcgtcggctcatgcgctcgctctgacgcagccctgtgcaagggatgaggtagctgtgaacagccaataaaaaaacagaactttatgttgggtaaagcaacactatagacggttactgtatttagcgtggtttaattagctgttagatgacgtgttaattttttagccctcacggttgactgtactattaaacttgctctataggcagccacactagttctttttaataagagtaatttggaaccatgccattataattttttaaagtttgagatatgccatcgatatctcaatgacatgtaagacccacatgagtcaatgacatgtgggtcaggatggcatatctcaaattttgtaaaattataatggcatggttacaatttttccttttaatttaataatgggttaaaaaaacccagcctccacgagccaagccactacggctgtgtttagttcagcgcaaagtttggattttggttaaaattggagatgatgtgactgaaaagttacaggttgatgtgattgaaaaggactgaagtttgaatccaaactttggatctaaacacagcctactttaaaaaaaatctaattctaaagatatatctaaacatgtatcttgttcggatacgtttttagaattggatttttttttaatgaggagagtagttaccatgaactaattacaggcacagtacacattttcagtaaaaggaggtcagagtccggatacatctcccgtggaagtttcagcgaagttgagattccaagatgcatctcccatggcacattcaaggttcagaaagatccatacggctttgcattgctgccagattcagtggcaatgagcggcagttgcacgggtaaagcgaggagacgcacaggctggtgtagctgcttgaccggagctgcggcgtaaacgcgtatggaagttagtgagcagcgtgcagggcgtacagagtaggcacacgggagccgtggtgagagagagagctccttacgattacgagacaggcattcactcatgacagcctcgccacaaacgagaaccatatgaaagatatagcaaatcttgagtgggcaggtaggattcaaggcagcacagtagtattcgtaaatgcgcgaggcaccaggcagagattgaagacaccaattggcacgacaagatgatacccttcttgcaaaatctgctgtgcatttggtgtccggtcagggaccatatgctattgccgtctcagggaaaaggaccattgctacattgctgttgcacacctcatactcatactcatcatacctggtgccgatgcccaccggaacacacaatccggcggcggacaaagatctcatctcctgtcccaaacctgtatgttctcaacttggcaattacaatttacagtgagcaatggatgatattcagagagtttgtctgcaggcagaacgaatgatgtcccgcccgcttatttggatcagaaaaacgcagaagttttactctctgtacaggctgatatgcagaaaccttatttcaatcaagtatacattgtctcctttttaccgttccaggtagaatccctaacgtgaaattaccagatgcaaaccagagtacactttgccacaaaatataaatcaaaacgggtatatatgtttctttatccaaaattactcatcttgcctacaagtttgtctttggcttggatgatgggctcacgcgcctggtcaaggtccgcattgtcacaaactcttcagcagcagacgggtgaataccaacctgcaaagccaatggataatattagaaactcgagtgccaaatgatattaacaactggtttattgttgtgtccacgtacagtgctgtcaaaggtcgccttggtggctccacacttcagcgctacagccataccctgcaattggtggaaagtcaggtgcaaaatactagtgaagactggaaaatgccacgatttttttgtgtgtgaaataaacacacaaactttgcttacctggataatctctggtgcatctggtccacacattgatgcaccaagtactttatcagtctctgaatcaaccaccagtttcatgacggtcttctcctgccgtctaaaaaaagtgagccgagtcaggaaacttcaccagaacaggaactataaagaatgacgacactgataggctccattactagaatgtttatggtccatgagaccatgacaagtgaaaataatgaaatacccagaaccttcaagtgataaagcactcaggagtcaggtgtaactatgacgtaacagatgatcttgcaataaacatgatacttacttggatatgctgttcttcattgggttgaagctggaagtgtaaacaagaacatcgctcttggcttcctccaaagcctgctgttcactcaagcccactactgatagtggtgggatgctaattcaacaaaaaaagaaaccatgttatgagtgacacgatgattgtggaaaagcagataatctaaagaaagcagcagcagccataaatgcactgaataatagattggtagaagcactggcaaaagcaaaaatcactagtgaaggatccttagatcttgtctattgaaatgactaattttttttctatctagattctagtccatgttttgttaatgtagaatttaattgttgcttacttcctaatgtaccctaaactacataggcatcaattagaattaagaaacatccagcataacaaccgcacacaagtttcatgctgctcagtcaaacctggaagaatagaaaagttaccctatatcacgtcatgctactctctttcactgctaagatctaagcaaataaacattcgaagtgcagacaagaaaaccaaaccacagtgtgcctcaccgaaagtgtcaaaagcaaagagttgtgaagtatatatgtggccatcttgtagatgctacttgtttcagttaaaaacaaaaactggagataacagagaacaatcaaggtttattggcttacgagaaaacagcacaaggtacatctctgtaatcaggtttagttggctggccaccaaacacagttttctgcaattaaagattaaagtaaagttgctggttacacagaaacaaagaaatttgaacacacccaatttacaaggggattatgagtcactgtagtcacttacagaaaagcaggtagcctccatcagtgcaacaggtgttaaatttatccggttcgttacatcacccacagcccatatatttgggactgatgtacgagaataatcatcaacctaaaaatagaacattgaataaacaacacaaattacttgtagtctcaaagaatatcatacaaagataatggccaattaaatgcctaagatggtctcacataggttcacgcgtaagttttctccaaggaaatacgagaagtaaatttcagatgaacaaatatgtcttcagcaagctaacagcctaacaggtaagggttcaattaataaggcaagaaaatcaacctttatagctccaatattatcaacttcaacaccagcagcttccaagttcaacctctgggagtttggtgtgcgacctgcacgcaattaaataccaggcatagcaacaatattaaagtttccttcaaagaaaagaaaatcaggataaatgccacattccaaatatagtgtgaaaagtagaatgtctcatattgagcatctcaattcccaacaacaagagataaaaaaaaatgttgtgaggatgacattgatcaatttcaaacatgcatatggtgcttgaccatgtgaaatatcagaagatacatgattttttttcatccagcacagaacagtcatcaagagagatgtattcaaagaaattattaaagtgacagagaacataactttcagcattgaactatcctaaatacctgtagcaaacagaacaacatctgcaatgatctcctctcctttgtcagtgacaacttttatgccatcggctgttttactcaactggtttacataaaaaagaaacagatcaaaacctatcgtgaaaacagaacacatgggaatcaaaatgcactttaggatgtcagcttaactcacctcagatagatttgtccctggatgtaatctgattccccttccctcaaggttacttgcaacaaccgtcctcatctcatcatcgaaacctctgcaattagtcaattcgccattaatcatggtggatagaaccgtaatcaatagcttgaaattttggctaataaaaatgacattggcattctttctccatatcattattcagttgttcagatagcatggtccaggcttcgcaatcgcatcgttttatctgataactagtttcatcatccatgttttcattgtaggttgatgatattgcaaaaaaaatgttcagaaaataaattgcatcaatgtacaaaacga

SEQ ID NO: 66036 - DNA, 11449 bp, Oryza sativa
gttctttgtattcctccacatttgggtacatcatgcatagagctcaaggccggacttatcctggcagagcaggggagggccggtgcccgaagcattcattagagttttacttttaactttattaactaattaaaagacataggaatactctctagccaatttatgttaggttgttgtatccttggattgaatcctggtcatatataatacacatatgttgcttgtgttcgatacccttgaatactctaaggagaactgctacaatgttattccgcgcgcttgcgaatttacatgtgatcataaaaaatatcaacaattctacaattttaaagtcattagatggcaccaaactaaaaaaaaccgttgtaccaaatttgcagaaactctatatatagagggttcatctaataatttatgagttatgcagttaacttttgccaaatagaccaatatcggttatggagatgttttaatttttcagagaaaccaactattatcctaatattctattgcttatcagattttatttgtccccgtgactatgacatcagctgagagaagcttttcaaagctaaaattgttgaagaaccatttgagatctataatgtcccaagaatggtttaaacggtctgacaactttatatatgttgagaaggaatttctggatgagattaatattcataccaatatcaatgacttcatatctataaatgtctaaagaaaatttgaaggtaatatatgtaaagttttttcttcaaataaatattgcttttggttgcaggtaatcatgatcgagtctatgctggtgatgggttgcaggagttctgactgtttctcaaaattgtctcggattgttttttctttttttttgttgtggcaaagcccatcaggcagcggaagagtgatatttggaaggacgattccgacattaaatgtttaaaagtaaatgactggtgtgctggtttttgctgctaagaaaggggcaagtttgaagcaagacggaagataattcgaagcttagtcttctttttcgttttaattttatgttgttcctcagttgtgaagcctgtagtctacgtatccacgtgtagatatagagggcagatttgttacccattatggtaaaaacaatgttgatctcgctaaaatttggtattgtcaatatttagctttaccaacatggtctaccatatttgacagatccatcacttgaatcaatcctttgagtcagggtgtatttgagaagagaggaaaagagaagataggtaaagcgaggcgagtaatgagcgtataattaattaaatattaattattataaattaaaaaatggattaatataatttttaaagaaacttttgtatagattttttttaaaatacaccgtttagcagttcaggaaacgtgtgcacggagaatgaggaagtatttctccctaagtctattcttccaactaggaaacttttccaaccatatgggtactgtttatgtagaaaataaaaaaaatgacttcgttaccgattgttttcaactataaaatttagtttttctaatttctacgttttattgaagtttccatttaatagttaaatccatacatatgaaaattcctgaccgtatatatattgttatcatagaaggtaatactgtttttatcctacattcgacaaccaataatatttattattgataatataagtgttcccctctccagatgcatgcaccatttacgaagactcatgaggtcgtgttttgccaactctcttacgaatcatagttatcccacctccaagctttcatgacttaagcaccatacaaaacttgcgtgcgttgtgtctaccgtgtaattgtaaaaaaagtaaaataataaacttttttgaacatgtaggattacttactgttaagcagctagatttgtggattgggccatgcttgtgaaaaagggtaggaaaagttcaatttgactccctcaatatagctagaatttgattcatatcacttaaccataaaaccagatatatcggtttctccaactattaaaattgttcaatacgactcctttgcctgttttgtaagtggatttcactgacatggcgttcccgtggcaacttagtatgtaggaagatcaaaaatagacatgggacctaaatgtaagtgagatgaaaaaaaaaccgtggggcccatgtgtaagcccccactcttattctcccctcgctcgtcctttctttcacatggcataacaccctggcggtgggtggcgcatgcctgctcatcaccctcccactaggcgaacagtggcgatgacgaaggaagtcgacgaggcaaccgccgttgcacaaggcacatgcgccgggagccgatgttgctcctcgtcattgtgccgaggggtccaccatggagacacggagggcgcgcaggggtttggctatggcgacatcacgataggctaatgacgtttgtgaagggcaccggtgggttggggttcggcgataggcgacgtgacgctctcgcacaacatcgtgatgcaccactcctcctcatcccgccgccaccgctcattcttgctccccaccatgttcatcgccgaccaggcccgccagaagcccaggttgaagccttcctcctccacgtgcaatctacacatcgtcattggcggacacgttcttcaagccctcgtcatgcaggatcttgcgccgcgtcaccatctccggctcctctctcgtcggctactgcccctagtcttgagcgggatctcgctccgccgccacctttgacgaggaggtggctgaagcagggtggagcagctggcgagcaggatggcaccgctgctctcgactcttcttcttgcaccccctcctccttgccgctcgccgccaccggggatggggagaagccaaaaaaatctaattgttgtattatgttgttttctgatctattagatcgaccctctcatagagtatatacactggtggagaaaccatctttcgtcagtcgggctaattccacaatagtcccggttgcaacaaaaactgggactaaagatgatctttagtcctggttaaaaagggtaacaggcatatttgatctttaatcccggttggtaataccaaccggttcagatgttgtcagggcttgtcaggcccccccgggatctttagccccggttcataacaccaaccgggactaaagtcccacccctatatatatgtcttcttcctcctccagcccgagcaagcttcaaaatttcttcaaaaaagaggggaggccatgctaaaatttctagtgaatttattttggtgattatatacaaatcggaggtgcctaaaaggttagcaacttcatcctccaatgttttttttttcatattacatttggaactatgttttgcccactttttgtctccaaaattttgttgttagttgatgagagagaaaatttgtgtggagaagaaagaatatatagaaatttagtttatttgctaaagaaggttttataaaatagttgagaaggaaaatatagtgaaagttaatcttgaataatagaaaccaaagtaaaatgaaaaattaaaataagtacagcacattaatattaatattagtttaaaactttataaatagtaaatatataattattcggtgtaatatttcataatttttgtatgaataatgatatgtcattattgtgtgactgttgaaagagttcgtaattattttataattattgtatgactgtcattattgtacgaataattatgtgtgtacgatttttttcatgtcatgtagatggatcggcaatggatgtacactgaccggcggtccaaagagtttattgacggcgtgcattattttttgagagtggccgaagctaacaggcaaaagggttttatttgttgtccatgcaataagtgtaagaatcagaaggagtattctgcatccaggactattcatttccacttgtttgagtcggggttcatgccaagctataaatgttggacatcccacggagagcaaggtgttgaaatggaagaagatgaagtggaagacgacaatattccggactttgctcagtacgctggatttgaaggaaatcaaacgggcgaggaggaaagggatgctgatggtaacgacgttgcggatgatcttggtcagatgttgcaggacgccaaggaggactgcgaaagtgaaaaggggcccataaattggacaagatgttagaggaccatagaacatcgttgtacccaggttgtgagcagaggcacaaaaagttggataccactctagagttcttgcaatggaaggcaaaaaatggggttagtgacaaggcatttggcgatttattgaaactcgtcaagaacattcttccggagggaaacaaattgcccgagacaacgtacgaggctaagaagatagtttgccctctaggactggaagttcagaagattcacgcatgtccgaatgattgtatcctatatcgcggtgaggagtatgagaacctagaagcatgccctgtttgcaaagcactatgatacaagattagacgagacgatccaggagaagttgacgggcagctaacaaagaagagaattcctgctaaggtgatgtggtatttccctataataccatggctaaggcgtttgttcaggaacaaggggaatgctagaatgatgcgatggcacactgaagagcgtcaacaggacgggatgctgagacaccccgccgatggttcgcagtggcgaaacatcgacagaaaatttgaagactttggaaaggacgcacgaaacatacggtttggtttaagtacggatggcatgaatccttttggagagatgagcaggggccatagcacttggcccgttacgatgtgtatctacaacctccccccgtggctatgcatgaagaggaagtacataatgatgccgattataattcaaggccccaagcaacctggtaacgacatcgatgtgtacctaagaccactggtcgaagatcttaaactgttgtggaagaaggaaggtgtccccgtgtgggatgaggacaaataggaggagtttaacctacgagcgctgctgttcgtaaccatcaacgattggcctgcacttagcaacctatccaggcagtccaacaaggggtacaaggcttgcactcactgtatggatgatacagaaagtacgtatcttaagcactgtaggaaggttgtgtacatgggtcatcgtcgattccttgcagcaaaccacccggtacggaagaaaggcaagcactttgaacataaggcggaccaccgtacgaagcctaaacatcgcggcgggaaaacagtgtttgctatggttaaagatcttaaagtagtgtttggaaaggggcctggcagccagcctatagagagcgaagatagtcacgtggcgatgtggaaaaagaactctatattttgggagttaccctattgggaattcttggacgtcctccacgcaatcgacgtgatgcacctcactaagaatctttgcgtaaaccttcttggcttcctaggtgtatatggaaagtcgaaagatacacgggaagcacgtaatgatctgaagcatatggaacaacgcggtgaccttcacccggaaccaaaggagaaaggaagccattacttgagtccagccagctacactcttagcaaggcagagaaggaaagtatgtttgaatgcttggagagcatcaaggtaccgtctggatactccacgaatataaagcgaataataagcacgaaggagaagaagttcacaaatctaaagtctcatgactatcacgtgctgatgacacaactgctaccagttgtaataaggggtatcctcccagataatgtccgggcaacaataacaaagctatgtgctttcatgaacgcaatttcgcagaaggtcatcgatcctgatagattagaagccctgcagaatgatgtggtgcaatgtcttgtcaactttgagttgatatttccaccttcatttttcaatataatgacacatctgctttgtcaccttgtcaaagagatcggtattctcggtcctgtgtacctacatgtcacatcctgatttttgtttcaggatttataaattatttaataaattaataatagaatttatattaaatgttctttaatttacaagtgaagttaaaagtgggaaataaaatttcctaaatataaaacatggatggatttaatttttattaaattctccatgattaagtcaactctctgaaattttctcgaatttttcagagctcaatttctaaatgatacaaagaacagttcagtaattatttgatcattaatgatctaattataattgttaagagcttttcttgtttaaaaatccttaaattataaattgttgtttaaaaggaattattagaaatgattttaaaagcctaaaagaaaagatctaattttaatttgttaaatctcaatataaaatttggctagataaaattttattaaatactttgcttaattctataattcctagatttttttgggatttatttgagctaagaaagtatttttaataaatggaattgcatttcatgaataatttaaattgaaaaaggtttttaaaagtctcttttggctttgggccgaaagtcggcccaaaaccctctctctctctttccctcggcccagtccggcccagtccgccgagccgccgctctcttctctctctctgtcgctgacaggtggggcccgcctgtcggagtcgtcgtcttcgtcgcgccgccgccgcccgaaaccctagcgcaagccgccgccgtctccttccaaattcggccgcgtcttttcttctccggtgaaatcaatagaggggaaatgatcctctcgatctcctcttccttttctcttttggaatcttcggctaaaatcgtttggaaattcgtggattcgagttcaattcggatcggcctctttcctccgaaccccgacctttccttctcgtccccggcagccgtgggccttcgccgtcgcctccttgcccctttaaaagcacccccggtgtctccgctacccgccgcctctctcgccttcgcccgccgtcgtgtgtagcgccctagcctcgtgagcttttgcgccgccgtcgccgccgttcgtctagccgtgcgccgccgtcgctacggtcgtcgtcgtcactcgggaaggccaccgtcgggatcgccaagtcgccgccgtcctcgtccgcctcttcgccgccgccgaagactgccggagcaccgccgtcaccgtcgacccgatctccgccgccgtttcttcctcgtcgccggcgccgtccgttgcttttccgccgccgttttggtcaccggtgagttcgccgcgccgcgctctacgtcctggtgccctccgttctcgtcgtcgcgccgtcgttcgccggcgagcttgcgctcccgagccgccgccggtgctgacgtcatcgctgccgtcatcgctgacgtcatcgttgctgtccccgtgagccggtcgtggaccgttcgatctcggccgtccgttttggatagggttgatctcggccgtccgatcccgtgaaccgttgccgtgtgcccggtccaccgcaaaccctagccgctgacgcaataatccttcttttccttttcaaaaataattcattattgcgtcataattcaattaaaatccatataagtgttttaatccgatttaatctttaaaaattcataactaattcatcttaactcagtttaatgtggttcaagttgcaaaagttgtataaaataaagatctacatattaaaattgtccataaattgaattaaatttatttaattctttttaaatgggctttaaatagatttaatcttgtaaaattcataataaattcatttgaagtcagaatgaggccgttcaagtctcataattcatctaaaattataatctacatgtttgtttactttttatgtattatttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcaactagatattagatatgattgcttagccatgcttagaaacattagcacactattgggataacttatgactcattatttaatgatggtttaatgatagttcacgatggttaatcgtgattggttaattaattacttgccaactaaaatttaataatggtgggttgtgagcacatggttttgagagtcgtgctcatgacaattaaggaccggttcgcgagcttctattgtgaaacattaaccgtgccaaccacaagccagcgtgggcaacggctttaccttttgtataacatgattcattgcggagcaccagactgagaagtggcggagataagcacacgggggtcgctggggagtccatgcctctggtttttgagggggtgattatgatccaggaatggtgcactgtggtgagttgtgttgtgcaaagggtattgtcacagcctctattcgggtactttccagtatcgcgacgcatggtagacatgatgttgaggctgtgtcttgtgggtacagtggtacacctctagccagagtaaaactattcgaatagccgtgcccgcggttatgggcgagttgagcaatgtttttcgtgattagtctcacacctcccacaataattatggatgttataactggtaataatttgcttagctcctggtttggagttagatctgtacagccgggtatggttgttcagaatggttgggcctgtgcagcatgggtgtgctgttcagtgttgattaaaacttctgattaattactccactgttttattactcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagacaagttgcgaaggagaagacgtttggcttataccccagttgagctgcctgttttctttatggtgaggactaagtgcctcttaagtaagtatttatcgttttagttaatttgatgaatctgtatattaaattgtcagtttgtgtacctcggctgattcctggacgaggattttatgcacaaataagttcggtaattacttgtgaatttccgggcgtgacactacacaacatgtttcctttcgagaggtacatgggcgttctgagggaaaagtatgttcataaccgtgctcgtccagaggcaagcatcgccaaggggtatggaacaaaggaggtcattgaattctgcgtagaatttatcgaagaccttcacccaatcggggtacctgaatcacgccatgaagggagactacggggaaaggggactctcagaaggaaagcaataatgacggtagacaacaatttattccgtaaagcccatttcacggttttgcaacaatcttcattggtggctccctacatcgaggagcacttggctctagttcgcgccagaaacatcggtaagtccgatgcatggattacaaggcatcacattgatattttctccacgtggctgcgacaacatctcatgggtaacgagacgattaaccaacaactggccttcctggcgaggggaccatctggctcgatcgcgacattccaaggatatgaaatcaatgggtacacattctacacgagggcccaagacatgaagagcacgaaccagaacagtgctgttcgtatcgatgccatgggacacgatagtacaactggcacgtattacggtgccatcgaggacatatgggaacttgactatggacctctcaaggtcgctctgttccggtgccaatgggttaggttgactggtggaggcgtaacgattgatgatagtgggatgacaacggttcaacaaggttggatactcggacgaaccttttgtccttgccaatgatgtaacccaagttttttacgtcaaggacatgtctagcaaaggaaaaaaggccaaagggcttgacgagccgaagcgccacgtggttctcccaggaaaaagaaaaatcgtcggagtagaggacaagactgacgaggattatgatcagtttgatgggcaaccccctttcacagtgacgattgaccctagcatcctcctatcaaatgaagacaccccttactcacgtagcgatcacaaggaaggaacaatagtgaggagaaagtacgtgcggtcaaccgtcaccgccgatgtattgccgtaattgttctgtacacgatgtaaactatgttggatgtattgaatatccatacaaatcaattgttgtatggtatatgttaaatatgtatgattattagaatttttatcaaattgaaatcatccatatgctagttatatatgattattatattttttattaattatgtatgattattagaattttaatcaaattgaaatcatccatatgctagttatatatgattattagaatttttaaaggttttaaatcatgcacgtggtatttacatatgttaattataattttcaacaatttaatatcatgatatgctagttatatatgattattagattttttattaaaatcatgcatgtggtaattacatatgttaattagaattttcaacaatttaatatcatgatatgctaattatatatgattattatattttgtattaattttaaatcatgcatgtgctatttacatatgttaattagaatttttgacaatttaatatcatgcatatgctaattatatatgattattagaatttgtaacaattttaaatcattcatgtgcttattatatataatccacgtattctagtacatacaacaataatttttcgaaggttttatcattaattgttcgactttaaataattgtaatgcattatttactattttagaaacacatatgcaatgaaattcaagacacagctgctattatctttagtcccggttcctaaccctaaccgggtttaaaaagaatttggaaatagcgggaaaagatctttagtcccggttgttgttacgaaccgggagtaaagatatttttactcccggttgttctcaccaaccgggactaaagatccgggggtatatatattgccggtgcgccctcgtcttctccaccaacacttagacatttttcgatctcggatcgatctctttcgccaccaccgtgcctagggcaaccccgcaccgacaccgccgt

SEQ ID NO: 66037 - DNA, 6771 bp, Oryza sativa
ccgcggggtccggtaaccgtgccaaaaatgataaggggaacctggttacgtccaacaaggcaacaatttgtgagatttggacaaaaccacttccccatataaaatacatctataaaatacttcagtggtggaattttttcgctcatcaacgggcaaaatggtttacttttaagtaggttattagaatttttatttttaaaagtaagttattcgaaagtttgtttttaaaattaaacaaaaagaggctgaaaaaatcattaaaatttacatcttccaccaagcattaccatatgtatgattttttaattagttttttagataaagttacttttgcttaattagtacgtaatttttcttatagattcaaagaccactagatgaagttcgcccaaagacatattcaagtagataactttacatgggtttaattaagggttaattggatccatgccattgcaaatttgtttattcagaaaaataccattacaattcgtctattcgtaatcgtgccactgaaattttacaaaattaaaaccgtgccaatgccgtcacgttattcattcatcatctgcattttccgtcttcttccatcaccttctatcctcaccggcgcaggaggtaggccagagcacggtggcggcgtcaaggcagtggaggatggcggcagcaatggtgccggccatggggaagaagacgaagccatcaccgtcagggaggccaggggcgcgggaggcagggcagagcgcggagtgcggtggtggtgtcgaggcggcggaggaggatgatcgccgcgatcgccgccgtggaggaagtcgcccctggcgccggatccggcgagccggtggctggatccatgtggtggcagaggaggaggaggagacaaggggatttggggatttcgccgccgcttccgcacgagatctcgcccgcttgggtttcgccaccaaatccggaagagaagggagaggagagcgcggagctaccatgctacgctgcccgccgccgcctgccatggtttggtcgccggcaagctctctctcctcccacgagctcgcctcactgcgggagatggcccacttgacgccactgtccctcttgctgctgccactgctccacgtcagttactccgctgatgtggcaggatggcgtcgagcacgccgatgactgcgcggttatcgtcctccatgaggcgcgcgggaggcgtgacagcagagagatgagagagaagactgaagagagaaggaagaagatggaaaaagaaagagaaagatgggaaaagtaacgacaggggcatggttttaattttgtaaaattttagtgacacaactacaaatagacgaattgtaatgatatttttttaaataggcaaatttgtaatggcatggatccaattaaccctttaattaaagcctcgtactccacctgtgaacacacgattccatagccatttgttacaacgcccttgtactaccgtctctctcctagccattgcatcaaacacctgacgtacgcactgtggcattccatggtacacaaagggcgtcatgacctcttctcacaccattcaaaatgagtgactgccacccaaatatagtgatagtctgatagagattcttgtgttactgaacaattaattatttcatctctcaaatctcacctgggcggcttggtcctcgacttcgccagctgagccaccgccatccatgatcgaccgcttggtcctcgactttccgtaccggctcttgactggagagtcgtcgcagcgacgccgttcggccactgctcgagtactaggttaagacgaaatatgatgtatggtgttggcggattgagagtgacataatcttaaaatttttactcgagcactataggttagaaatttgtggccccaagtgtattcttttctttttttttttaaggaatctctctccaattggcttggaaatatcttttagtaaactgctagttttttagtctcctccaatgataacacgttttgtgatgtctagctgcaaaattgtctatatcccaatggatccgattatatagtactgcaccgggtaatatactaagcattccctctgataaaagagctagagtggtctaaagtgaaacaatgatccaattagcaattaagtcaaaaaaatgtataagatctaataaatttataataccatgcgaatattttttaagaaagacatgtacaatttattatgttttaaccttaaaaataagtatttgagaaattatcgatgattgtaaattttgaagttttattaaatattatcctaaacgtaagataggggaagaaaattcaaatagtaaatttgggaattaaaatatatgacgataccatacatttgcatattatatatcgtattaaaagatgaatgattaaatccaccttagcaatgttttgcttgaataactaaaatacccatgaaaatctatggtaaaatttgagagaactcccattcttgggagaggtatatactctcaccaccacttgagtcaaaactaactaatagatacacaggtgaatttccaatcttattctcacttatgggattacttttgatatctcttttctggaaaagtaagtattgctcatgggatgagaaggtatatagctttgttaggataggagaaaacttctagatttaaaattctactccctccacaccaaaagaacttcatttctagcactaccctttgaccagcaaatcgatgagttatttattcaatactcctacctcactactagaataaacatttttcccgatgtggggtttttttttttttcagacggacatgacccttggagccaaatgaccgcctacaaaaatataaatcggggtgaagttcgctgttcacaggcggaccatttaagcggtgcctgcaaaaatgattttcgcagacggaccacttaagcggcgcctgcaaaaatctattttcgcaggtgaaccttatgtggtccacctgcaaaaatcgtacctacccaaaaaaaatcttaattcttatcttctcctcccacccctccccaccactatttccctctcaactctctctctccctccctcaacacttctctcctctccccaccggcccgtccccatccctccccgctggagggggagcgacggcggctcccggcgcggcggacgcggcggcggcggcggcacggctcccctcccagatctggccggagggaggccgagggagggcggcggtggcgaggcgaggcgcgatttctttttttgttcgtgcagaggattatcgcaggcaagccattgggcagtcgttggtctacaaacggtccttcccactgcctggaaaaaccacttttgaccgcctgcaaaaatacttttttctagtagtgtattttatcttccacacgcgtaaggtaaaaagatgaagttattttggtctaattgagcggtacctcactacatcgctagtacagttgaagggtgcgtgccgtagatatctaattgcttagttgcaaatttacctaaaacaggtcacactttctattttttatgcaatggatagttaaaagaagaaccagtgtgcgcatattgtggttgtccgtgtttgtattgtgtttgtgtttcgtaaaaaaaaaattgggttgtttattgataagttggatggcatattgacaaattggccggcgccatattttttgcccctgctaatatattcattcacttggttataaaatgcccatgcccacgacctcagttggcgcgtgagacgcggcaggccaggcgacgtcaagtagaccgatcgacgcgcaggccgcgcgcgaagatcgtatataccttcgttcgcccccgtactgtgagttctttcatgtcaatcaattagcttcaacacatgcatatgctatgcgctgcctgcaccaaaacacaccagatcaaaataaaaacgataattatatatatgcagcacctgacctgatttgttcttcaattctagctttgacgaacatatatatgtaaacctctcgtcgttcatggcgtcttgtttagcaggcaactccaatatgtacgcctgcagccgaagagctatagcgcgctcggcagtttatgcatgatgagaagaaaaagggtcttagttcatcacggtgaaaaaaaaccttgagaaaattaagttcagtaatggccacaaatggacttttcccaataagcatatatgcgcttctagatgatttttttttgaaatgtttagattaattttactaccactagcaaaatacccatgtactatatattcaactactatgtaggtccttcggttcgtcgcacaaatcgaggccggtcaaattaatgcgcacgctagcaatataattttacaaacaaagttttatacactgggagcaatatgatcaaagggtgattttcctctgtcttcgtctttgaaaccttcaagattctgcatccaaagttattcttgtcgtcgttgacaaagtgcaatagagagaaaaccacacaaaatcccagaaagaaaatactattactgattactaatattgccgttgggtatatctcacttttatataaaaaaaatggacacttaaatagggtcaatcggaattgaggatagtgagaagtgaacttttaaagattaaaacatttttttggattatagaaaattattaaaagaattttggaaaaatgattggctttggattagatgctaacaggttgggtcagccaggaggtgaactagactttatcttcggtaaagggttaatgggttggtgggctggagttcaatgggttgaggtaggaggtagcattcgtggtccatagccgtgagatgccccgagttaccgacttatttataatataagtggattcacgggtcaacccacttgcacccttagcccccgaccctaggctgcaccgacagttgtcggcggtggcaggtggtgccccgtcgaatggcgcgcggctcgctggatgggatggctgtaggagtaggaaacggaggggagggcgaaactattgaatgggttggattggaaggagggactgtgaagatggtcggcgactagcagtgaagaggctcggtggagtgtggtcattatttggttgccggcagcgaccaaatcgacggtggaggaggctcgggatgggtttggtagggtgcagtaatcgcgaactaaaggaaggagggaggaggagaaggctcagtggtgaaacgaggggatttttcgccaacggcggtaatatattgtggatgggagagaggagagggaggaggaaagtacatggtgtggtgcaaaaggaggagagggggtggcttggagctttaaggtgagggattcgtcggccaatttaaagctgagctcagcactagctaacacagaagagaggcaatgatgtgcgattcatgtcgcagctaggagcggcgcgatgacaactataacctgtgcggaggtcagggggaagcgaaggcggtgggctatcgggacgacatcgatgcaatgaaacgatgtggcggagctgcaagggcggttgggcggcattgcagctgtagttgccagcttaaggaaggaggtgtggcgggtgggccctactgtccgctgctggccatggagcgaccgagcgcgctagtctatggctcgagcggtggcgcatttggagggaattgggctattgggcctaattggtcagcgcaggttgcgtgggagaaaggagaaaaagcgatggagagaggaaggaggttgggccggcgggaggaagaggaagatggttggctgaagatgaatagtgattcgtgggatttttcaaatcgatgaatggagatggaactttgattaattcaaattcaggtttgaattcaaatttgatacttgaactcgagaaattaaggaaaggccaaggaataaaatttcaatggaaattttgatagaaattgatatttaggcccgtttggcacagctatagctcctaactccaacttaaatggagacggagttgtgccaaacagtccagatcctccgttttttggagtggaggtagcagagatactcctagaaaatgaactacggggatggagctaggtttttgctgctccataactccaatccaccccaaaagacccactaccctttaactttttagtctatttacacaaaaaattaccactcaactacccttcactcctcctctcctcccgttctctctcctcctccatctcctcccgatcccaacctagctccacagcgtcagcgggcgacggcgacaggccggcggcgcgcggagaccacgcgtctgggaacatcgaacagctagcgggctggcggcgtgcggcactcggcgagacgatgcgcggccgatggccggcggagcgcctggggatggcaaacgaccggcagggcgcgcctggggccggcggctatttttttttcaattttgctagagctgaaacgtacccaaacacttttcaacgagccttcaactccaatagaagctagctcttactggagtaggagtttggagctcggagttggagtttggagccttaccaaacgggccttaaattgatgggaaatttatgaaaggtatcagagggaaattcgaattccggaatttgaaactggatcgggatttttgggttgaagattcactggtggagaaaccatctttgctcggtcggccaaaatccataatagtcccggttgcaataaaaaccgggattaaagattatctttaatcccggttcaaaagtttagagctgccttttaatctttagtcccgg

SEQ ID NO: 66038 - DNA, 2563 bp, Oryza sativa
gcgggtggaggcccgggcggcctcctgccggcgcggcgtcagacggagatacggcacgtcggcacaccggcgaccggcgcgacagtggctggcagcctgtgttatttttcttttttttaagaatttgtgactcagatctgtgtatttgatttgtgtgtgatgtccgtgaatatgtgatgtatttgtgatgaattttgtagaagttgtgatgtaattttgttttaagattttgtgatctatttgaatatggctgatttggggataatttatttgggattttgggatggggatggagcgaaatcaatatattaaaaacacaatgaagaaaagaaaataataataaagcaaccgatctagctaggctagctctatctttagtccggttggtaacaccaaccgggactaaagatagatttttactcctggttttttcacccgggactaaagatagtgatctttagtcccggattggtagtcccggtttgaaaaccgggactaaaggggggttatgaaccgggagtaaagcccctttctccaccagtgatttaggaaggtctcaagcagggatttttttagatcttttggcagttagtccttaaccactgtcagagaacaaaaaattttggaattagggatttactaaaatagtttttgtcagcccaaaaaatcgtgtcgttatagatttactcaacaatgtatttcccagagttcgaaacctcgagattctacgtcttcgtagaggagcttaaaaatatccgtagaggagcttaaaaatatccagatatttttcaaccctatccttgtgatgttctacaaatgcaatcctcctcgacttgttgtacattctccttgcttgaacaagatccagcctttgcaaacttccttggctcaccacaatcaaaatagtgaccgaggtcgacacctagccatatacgagtcctcaacacctccaataataaatccctcacaactacatggaaacaaccatatatagtgctcaaatatcaagagaagcacacacttggtcacagcggcagagccataaaaccttcgtgcgtaagcctgagctagttagagctcaaatattttcacagattatatagcatatttcaagattagattggggattatagagctaggcatagggctcaagcccaacctaccccatgtctgtttgtgcccatgcttggtctgaaactccaaatccacacacccaaagattcgaaccacaacgatagagaaggatttgagagagcaagagaaagagttcaagatccaaagcactataggcaaagctctacccacaagcaagattgaattggatgaatggataaccttacagaagggttgggtggaggtttaaatagccaacataaaattggttgttgtgggggagttgggggggggggtggtaattttagtcccaccttggatattctgacttcatcgatggatatgctccaactgtgacaaacaaatattgtctcgtaaaaatactggtcggatattccaattttgatatcgaaaactccaaaagcaaagaagtaaaccaaactgagactcaagttccaaggaatacaaggcattccaggtgatcttatgttcatactactaggcgatatgtgatggagcatattgtttctacccaagagttgagtcctttgaattttggattgttcggtccgtctggtatttgatgtaagcattgaaaactccagtcaagaatttaatcccaaacacataatcgagttccttagaaaaacgaagattccgacggatcagatattccaaaattgcagcggatatcttgatcacttttaatttagcccaaccctcaactcggctaaaaaaaatttcaatgcattggaattctgtcagtgagtcagatattccaacctaaaaagtaccaagactttgagaaaatgcaacttttagcactaaattataatccaattattacatgtggcttccgtcttaatagtatggtatcttggactcaataaagcaaaatattagaagttcgccaaaagtctccaaactgttttttgcaccttgcatcatgaggtagaaaatttactatttcaaacaattaacaatcccattactaaattcaaattggttctcattaatcaccaaaagaattagtgccatatatgcactttcagttctcgatcgttacagactaaatggtgtcctcaatttttagagggggatttggtgtttgccagaatgatgggtctagatatagaattatgtcgacaatggccataaagtggtgactctggtggagatatggatggaaacgaaggagcaccatatgttctcacatatgaggattccatttttgtggttattcgagagataggacatacgtgacgtgctggagggcatcatcttggcatgtgtttggtttggggattatgtgggatgtgttaaactcatccatgtgttttaggagggatggtcctacttcttatggatacccccacatgtcaatgtgagagaaaaatctattgtattggtccacccatttttgagggataatgtaaacatgaacctttgg

SEQ ID NO: 66039 - DNA, 6252 bp, Oryza sativa
  unsure (1)..(6252): unsure at all n locations
ttgcaaaaagaaaaggttgtttttttagttctttttttttcttcagacttggcaaggtacagcaaatctcttttctgaaatgatagtactactttttttcagaattggctatagcaagtttgaactgactgagtaatttgcaggattttgcattaatcttgaacagatcacttctgcacttctaatgcgcatgcacactctcttttttaggtttaaaacagggatgagctgtccaaaactgaaaggttttttgggggtaagtggcagctttgaacagtgtaaagctgtctctctctcgagagagagagagattctactgtaggcgtggaggcaatgcaagattagttttttatttctctgaaatgtactgctgcttttgagaactctgtgaggttattttttttttttagttttcgattgaagcatggtttctattctttccaagtgtttgtgtgtgtggctttttctgttataaaaactattttcagtgctggatatactcctacatgaactgtctctgaaaatacagcggtgcagctggcctgccacctgctcagctcagctcctctgtactcgtgtggttgaaaagtttatcgccatttcaaactaaacttaattatcttggtttgcaaaaattccggactaataaagcttgagagataactgaaaaagagagatctacacaatcttcagtcattttctccctcagtaaatgaacaagatgtcggtggtaaaatatttgaatattagtagtaggatatatttgaatattagtagtagaatagtgtatgaaactctgtgtacactccagtgtcaccccatcgtccacgatcgattatactctggatacagtccagtgtcaccctagaggctggagaagatagtactttatccgtttcacaatataaatcattctaacatttctcacatctagattcattaacatcaatataaatgtaaaaaatattagaataacttacattgtgaaacgaagagagtaatacttattagcgtttaggataaagcaattttttaaaatttctctagaactttgacatagcgttcttagcatcttaaaaaccaatgctaaaaataaactaccatgatgaactctaaaattaagttaaattttaattttgttatggttgataagatgaagagcaaacgatgaagcaatctgtttgcagataataaataatatttaacctttttatgtctgaattatttaaaattaagccttggctgcagataataaagccaactaagacaacatttttgcacaatggctcattgaagatgaagaggcaaaccacactagctaagtcctccatgtcaaaataaatcgaacaatcttaaaataaagcaaaaggctgatatgatatatatcatatttcgtatcaggccttgtgtagtttctattttttttcccagaaacatcataacgaatctttggatacatgcataaagcattaaatatagataaaaagaaaaactaattgcacagtttgcatagaaatcacgagacgaatcttttgagcctaattagtcttataattagctataagtgctacagtaaaaacaacgtatgctaatgacggattaattaggcttaataaattcgtctcgtggtttacaggcgagttatgaaattagttttttattcatatccgaaaaccccttccgatatccggtcaaatatcggatgtgacaccaaaaaattttcttttcaccaaataaacatggactgaatttatttcgaatcggaggtagtacgaaaaatcaaatgatgcggtagcttgcatcaccgatcgctcaagctcaactttagtccatgtcactgttcctgtgcagncttgcaaatccaaacagtctctctctctctctctcactgtgcctcacctcaccagctcacctagatcttctgagttctgtctgatacaccgcaatgagtagcagcagcagcaggagtatactccaagtcgatagcatcacaagccaagctgccaaacacaagcatccaaacattacaatcagatatactcctcctactactggtacgtactagtagtagaagtaacattgcaatatcattttctttcagggtctcttgatttgtaggaaaaatatataaattttgaatgatttaggaaaagaaaatcctatgaaagcatttgaaacaaatgattgaatcatatccaatcctttaaaattcctatagaatgggtaatcctatgcacattttgaaggaaaattagcaagagatctaacctcttggaacatttcctctgagtctatctctctcatctgatttctgcgtttttcctgtgatccaatcaaacgattattcctgtgttttgcaatcctctgttttacaattgtattcctgtcagaatcctgtgttttttctattcctcttttttttattcctacgatttaaaggggcccttacaaatgaaatatgcttcgtacataaaatcagaaatttgaagtttgtccaacacattataatgtacatctgcaaatactcatcgctacggctatttcattgtcatgacatggttttccaccggtaggagcggtcgaccacaaggctaataacaaatatgtagatgatgctacacatgagccgtagcgtccgaaataagcagacgggattgtagtttacttcctataaagaaattctatcgtaaatcaatgaaccttatattttccctcctaatatcaatcaaataaggtggaaattaactcctaaaatccctggtgatcagtccaaaaaacaacgctttcaacttgtgacctttttgccaaaaaaaaacatttatcagaatgtgttgctacattctaagggtctgttggcatgcccttgttctcagccccctctcccttgttttccgcgcgcacgcttttcaaactgtaaacaatatgttttttacaaaaagtttctacacgaaagttgcttaaaaaaatctaattaatccattttaaaaaaaatagttaatacttaattaataacgcgctaatggatcgctctgtttttcgtgcgaagggaatgagttcccatccacaacatacaaacacagcctaatttgacaaactatcaagcttccattcatcgcaaaagtaaacaatgtcgaatatttgcaaaaggtttaagtctttgggatgtgaagctgttgctgctgctgccgagcagccacagaagatccggagaacagtgacagtggcagcagtgcgcgtgcgccgtacggtcgaagagagacgggctacgtggaccgggcaatcgggcattgaccgatcgtgagccgcaggatcagcgtggccgttagggatggacggttcagatccgccctggtgtggggattaattaatatgataataataactgggacgcgattcgtcctccccgacggcggatctcggccgggatctcctctgtcgctttcctcttttcttcctttccccactactccccctgttaataatacttgttatcgttctgaataacgatacgttctttaaaaaataactttaaccattattttctattataataaatatataatattaacaaatatatgattttactaaagtatttttaagactaatctatacatgtagtcacaatatttaaaagataaatattttaaaaacgattcacaatcaaagattctaaagtttaacatcactcttatctaagacgacaagtattattagttaggagggagtagtatttttttttctcaagtaggagtaatgttatagtatgtactatccaattttataacccatatataattagagatatgtactaaaccataaatcaattaaagaagaatatgtcatatgcactgcaaccgtttacaaacgttgatcaaattcaattctacgtgagttggatagttaggtcgtatgcatagtaaatttcttttttttcttttctttcttgctccatgagtagcccagtgaaagaaatcattttcatatttttaaaagtgttaggtaataagatatttaatatgaaaatgatttttcataggtacttgaatatgaatatgaaaatttttgaaaatgtcatcttttctttcttgtttcattttttttgtttcataggtagtacatgtaagagataaattgtaagaaaacaatgttaacatggtttcataaaaaaatactggtatgacactttattatttttttatcacatcatcaaaaatactttcatgtcacctaaatacaacttcattttagttctccattaaaaagaccaacataacttggctctttgtctctattctctccctgactccctctttaatccatttaagctctctttgatttataaataaggcgtatgaaatttggagtatttaatattgcaaggaaattttgtatgaaatactttgaaacagatgattgatagtactatgaatttcaaagttgaacatgaagaaataaaacaaaataaaaagtagcagcggcgaaatactggtacagtggcagtgcactgtgcagcatatgagagacagtattacagcactgtatccatgtcgtctctgcttttgcattgcactgcatctgtctgttgacgtgacattcaactgcacactccgccgtatcatttcgggtatacgagaactgttactgtgggctcatccatcctgattcgcggtttgattcgtactccctctgtaaaaaaacaaaacctgcgtttttccgtgtccaaacgtttgaacgtccgtcttatatgaaattttttataattagtattttatacgtgattaatactttatgcgtgacttgtcttttttttatatttttttttcaaataagatggacggtcaaactttagacacgaaagtctagggtttgtcttttttttttacggagggagtacgactgtactccatgtacataatgaaaagtatatatcacatgtaactataattaagaattttgttaggttttactcttagcaaaatttctactcataattaaatctaagattattaagagtgctcttaacaaatcttagaaatctaaattttttaatcctttgatagattttaagtttacaagtgtatgtcctctatactacatttcattttatatactccaccaaaccgttttagatgggattaccatcacctcacggtttgacggtaagcggttaccaaaaaaaacgtatgggtaccacgagatatgatatggttctaaaaattgaaaatattactgcacgtggtaaccgtatgataatcgtacggttttgtcaacctactatgtatatgcattgtagtgctccacctatatatagcccgtgagccctgattaatctacactcacgagtaatcaacagcatcatttttattctgcatattactattgtactatacaaaagaacttcagatcagatcgcagattaattgatggataatacgttttctcggttgaaaagtttatgttttgctcgggctcaggacttcaaccaaacacagatctcataggcttgcctggttaggcataaatcatcgaattctcaggcttgcatttttctcagacattactcagggcgccaatcaaacatgtcgtaggatataatggtagttaatattcgttctttttgctaatgaatgtttggatttgttgtgccatacatgcgtatgattttctcaatagtctatagaattgtattaattaactttatattctactccctctatcttttttttaagatgttcaactaaccagcgtcaaaaaaacaacaacatggagtataatatttagtaaattcatgtattaatttatcagctgataagtataatcaaacgggacctcatgtagcaaggtcccgtttgatatagctgacattgatggataatctgattttgtgttagctagtaatattaatctggggatatgcacaaatgagtaggaaagttgctttagaaaaaacattcggagaaaaattagcatagaaatttttttgcatgaaacatgtggcttatgcacccaatttagttctcctttagttctcctatatgaagtgtccctagctctccatgtaggagccgatccccttttcgagtcgggaccatggccttacgagggagcgcatcgctctatggggtccccttgtgcctcggctccacacattgggcgagccatgcctctaccttgtggtagtccatgtacaggaaggaatatcacagggagcatcaatattcagttattgctcctctccatgaactgaagtca

SEQ ID NO: 66040 - DNA, 4560 bp, Oryza sativa
gatgttttcgttcagcggcaccgttttgttggtgggtgtgtagacatgagacgtagtgagatatcccaatgcgctgaaaaaaagaatttaggcattggtactcaccaccccaatctgtttggagtgcaagaatttttctatcaaaacggcgctcaataagatgttgacaatcatgaaaacattgaaaaacttcggattttcgcttaagaagataaatccatgtgaatttactgaaatcatccacaaaactaacataataggaacgactgccaactgaagttggggctggaccccatacatctgaaaaaataagctccaaaggagctttagaccgacttaatgacttagggtagggaagttaatgactcttcccttgttgacaagcatcacatatggtgtctttattggaatcactaacaaaaggtaaattattctgactaaggacttgatgcataatagcagaggagggatggcccagtcgactgtgccaccgggaagaagaaatcttgtggacaccaaaggcatgcttgacaactggatcggtagatggcttcaaagggtagaggcgccctttacatctgccgcgatgtagaagcctcctcgtgtcccgatcctttatagaaaaatgatttggatgaagttcaacaaaggcatcattatcaaaagctaaacgggatgcagagactaaactttttgtggcttcaggaacgtaaagaacatttttaagaacaagattaccactagagattggaacagtagcatgatcaatatgtgagatctccatacctgttccgttcgcggcgtggacttgttcattgccggtgtatttgtcccgtaccgtcagcttgtcaagttcgccagtaatgtggtcggtggcgccggtatcgacgtaccagttggtatcaataccatatgaagttgtggccgtgttcgcagccttctcctcgccagtgaaggaggtgtcgaaacgcttgtagcatttgatcaccgtgtgaccaagttttccacagagctggcacttgggccactcctgattgttggcgccgccgcgaccgccttggggagcgtcgcggccgccgccgccaccgggattgccaccaccgcgaccacgtccgcgctggccactcctccgccacgtccacgcatggcagcgttcgcttgagccatgccttgacgaagttccaaacgctgctcaaagctgatcagttgtgtgatcagctctgagatcgttatcggttccacgcaggctgcaaccgctgaaaccactggataataatcgaagtcaagcccggcgaggatgtaagacacaaggtcctcatcgtcgagcttttttccggccgcggtcatctcgtctccaggccgtgcatcttgttgacgtagttgatcacagaaaggttatccttctatgttgtggcgagagccatccttgtgttgatagcccgagctctggactgggacgtgaacatcccttcgatggtcgtccagacaccggcagcagtgttcatatgaacaacctgagaaagaatttcacgtgagagtgaaagcaaaagatagcttagcacctgctgttcctgagcaacccattcggtgtagtcaggattgggaacaacaatgtccttctcatcctttttcacgatcttggttggagccggcatctccttggtgccgtcaaagaacccagccatctgggcccctcgcagagttgcaaggacctgagctcgccacagggagaagttgccgcgagccagcttctctgtcaccggctgcgagagcgccggggaaggagcgatagtggaagaagatgacgccatgaggaaaagaggaagaaggctctgataccatgtaaagatgggtttaacgtggattgcctctctcggttccacggtccatgttatatagccagaaacagcccctggtgtggcgtgtacataggagtttacagattacatcttcaccgagaagaaaggaaacagaaaaacaagaaacaaactaaactctatcttatcttatcaacagatatgttcctatccgaactatctatctgtttaacaatgtccgcctgcgaaaaaaagaccccacgtcgggaaaatgctttttctagtagtgctggtcgcccgaacctactgttgttgcttcgggcagcgcctgcgacgtgcaggagccaccattgcttgctccgggcgctgcctctaccacaggtgccaccgccgtatcctggtctatgccgcaaccgtcgtcgccttcgaccacgacacattctgcgccgtagcctcgactcaataccagagcctacctgctgtttgggtatgtcgtaccgaagcgggcgattgattttaggaggttgggtttgggtcagttgggccttgttcttaggttgggccaaaggtcattttagtcatttatgtaaaaaactgacagttgaccaatgtccattgttagtcaatgcacggtttagtgatggtagtgacatggaagggtagggaaattttaagtcaatggcatacaagggaagagccaattttgaatggcgtatcaggaatccggtaaatttctagtgacatataggaattctcttgattgaatctcaaatgtaaaactcacattgatgttccaatacaagtacacctttgtatgtatggactctaaatttataatattttcttatctgaaaaaaaattaagaatccacgataacgctccattcaaaacgtttttcttcagcatctaatccactattatattttatcttaaatttgcatgtgtcttgtctaaacttcttcaaacagattggttcaaccttatagcatacacaactcctctgtaaaactacccctgcaatagtagcgactaacgtggatctttgttggttgcccggcaaaaggagcccgagggcttagaacccgttccaaatgaatctaccagtgccatgaggtgtaggaagcgcatgagggctacgaagtgcttcacagagtggatagagcatgagccaagggagaaatgttcattgatgtacgatgcggatggttcacggtaataatgagtgttgcgggactgggagtcatcttctcagatatcatgcatcctaaaggccgatgacatcaaaccacagaggttttattcgtgttgatatgcacggcatatcacacatcggttattgtattagttggttaattttcatggtgatctttcataatggtgtagaagtctcacttgtcatatattcaataaatcaatacataacaattttctcatggtatatttagttttagagatatttgacaggttggctcgtcgggtgataatttaccttaagtagttgctgaagaatcgtacttactgaagaatctccgtagcctcctccaagtcaatcaggaactgaggaggcaagtaatcaatccaatgggagtcccaggcgcattggagatccagagaccaaagcaagcacatctgattcttagcatcttatctagctgtttcattgcaaaatgtactggaataaatgcatgaagattgtacgaccattgcaacattcaaaactaaaatccatttaagctcttaattataagagagagttgtttaagaaaaaactattatattacaatcatctatacaagtgttttttttcagagaaacggattttatttttctacttcccttatagacacaattatttttagagatagtagctaactacttactttgcaggactaccgagagaagtctacccccactagctaacatagatatttattcttggcgtgcatattcgagatttagaatctctttccaattaggctaggctgaatcgggccacccgcccttgggtgttgccttattatcagcatggtgttgatgtagctcttaagatagatatgcctctgtaggcactagttgcttagggtgcaccacctcattatttgaatgtttatatgtagaagcatatgtccttaaaaaaaatgaacagttctatttctacgaaatattatctgcaatgtataaaaatataaaaggctaaaaacttgaacttttttatttacggtgaaccaaatatgaggattttattttttaagacctgcattgcgattctttatcgccaacatcatgtgctattatttatgaatactaaaattataatcatatgctaaatatattgattttttaattttaagttttgaaactaaagtaataaaatagcaacaacacattgatataattctaccaaaatttagtaacgttatcaacctgtacattgccaaatttcggaaatgttgaatttggcagtacatgaacaacctcaaagtaccaggttggtacgccgcggaacaccgtagcctgcccttctaaacgggataagatccaaagcgaaacgctgaatcgtacccatcctgatggcccagatcctgctgacgtcatcctccatcaaccccgcaaattcccccaccaacggaacactaagggctcgtcctccgcctccgccgccgcggctgcctcggcgtcggtggcaggcgccgccgtacgccaccgcgctcctttcctcgccgccgccatcgggctgcaggaa

SEQ ID NO: 66041 - DNA, 7937 bp, Oryza sativa
  unsure (1)..(7937): unsure at all n locations
gatcctatgcgcgcgccctgcagtgaacatagagcttcctgaagagcaagcaagcttgcgtgactgggcgctatcttgccagaagaaaggcatgcttggcaaaattattgatccacatctccatggagaaatcagtcctccctgccttaggatgtttgctgattgtgcaaaacaatgtgttgctgatcgcagcatcgacaggccgctgatgagtgatgttctttggagtctggaagctgcactgaagctgcaagagaatgcagagaataacaaaaaattcagtgaagcaacaacatcgtcaaagagaacaccagacttgataactatcatgggtactgacaaaccatcgacctactcaacaatgagcatcaccggacaaaagatcatcttctctgatatgatgcacccacagggccgatgaaggacaacagttgaggatttcaattaatttctgatccagagttcatgtattgatgatcttttgatcgcaattactagaatattgcattattgatcaattgtgtcagtttctgtctaactagaaccaaatgttagtgattctaaattccgaataaaaacccaatgctacaggtttgactagttttttcttgtttctgaatggtaatttaacttatctagctctatgcaaaggcactatatttccgttctgtggttcagctgtcaactgtactgattcctgatgtttccacatatccacattacattaggaacaaatatccagggtatctggagacggaacaaggctttgctgattctttaacattcatcacaatggttctttcatatcaatgtgaatttctgcaatgctatgaattggagcacactcgacacacacagtgttgcttgcactggctgagtgttgcatgggtcatgtgcatggtcaagaacaatgacctactacaggcgcaaatttctcatttagtctttctcgactattataaaaatagaagatctttttgccggtatattttggtacttcatccgtatttgagttggtttttaagttcgttcacttttggaaatacggattcatgtttgagttggatttttaagttcgtttgcttttggaaatacaaaagaagtcgtataagaaatttctttttaaaaaaacttgcatgctaacttgagattaaagtcagacttctaattgcagctcatgattttctaaaataaaatatccaagcaaattttcacagtgaatttcatcctagctaaaccgtataacaataataagattaaaatagcattcatccgttgcaatgcacgggcatattttctagttattaaaaaaaagaaaggtgaaggtatgagaaattgcctaaaattgattgatcgagcttgggagaacaaagctgtataagaatattaaaagccagaaacaataaagattagtttctcgacatcaaaggttctcatacttttgccaggtgcttgagcttcctccttaatcttctacatgaaagtgccatgaattgtgctgtgttgtaagcattcctctcgtgagcctcccagcaaccaagaagcgcaatgctggtcacggattgtctcagaaaatgccgatcacggacataatgtgacaaaaggggtaaatttctaggtactgatcacatttctttcaggtgcgatgtctattgacaaacaaaaatcatatggtatgtgatgttcttcaccccctttgtaatcttccttacctcagaaaatacgaatctatgttcttaggtgttttgtttctgaggtgcaaggtgtaaccgaataataacatatcgataagcttaaactgaatgataactattgaatgcttctttaaaaaaggaaaaaaaacaaggaccatggtgttaggaccacagagtcttgctcattggacaagaacactgcctcaaaggatgcctcttattgtcgcgcccgaaaatcaccctaaaattttatcgtctaaattatttctagaaattgtaaaagccaaaaatagccttcaacaattaaaattcaccaagtttcaactcaaattggcgtgtcggaatttttgtttgttcctcatgttttaaaacacttaaccaatttttactggaattttcagagcattctaaataattttaatgcaacactaacctttctcagttttatctaaaaacaaaaactaaaataaatctctctccctctccttgggccattttcggcccatctcttcccccccccccctctctctttctctacacatgttttctttagaaaaataaatcacaaattcacaaaatgacattcaaagaacacctaaaattcaaatagccatatcttgactatttgaactcggaattgacccgttcaaattgctaatttttccttaaacagtaaagaacccattttaatgctttgctcctgcaccttatatggtttttatttatgttttggccctttttctttgcgtatgtcgtgtagacactgcatatccggaagagccgctctacctagaagttgatcaggagattttggtagcgagcaaggcaagtcatgtcattttgatcatattgctgtcctaatttataaaattatgtttatttaaattattgcatttcgttttattaaaaattcccgcgtttatcactgttttatttagccttaccgattctccttgttatagccttattatttgtattattatgatccttgataactctaggaaaaatgaaactagtgagaactttatatatgtggtgcttactagtaaaattaggaatatgcttagccctggttaaatagaaacaaatagatgttttccaataattagactttgggaataacttttaaataatggttaatatggtttagtggctgtttagccatgacatgatatttccccttcaaaattccccaaacatgttttcagctgggttcggagtgcttgcttttgctagtcgcacctcggccatcataaggaccggtcttcgggccgaccgggcctctgttgcaaagcgtactccatacaaccacctgtctattgggtaagtcttaaccngggnnncccnnnaanatttnnncccggnnnntnnnccnttnaaggnnnttnnaanccccgtcataaacaaggaagacacgaatagggatggatgaagcccttgatggggtcgacgtctttggcttgtatgcccgggtcataaactgtctgctcacccanggcacctggcnnnnnacaagtgggtcnnacctctttgtttagggcagtactaaacaataggttatgtcatggcttctgtccatatgccgtggtggcatgtggcacatggaaacatgtgaggaagacatgtctggtgggtaacgatgtacacctctgatcagagtataatctattcgaatagccgcgccctcgattatgggcaagccgagcaatatacccaagttagagtttaattctattaaaattttaataactagagttatcacctgttggcttgggttaaggtaagatagcgttggagcgcggcttggtaataattttactagagaaaggtttatgttttatttaaatgcctttaaatatttaaatgctttgaaatgctagttttctgcaaaatagccttataaattaattctttgtactcccttgcattatatttacattttcccggcatggcttgcttagtacggtggttgtactcagccttgctcctttttcccacttgcatggcttgcttagtacggtggttgtactcagccttgctcctttttcccacttccagcagaggagtatttcagagatgatggctttgatgtttagctcgtgcctgccgtcaagcgtatgtggtggcccaacgtagcttccggtttttatcgtttatctttcagtgttgggcatttggtcgcccatgtaataaagtactctatttacgcttccgcttatatactttgttatttatcaactttgtaatgtgtaccttgccttctgagataaggaattatgcactcacaaacggaatatagtgttctattttccgggcgtgacagtcatccacatcatgtttccttcactagtcatattcagaaggctgagaataaatgcccaagtgctgccactgttcagaaggcttacttgcttagtactccctccgtttcacaatgtaagtcattctatcatttcccacattcatattgatattaatgaatctagacatatatatctatctagattcattaactaatatatgaatgtgagaaatgctagaatgacttacattgtgaaacggaggaagtatgtttttttttctctttcaaaaaccatttagaccaaggtcacccaacgacagattcaagcagataaccttgtatgggctaaaaggctaactaaaactcacctgtgaacacacgatctcacagtgatctgttgcaacggccttgtactgcaacctccgtctctctcctagacattatatcgaacacctgtcgaacacactgttgcatgccatgtaaacaagcacacgatctcaccacaccattaagaagtgaaaagataaaggcaaaatacacatctgtttgactaatcccaccaaaggatgggggtagtaattttggtattactgcacaattaatctcaccttgttggacctcgccatatccgagccaccggtgtccaactcccagtgtctgcggtgcctttgcctgtcctcgcccggcgtccgctttgccgacgccgcttgccgactgttggccggagccgcggagcgtcgttgcggcgacgtcgtccagcaaccgctcgcaactgggcgtcgccacggttgatcgatccattcaaccttgtgatctttgttggtttggttaatagccaccgagttagaaatttcaggaaacgaattaaccatcactatgctggtcatatatgtctactgaaacccaacaattaatcaaaaacaaaaacccaacaattaagctctcggaattctctttccaacggatccagtttgatctccaaattccatctcagacaatcgtaataacagaaacaaggtgttgattatttaatatgagagagagtatatataccttgcacctatacctttgagatatacaacatagttgcaactcctgatcaaagtttttgtttccttttgtccttcactcgggacgagcaaaggtttaagtttggggggttttgttgacggtcgttatcgatcagcttcgaccgtcaatattaccaaaatagagaagaactagtaatgtttgcaatgcatatatatgttagaataataatattccattagtattaggtttactaaccttttgcagagaataaccatgaaacggaggagaatcgatatcaacacagacgataaatcaatcggacgatgtcgagaatcagacttatgcatgaatgggccaataactcagaattgacacgacaaattgggctaaaattcacaagtctgcggagaagaacaacggaggaggccacctgccgaattagggccaggttgggccggcccctggttcggccgaaccagggggttcgcccgaacccccctggcgccgttggatgcagggttgcggctggacggtgtggattagctcccaatgatggttggagggtatttccgaccattccaaccgtcacaaccgttattgggaggctatataaacccctcaccttctcacttcacttacacacctcaagcaaggctctctcatattaagtttagtagtatcaagctagtagaataggaatagagtagaaatcaggagtccggaagtcttcagaagagttcgggtatggctctagtagctttccttttctcttttgtaagctttgtacttttattagaatactcttctatatacatttatggtattgaaatactttccgagtatataaatgcctactttacattatgttcatgttatactgaatatgctgctagcttatctgggaaatgctttggtgcgggtataatgtttgcttatgcaattgctctatgtcatgacgatgatattagaatagtattgtagtttagacatggtatttagattacgggatatcattatttggggttatatgctgtggatgaaaggtgggccgcagatggtgacagctcagtacgggtattcctccgcgcgtgtatataatcctaagttaaatccttggggagggtactcctccgtatttagccccggttgtatggtcatacaggctgtcgtaaggaactcggcagtcaggggtggcttctcaaagtacgaggagggcatcggatagaggggattagctagtatattggataactataatgtatgtatactatgtatactagaagtataggagtagattatctttctcttttctttccacttagcttatataatatattatgagaatgagtagctactgcttgtgtgtcactcccttggattatcttaacccctgcttaggatttgattattacaagtaatatataaattattagttctctctacatgatcttcccacgggataaaataaatacgatacccttggaatactctcgggtgaaatgctacaatggtatatccgtgcgcttgcggatgaactctgtaaccataatatactagaagtatttctgcgtcattgatgggaattatatttctagtaatgtcgttaagaaataccaacaagcattttcggcgccgttgccggggaagattcataatagagattacctgaactaatactttatatttacctctgtataatcactgccctttgcaggctaaccttggttgttttcactttttactgtgaaaacagggtagtgcatgattggtttcaacttgccagaaaacttcaaagaaaatccagaagctttcttccaaagcgtcaggccgtgagtcgttgctccgcagaaaactctaccggcagagaaaccagccgtactagcgccaccgaccttcaagactatggctgacaagaccctccgcgagctcgctgctccctctgctgacaatgtggccattgggccgcagatcaacatgggagatgtggatttcaacttaaagtccagcctcatcactatggtgcaggctagcccgttctgcggcaagcctaacgaggatgccaacgctcatctgcagcagttcctggagatctatggcacgtacactataaagggtgtcagtccagacaccgtcaggctgaggttgtttccgttttccctcctcgggagagcgaaacactggttttacgccaacagtgctgctgtcaacacctgggacaaatgctctatggtattcctcttgaaattctttccgatgggcaaaaccaatgccctacgtggaaagggacgagtccattcctgaagcatgggaacgacttcaggagtatgtggccgcctgtcctcatcatgggatggacgactggttgatcctacataacttttataatggactcactccaatgtcccgtgactacctggacgcggcagctggaggaacattcttctctaagacggttcgaggagccgttgatctaatagagaagatggtctccaatatgggttgagcgaggtatgcacaccgtcaaggagacggaattacttactgccaagctggacctcctcatgaaacgattggacgaccacgacaaacggccacaaggcaccgtccaggccttggattcacacgttacgtgtgaggtctgcgaccacacgggtcattctgggaatgactgcccagaaacccgtgaggaggcgatgtacatgggcaacaacaacaacggatatcatcgacaaggaggtcaagggtggaaccaaccacgcccgtatcatcaaggaggtaacaacaacggtaacttctctaaccaaccctccttgaaggatctcgtctttgcgcaagctaaaaccactgatacgctaagcaaaaagctcactgccaatgacaagatccttgaaaatattaatgttaagcta

SEQ ID NO: 66042 - DNA, 7218 bp, Oryza sativa
ttctgttaaaaaaagtttatttttcacccatacatcctatacataacagtaaaaaatcataatacttccactttatcaatcataatacaattaatcctcgttttatttacttccattgcattcatcatctacttttttaaatctgatattaataattatttaaaaatagatttactttaaaataaacggacgaagttaaaacttaacttagagcttgtttgggggagtttccaacaaccgaagattcttctaaaacctaccgttgccagaaactcccccaaacagtccagattttcacacagtttttaagaaactcctccaaacagcccagattttcacagcggttttaagaggttgtttctcaaaaaaaattaagctttccaaacagcatcttattttaaaattgaggaaatactcctatatactgtacggtactcgagagatgctccatgtcagtactgtacagtacttactgtacagtacttgtttaggccgtgtttagtttcaaagtttttcttcgaacttttaacttttctatcacatcaaaacttttttacacatataaacttccaacttttccgtcatatcgttccaatttcaactaaacttttaattttggcgtgaactaaacacagccttagttcacaccgaaattagaagtttggttgaaattggaacgatgtgacgaaaaagttgaaagtttatgtgtgtatgaaaattttgatgtgacggaaaaattggaagtttgaagaaaaattttagaactaaacactgcgtaactactactacttacatgcaaggcaaggcaaaggcagcagagttaagcctgcacagtaacgtactcacaagtagcaacagatatgttgaccaccacccatagccatagccatagctaagctgcatgcgcgcgtgagccaatctgtttcaggctggagacacgacgacgacgacgacgaagagctcgatcactgccatagccatggctggctcatgcagctactactccgatgcagacgtatagataggttggagtagataggatagcatgatagcagtgagccatggctgctctgatctgaatcttctgttgttcgcagctgcttttgtgcctgcgtcgttgtaacttccatcccttttgcccccccttctgctgctgtctgaattctgatcgatgccatcaatatatgcttctgtctcgtgatcgattcatccttgtgtacacattgaatggctggcctgatcgaggacgatcgacgcattcatatgcatagcccgctgctgcagggccattccagtatgctatactcatcggtcaattgctggtatagcatgcagctgcatatacactgctcgacagattaagtcctgtttggatcattgaagggtgtgtttagttcacgccaaaattaaaagtttgattaaaattgaaacaatgtgacggaaaaattagaagtttgtgtgtgtaggaaagttttgatgtgatgaaaaagttagaagtttgaagaaaaaatttggaactaaactcggccgaattatactactccccttatattaaaatagtacccctccattctaaactatagtaatatgaaaggtattagtaagacataagctagtacaataaattaatttaaaattctgaacaaaagttgcaataggttaccagtatattctaggacagaggaaagtacatgaaactggtaactctattcggttgaacttttgaaactttaacatcagtatatctaaatcagaagtcataagtacttgtaaaatattatagaatattagtacttaaatagaccaaatagttttgttatatattatcgttatatgcgaataggaaaatagtgatcgaagttgcacaccatagaccaaatgaagtgagcagcattattatatatttaaatacggagatagtaatacaaagtactgtaatttttttgggtaatgttacgaggtactcctatacgacatgcataaaaagtgtgacaaagttttttgctgcattagaagcctgtcaggacggggctagctgtttggatgtagagctagcaagcaataatccctgcatgttggtctcattacatcataattaggctatgcttaagcgtgcagtagcaatgcacggcctgtgccctagcacttaattgatcttttccgtagcttaatttttacagtgctgctcctgcttagctgaacatgcatcaacagacagaaagacagacagatctcactctacacatctctagacaacatcaacctaaatttcactccatgcttggtaatctaattaactgttggtctctctccactatgatactgacagtaaccagtgattagcagtaagtaagggcgtgttttgttctttgccaaactcaaccataccaaaattttgtcaatagcaaaggtttagccactgccaaaaaattgataaggttgatcatttgatttctaatttcttgccaaaatttttgaaatgtgtgtgctttacttggttttggttgctaaatttttggcaaagcctgttttggcaacaaagcaaatggaaccatcattcattgtcattacctttttttttttgacatggttgaattggacaatgaaccagaatccaaattctaaaattgaattttccatttgctcttcagcttatccgccacagccaaaatttaaatttcaaaacttaattttagatttgattctgatgtttcttgctcaacgtagtttatttatattactgcctttttaagtcgctaatagttgtttcggtttataatcggctataggcaagtttggggagtttctagcagatgcggtttcttccagaatcaaaagctgcctaaaatagttcggttttttattcatattccgagaagctagacttacataatttcaaaaaataaactacaagtcaggagttatgctttcttcttcagatttctaaagccggctacctatcacccgcttcttaaaatcgtaaagttcaccaaacagaatccatggtagcctgaagaatgaaaagagagtgaagagaggatgatgatgctacaggcaatgcttggataattggactccctttggcattttatagcattagcgttgggaggagtggtgaggtagcaccaccatgtgtcgtgctcgctgctgatgctgataccagggttcgccataccgccgttatccgcgcggttactgcggttaccgggcttatcgcagggatacggtaatgtaaataccgcggtaacctccttaaatttaaataaatttaaaaaataatttaaatttttgatgaattttgcacggttttgtacggtttttcacagttaccgcggttaccacgcggtaaccgtgcttaccgcaggggcgcggtaaccccggctccggcggtttgggaaactctagctgatactgctgctagcttaagctagtagtactagctgtagctggaatcgatcagtagcagcaagcagcatgtagtagaggcgcatcgagaggcgagagggtccagatgcagatgagatgaggttttggagcagaggtgtgtgcgtcgggcgggcgggggtcaggctttgctacagcctcaggcgacaggtcgcagcgcacgccgcatctcccccctccacgtcccatccatcgcccaccatccacttcttcttcctctcatcagtttttgtttccactttgcatatttctgcagctcggatcttgcaaaagagattcataccacgggtatgtttagttcacggtaaaattgaaaatttgattgaaattgaaacgatgtgacggaaaagttagaagtttgtgtgtgtaggaaagttttgatgtgatgaaaaagttgggagtttgaagaaaaagtttggaactaaactcggcccatttcttgtagtactacctaataatctactctcagcagaagtatagagtagtagttactaccttgttaagataattcattctcatcagaagtttcagcaggattttttactgcaagttcagtttcagcagaaaattttagttcagtttcataagggcaacaccaatgtatcttgtttaactaggtaataagtagcagggctaagtagtaggtctttggaaagtgggtcccatgaggaaaaaaatactgctttttagttgctttttgtccaactcagcatgcagtagtagcacatcttgtgttggaaggagagagtgagagagattttaatgtttttttattcttatgagtgggtcataagcttactacctagcattagttactacccacttccacaatgcttattactagatcatagaaatattatattgcttaatacctgctttttcctaacattgtggatgccctaagaagatttcagctcagtatcagcagaaatttgtaactcagtttcagaacacattttagttcagttaaggtttcaacacaagtttctagttcagtttcactacaaattcttagttcagtttcagtacaaatttttagtacaattttagcagaaatttttagttcagtctcagaaaaaagtttagttcagcttcaacagaaaatttttggttcagtttcagagcaaatttcgggaaataaatcctgcatttgaaacggtgcctttgctgcatatgatcttgttgttgatggtgtcagcgagaggggctgtgaatgcccgtatggatggattatccagagttcagagagagagagagagagagagagagatagtgtttgctggtggtatgcgacgatatggtttcagacttttgatccctttattcttgtggactgtggtgtggtgcaaatgtgcaatacttcagaatgtcagaatgggcatgctcaggaccacttggcaagaggaatatttgcatactttcttgtggggttgcctcccttcatgctcctcccagtcattttctgtttctgttttactatccattttttctttgttttactcacatcctgctcttgtttgtgcacaatttattcagttacaaacttacaatctaggtagcattcagcaacaaagcatacttcttatattgatgcgtagctttcctacgtgttcgagaaaaaaaaaacaaaccatccaaacttctcaaattgttatagcgttgagtgagatgatgttcttctggtcttcctatcaaaatccagtgtgcattgcaaatgagactagaatacataaagttgtacaaattccaagatgaaatggtgagagaaaaaaaaacaagctttttattagagcctcaagtgccaaatgggggtaattagtggggtgcttcttgggatatgatagtttttaatccacacattgcagttgtcagtggagcacccagcctactgccctggtgttaggggcaaggcaatggcatgcatgatacatgagtgagtttagtgagataatgttcatcgggagagattaaataaagagattagtatacattagcaccttcctattgggctttgctggtgtgccttgcatccaaagtgatgccactatctccacaaatgcaggctttaccccatgatcaccaaatatgcttatgggaaaaggaattaaaggagaagattttggccagttgaatgagtttaattgcactgtttattctttcagtgttggaatgaaatgtgaggtcaaaattgttctggtgatgtattcagtagtagaagatttttactctgaaattgaccgttgtcctgaagataaatgactgtgaacagtaaattttttacacttctgtaataactgttgctgacttgctgtacctgtacatcattaacctgtctaaaattttttcaaatctttacacaagcagaacaattgatgctccgtggccgtaaaattgtctctcttgtctgattcctgcaatctttggacattcaatccagatctgaaattcttgctgtttctacacaaacaaggagtatactattatgcagttgccagtggatttcaccatcttaaaattgtttgcatttacatcagcacaatagacagaaacatttctatgctgtactacaaagatgacaagatctagcattgcatcaagaagtatctaggaagaacagaaaacaggaaactgttcttagatcttctcctcatcaggtttcctcactgaagaaacttgcaatgctcatctctgcaaaaggttgatgcatatgcattgaaacagctctccaaaatgctacaagcattatctatattgaccaaagatctgttctttgcatctgtacctcacagaagagattgcttggaacataaaaagagctaagggtgaaataatttccatggaaagtgtcatgctcttgttgcttcagaatggcaggcaagggtggtaaaagctgatgggtgcaagatcctgcatttaagcacctgggtgcagttaatggcattactcatgagattgtgtagatggatgtgaggcagttcaagtgcctctgctgggtttgaaatggcatggcaagcttctggctgacagagtgacagagtgcattcaattggttgtcattgctgcatatactcctctctctacatgcagggtactaggggttgaaaatgtgcaattttttatagactttgagatgatgctaacaaaacagtaacacctgatgttttttggggttttaggatagattcatgatcaaagagttgcaggctattcattgacttgagtttcaactggttaaccaccaattggcatgtgtagtcccattcagagatatcactgtctttttattatttttgagaactcattgagttgcttttgggtggtcagctttttcttagagggtaacaaaaaggagggactactggctggctgagtgagtggcatgaaaataagagaaaaaaaagaaaggcaaagcatgcactcctgcaccttgctactacattacaaacatagcctttcaaatccagagcaaaagcagtttgtcaagatcatgcagtcagccaaatggacatcacatttcttcagtgtttgttgatcacacacagatctaagctagtgatggagtactatcaacagccttaacccctaaaaaccctagcaggacccctactttgtcctgaaagccactttcttggcatgaagagagtgaggcaccaaccttcactttccaataaatttctttctcctctctttcactctcatcttccatctctttttcattttttctcttccatgggtgacaagtgaggatgttggccacccatctcccttcactcc

SEQ ID NO: 66043 - DNA, 9362 bp, Oryza sativa
aagcatcatccagtgagtcggctgacaaagaggttcagccagaaaagactgtgccacaggagtactgcaacacacgattgctgccgtttcctcaacggagtaggaaaccgtcagtggacgagcagtttgctcgttttgttgaagtaatccagaagatccacatcaacgtgctattgttggatgctatgcaagtgccaacatatgcccgttatctcaaggatatcctcaacaacaagagaccactcccaacaacggaggtggttaagctgacagagcagtgcagcaacgtcatacttcacaggctcccggaaaagaagaagaatccggggtgtcctacgatcacctgctcgatcggtgtacatcagttcgaccaagccctatgtgatcttggagccagtgttagcgtcatgccaaaggacgtctttgacaagctcaacttcacggtgttggcaccaacaccgatgcgcctacaactggctgactcgtcagtctgttacccggcggggatagtggaggaaaatatatttttataataaatttatcttgggttgaaaatattattttttctataaacttggtcaaacttaaagcaatttgactttgaccaaagtcgaaaaatcttataacctaaacagagggagtacattccgatgacttctagaacacaagaatcaaaatcagtggattggtcaccgcgatcggcctgcagcaacctcatcgcgaggagcgaactgccagccatgacggacacccttgtcggtcatcttcgactgttcgtacggatcatcttcatgatggtcaggttcgaggcttagagctcctggccagcacgccaacgcagaagcaatgttttaggatcttttttagtgtacctttggttcgatgtggaccattgaacggatgagataactccttgctactacatctagtattagagtgtagtagtgtagtagaagggtaattgtgaaaaaattattatagcattattgtaaattcaccattaggattaggtgtaatatgtaattgctaatgggatcagatcgacgctaggtttaggggcatcagccaggaaaatgcttctcttcggatgtcctatcagatacaaaacatcggacgcctaggaccagctcactcctttacttactagtttctcctttctctatgttgacgtcaggaaaatgttgcaaatcggtagcatgtgaattggacgaacccctgtcagtgtaaacatacatgcctagccgtttcttttcattctttcctcatctctttaaatatttttctcctaaattacttatccgatctacgaaccgatcacactgttgtattcgttgcaattaaatatttacaacaagatatcacatgattatattatgtcaaaagaaaaacatgtgtttcaaaccgttaaaacaaaatgtttcatacgtgatagtgatatgtttcaatatgtgccttcggtgtgtttcacaaaattcctgaaactacctgctactactctctccccacctcatgcatgcatgcatgtattttagcaagcttcaaaataatttttctcttaagttacttattcaatctatgatccgatcataccgttgtattcgttgtaattaaatctttacatcaagatatcgcatgattatattttgataaaagaaaaacatatgtttcaaaccgttaatacttgttgtttcatatgttacagcgacatgttctaacgtgtatcttcatcatgtttcataaaatatttaaatgtttcagttgcaatttttttgtttcaccatatataacataatgtttcacttgctggtcaactgcaacatttaactgtccgatttttttttcaatttaaaaaagtttcacatagtgtactcgtaatgtttcactatttatggatcaaatgttgcagtgaattgaaacatcatttcactattcgctgaaacattattttcatataaggtgaaacagcgtccgatgaaatattttcgatctacttagtgaaacaattctgatatacttggcgcaacagcgtgcatcatttaaaaataattcaataataagctattttttttcatcggattatatttatgtgtggtcttgttttaaagatttaattgcaacggatttaatggtgcaatcggatcatgattcggataaatattttaagagaaaaaatagtttaaaccttgcttaatttatgcatgatggatggctggcacacgctgcatgatggggatggttggcgcgtgcgtggatcagacggtcgcgtgaggcgtccgatttttcgtctcgcgccgtacgtccaacacgtagcgctcttccatcagccaggcctttggccgctcgccccccacctctcggcggcgctcccggcgtcgcctgcccacctccctcctcctgtaacaacttccggcggcgcccgtccccctgcgcctacctcccggcgccacccctacccccggcgtctccccctccccccttcccccctctccctctcccggcgtagctctaagcttaactaggtgataccccacgctttgctgcgggaattactaagtaatcttcaatatgatttttgttgtgtgaacaatcgagctattgacaacaaataacgggtttgctgaactttgttataatggagagaaaaattgagtagaatatgtaagaaattgtaaataattatctgcatcgcaagaaggtaggaagaaaattgatgtaaaatcgaggttgttattctgagaacaaaatactccatattacatgactcgtagtaattgttaaacatatatccaagaaaatttgcttatttgttgaaataattagatcattgcagtcttgcagataggatgtccttaattatattcttgattgtatcaaaactggaagacgacttgtataaagatttggtccaattagctaagagaactggatatcgacggacctggctcatgtatttgagccataaagaaggtggagaaatgaaaaatctgttggaaataatgcatacttagccattaattttattccaagcattattatttgaaagcatatacagcaagcataacctacttgcgacatgataggacaagaaaaactcataaattctatcatgctagatatcaaacaaggcataaataaccaagccaagtaggtcattaggctaatcacaatgctaatctagccgcaatattttaatctagatgaacagtaccatgcatataaaaaactcaggtacgaacaaaactagattagaaatgcaccggttcctttcctttgtaaacgaaagaattcactcactgaatggatcgacggagatcagcgagttgaagcagtgcagtcaatcgatgatgtcgagcggccgcgtagaaatacgctgcccagaaacctttacaccgcccccgtgcaggtgcgaatgcggcgaaggctcggagacaccgctcgccggaatgctcgttgcacgacgagcaccacggccggcttggatcgacggcgacgcaacacgacggcagtttaggaatttcagagtagatggctattgtgttctgtgtccttcaaagacgtctccttgactcctatatagagctaacactgaacggcagcccacgctcaatccgttgctcctccgcgtcaaagccggatcggctccgtgagaaacgcagccgccaaacggccacaagcgcacgttctctcttcacgtgagaaccaagtcttcaggtgattgactcgatcagcagaggttgttttatgcaagcatcttgtcatccaacacatgctgatcgtgcggctaagcattaggcatttaaattgatgaaatgatcaatgtttccaagcatgttatttccatcaaaatcaacaaccatttttacacaaagtgatgaaaacagtgatgataaaatggagtcaatgaagaatcattagcaaccattatcgttttgagaatatatatagcaaattaatatgaggatctagtgaatttgattatatatttgatggtctgattcggacaggaaatctgtagtaacaatactctttcaagtttcttcttcatgttgataaactttgacatgtcaagtttagtgattaagtaaacacataaatacttgctacattcaagaatgaaccacatgttacccaagaatatgctgagagcgctcaaaatatggtttatctgcctcaccaaaaaacatatagagatgagagcaatgtaattttgaaaacatgtgcatgatacaaactaatagaaacaggaaaaattacataccgtacatgaaaaatccttgtgtccaactcaagcaaaaaaattctatgcagatcttgtagtgaaaagataattgttctccaaaagtttcatccaagattgtatatccaactactcatgctgaactgttgtagcaattgaaaggccaaagctgcctatagcatgctctaacattaattcacagctcatcggtgaaaaatgtccgagaaaaccatgcgcctgcaatggagaagtgaatacaaaatccaacatatttccttgtgatgcaacatgcaagcagcaacaacggacacctaaaaagaggcaattgaatttaggtattttatcaaataactttgcaaacaatacaaagtgcatataaaacggatgcagggcattttatcaaacacatagtgcacatatgattggttactatgcatacctgtgccaaaccggatgaggctcctgacagacttcctctggatccaaatgatttgggaataggagtctgtccaacaacgcgtacttgatctaacggggactggggaggcaactgatccagagcttttgaggtgactgatggttggtataggatgatttgaaagaggttatgaagaggattagttgggttaattacggcacctcatcttcgcgtaggtggttgcagtttcttgtcactgatttacttcaaagagaaaacagaacatggcgcagttaatagaaggcgatgagtcgtggctgtggcatcgttatgggctgggccaacggaaaaacgtttcacgtaacagaggctgagtaggatgggctggtctggcctggcccaatattgttgaatgtcgatctaacgtccatccggagacctgcaaataatccaatggctcaagagaaaaggatgacgtggcgcaatgtggtgcaagctttatagtctagtgggtaccaactatataggaagaaagaattagctctataggaagaggccttagtttgaagcagattgggcctgttcagtagccccttgactacagttgtacagctactacctccgtcccaaaataagtgcagccgtggatattcgttcccaacgtttgaccgtccgtcttatttgaaaaatttatgaaaaatttgaaaatatttagtcacacataaagtactattcatgttttatcatttaatagtaatgaaaatactaattataaaaaattttcaaataagacgaacggtcaaacgttgaacgtgaatagtgcaaaactgcacttattttgggacggagggagtatatctcttgtaatagactagttgccgtgtttcttatacaatagctgtactgtaggtgtaactgcaaccgctgcaccaataatctaagctgaacatgctcattattgtgtggattgtacacaacatttgcctgattatagcgataaattaaatattttgataataaacttaataaatactagaagaatgtattttaaggaaatatattctttagtcgtgaagcaaataatccggcaaataaactaacaagaattgagaaattttgatttattttttttcccgctgacttgactcatgtattggtatcactggaccagccgcttttcctgcaggagaatgggatccggatcaaacccgccacgcccgcatggacgcaatagtcaactagaagtcagaggatggccctgaccaagagtactacgactatgaataagagtatgatgcgcaaatacgcaatagctttgaccaactcatcttcctggccccttagcgcgtactcatattttagcagcaggttaatcgagtataccctatactactgattaatcagcccaagtgtttggatccaaactttgaatccaaacttctaatttttttcatcacatcaacctgtcgttttcagtcacattgtaacaatttcaacccaaacttccaactttagaagaaactaaacacaaccaaaatttcaacttataatctctccaaagcatcgagtactgacaatttctcatctcgagattcttgtactgacaagtttttattataaaaaaaggaaaaaaaaatcgtaaattagaaggcggcgcctacaaattaagcgagtcaaacattttggtagaatgcaagcaacggacggcagatgtcgcggaccaccttaaaaccatactcctcgatgacaagagcgaggattaccactagttagctttgtaactaggagcctaagccagggaggagcaatggcgagctcgagcttgtcgcgccgtgccctcctcctcttcttcttggaggtagccgtcgccatggcgctgcttcttccgggcggtcacgcgcgagtgtgcccgccgtgcggctcgacggaggtgccgtacccgctgagcacggcggacgggtgcggcgacccggagtacaaggtccggtgcgcggcggcggcggcggggggcacggcgcccacgctcctgttcgacgcgctcaacggcacgtcgtacccgatcacctccatctccccggcgtcgcagcgcctggtggtgtcgccggcgccgttcgtgtcgccgggcgcgtgcgtgtcggtgggcgcggcggcgtcccgcggcgtgcagctggacccatcggggccgttcaacgtcagctcgtccaacaccgtcatgctgctcaactgcacggagctgctgctgcggtcgccgctcaactgctcctccaactcgctctgccacgcctacgcgggcgccgcggggtcgacggcgtcggcgtgcgcgccgctgccgctgtgctgcacgttcgtggcggggggctcgtcgacgtcgtaccgcatccggctgggcccgcagcgtgcagcgcgtaccggagcttcgtggggctcgacccgtcgcagccgccggcgacgtggggcagccgcctcgggctggagctccagtgggcgacgccgagggagccgctgtgccgcacgcaggccgactgcgaggacggcgccgccgccacctgcgccgacgacccgtcggcaaccggaggcgcgggcacggtccggcgctgcctgtgcgtgtccgggctcgtctggaatcccatcgctggcgcgtgccagcagcagagtacgtttaatttttttgcttcgacggctgacagctcggctgtgaggcgcctctaatttttttttatggctgttaattttgatgcagatctcacggatagcggatccaaccatgcgcctctcattgctggtaattatattgcttccttccttcagcgctagctagcgtcttaatttcttattactgtcatcctgggaaattaattaggacctctgttctcgatcgggatgcatgcttgacgcctactatctagttacgacttcaatttgcaaggcgggcgactagccgcttgcttggttttaacggagagagatcgaattgtggagtcgttattcgttgctttggtgaaaactcagtgattaagtaggccgctattacccttttgttagttgttactgcgagtagttactcgctccgtgcacaaatatgaaaatttctcttagcatggagtaaaattaagaaggaaagaatgaggtatggataggggtagaagtgtggtcgttggggataagacgaaaataaatttaaacgagagataaatgattgatgggacacatattattttaaaatctttacatttgtgaataaattttaattgattggaatgtttataatactgaatttttaaaaaaatatttggaatgcttatatttgtagatagagggggtcgtagtattatagttatctgattatgaataagaaataatccaagcatcgaatacatatcaggagcatggtcaaggcacttagtcatttttattcggtatacaataagtaatccgggctgataaaataaaattgaggtcaatgatctggattgaatataaatgagagatcaactgaaagtaggtttacatcagtatcatgctgggtcccatactcccttgcgccaatggtcaacttgcggcggcttacatccggagaaaagcattgaccataccagagcaagtgtaaatctacttaactccatccagagagctagcattgtcagctttacaacacggacgaaccaaggaagttcaacggttggaaatttggaatgagttgctgcacgatttagctcgctttggagtttgtacgaattctccacgcgaaacaatttaactccttcgtggagcccaaccattaaatggatgtaccaagatttttctttgaaaacaatacttaataaataattcatggaggccacatcttggatagtttatatatgaaaattgtctatcctgtctcatggtgccacatcaacttaattaattttttctagatttgggataatcgattgatcaaagttccaaaacatataaaatatatcaaatcaaaccatgttcgctaatcgctacaatgaaaatcaacacaccacacaactcattttaaccattgtgaattcggtagatgtaaccttctatcccacggtaacagcagcaacacacatgtaattttcatctagctggttaaatatagggtgaatagctaatttagtccctcaagtttcaccgaaggtttaatttggtctttcacgttttattttgtccatatagctcctctaaatatttgttttggcttgaaatcatccttgggtccacttaatatgccatatggctatttccagtcaatattcctattagaaaatatcctttttgcccttaatttgtatacaactatacactagaaaagagaaagccaatataaataaacaacattacatatgtacttcccattatttcaatatgtgcacatgaaacttaagcaattgctatcgtatacacttgctagtacataatttatttttattttacataatatactatgtattatctataaaaaattcaagcatgcaatttttctcttttatatatatatatatatgtgtgtgtgtgttatttatgaagaaaattgttggttcaaggataaatttgaactaaaaggaaaacttgaagtacttattatatatagatagattgaaatagaactaaactaagcctctgatgaaactgatgaaacttggaggactactttgactattcacccttaaatatagatatttgatgtttgtt

SEQ ID NO: 66044 - DNA, 639 bp, Oryza sativa
aaacattgtctaactttttgttaaccacacacttttatgcttatttgttgttacatcaagttcactgtaagtgttgtttccatggttaagaattagctagtaatattctttgtctatacagatcataaaaagtggagaaaagttaaattgcttttgaaattatagccttcacacagattagcacgctatttcttaactcttattcattactgaagttgactttagtatcttcataaaaatcaaactggatgacttttatttctgtttcttgcaacaactaataattttagatgttctaatacatgtctctctacatttaacagcagagtagatgggctggctgtttttctgccttgtcatgttttggatcacagaagggtggaaaacgaatagttcctgcagcacgtatacctgatggcaatgcgtcaactagtcgtggaaatgcacaccaatctggtagcaattccaaccaaaatgtggctctgaatttatctcttcttgctccaccatcttctccggcgtccttctcaaattctgcaattccttcaactgcccagtcacctaatcgcttcttgtcaatatctgcaaactctcctggtgggccaacatctaatatgttcgctgttgggccgtatgcta

SEQ ID NO: 66045 - DNA, 626 bp, Oryza sativa
cccaatccaatctccgccacgcctctccacctagcatcatccgtggcatcggccccaaaccgacaaggcttgttggatcatgttacttcccttttcattctcctgtgatctttaccgatcctctacattgtcccatccgctgtatcaattccgtctttggtaacttgcccctgctatcagctccgcccttgctaactaccttctctaccggtatgttcttactatgcttcccgcatactcctctctccactccctcacctatccttgaattttaattcggacttcaccaagctcatcaatgatgaatgagaaggttgatcgggtagaaaacatggagcggattgataagtcaaaatatcgcaaatattttgtttttgaatcccatttgtgtgtggttaggaaacttgcacattaaattatcatagtagtatttcacatgttacacattttgtccgagacattcacatgtttcatgtaattaggcatcactgtaaaatatgtgctaacttgggtaatgtacatacctatcattctgatgcttgctgtgtttgttggcaatgattggtccacgtgtcagttctctattggtagataaatctagattattcatttgaggaaacaaaaca

SEQ ID NO: 66046 - DNA, 3623 bp, Oryza sativa
acccaaatccttccaaatcaaatccctccgcaaaagtctattttgcctccccaggggcgatgggccgaatccctctagggccatcttcccctccctcccccggggctctctttctctttcttccttttaccggtccgcccgcgcgccgcgcgcgcgtgcgcgagaagcgcgccgagcgctcccttcccctccgctctggccgcgcgcgtgcgcgtgagccgcccgcgccaaaccgagtcctccctctccggtccctcgctgccgcttcccgcgcgccgtgttcacgtgcgcgcgcccgcgtggtcccgcccttggcgcgcctggccgtctgggtcgcctggccctgggccccgctgccctgccgcgcagccgcccggccccgctagccagcgcgcgtgcccgagccgcgccgctcaaaccgccgcgccgcccgttgcttcccgcgtgcgcgtgccgtggtggccgaccgcctggtcgccgccgccgtcagcgcctgccgcgcctgtcgctcgtgtcgccgctccgctccacaccgtcccgccgtcatcgccgtcgtcatcgcctcggccccgcctctccgcgcgcaagccgccaagggacggaggcagagccctgccccctctgccgcgacgcccccgctcccctcctccttttcccaaagaagcaagggggcaagccccctttctctccccctttttcctccttttccctctcgccggcgtcacctctgtcgccgttttggccgctagccggagcgccagctcgcgccttgaccgccctaagtcggttcccaaaccgacattgccgcccttaaaacccaagcctccccctttcccttcatctcccattcgcctccgtgccattgccgccgcccccgtgctctgttcgccgtcgccgttcgtcgttgcgcgtgtcggaggagccggcacgagcaaggacgcggaagaggactgcgggcgcgccctcttcctcggcccgaggccggagagattactcccgcgccgtcggcctctcgtcactgcgcccgcccgcacggtagagcatctccccgttctcccttctcgctccatctcctccccttagactcgggtagtagcacgagtagcctccccgtagttagccggcgccacctggccgttgccgtcgctcgccgtgtgctcgccgccgtcgccgcccgagctcggaagcgccgctcgtcgccggcctcgctcggcgtagttccacccaatccgacgctagcaacggattcccgtggccgcgtagatactctcgccgccgggaattggccccccgtgacctcgtcgccgttttccccttttcccgccgccggttgccgccgccgcgattcgccgccgtcaagctccctccggcgaatccgagccgttggctcgtctccccttgtcctgtgcaaccacccggtgtgctcgctttcgcctgtatcgccgtggttcgctccgccgctcgccgcggtcgtccgctgtccgttctggccggcgtcgtcgtctacctcccgccggcccgcgtggcagccacgtaggcgccacgtcggcgccagctcagccaagaccgggtcgagccgaccccggtcagcccctccccgtgcgcgcgttccaccgcgagccgtgaggctgcgcgtgggcccgccgcatccgcatccaccgcgaaccgcgcgcgtgcaccacgtccctctcccaccctagcgccgcgccgcgtgctccctccgcacggtgagccgagccgctgacaagcgggtcccacccgggaccgcgcgtggtgagcccggtccaccggctctctctctcctccctcccgcgcgcgcgcgtcttgggccgctctgggccgccttcttgggccggccagcccgttaagctcggccgagccgccctttctctcgggtcgcgccctagccgcccggggaagtctattttccctccctccttccttttcttttcttttctttttcgaaaaggatttaattaaatccttttcctttagaccaaaaatccaataatcttagaaattcaatatcttcccaaccgtaagtccgtttgactccgttcaacttccaaaattcctcaaatctcgagatctatctaatggcatgcttagaggtcattaatagggctttattttcgctgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgaattgataggatcgcacttaatctgttgtcccgtctgcaaggcagattggtagacctacctaatttgttggatttgatccttcctttgttaattgtgataccatgtccccttgcaaccatctagttgcgtctcgatattcgtgcacccagtgcgagtatcgacggacgccttcaaacttaaaatctgaaaaaacaacttgggtaaaacttgagttttacaaaagacttggaaaacccgacacctgggtcggtgcttgcgaactaaataaatttccaaaaccgcggaccggggaacgtaccgggtgtatggtttcccgctcttgcacttaaggaccgtttccttggaatttcatccaaacataagacaagtacgaccacatgggtagaatgggacacccctggctgagtaactagcttatcaggggagccttgatgtcgagagacatgtggattcgccggggtggtgtcggggaggacccctgggcttcctggcacaatatggtctgggacctaacctgttgttggtctgggacccctctcgtcggcatatggtaaacctgtgtcagctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttaactactgcttgtgaaattgctgttgtggaaaggggttcgatgtttgaaaaatctgtagctgatggaatcagctaggcccgggtggccgtttgaaagttgttggcccgggtggccgtttgaaaagctgttggccgggtgccaacctcgtttcaaaatctaaagactgatacattgcacatactccgaccggacgagacgcactgtctcatccgtgtcgtttgagaagcactcatttagttgtttcagaaaagagttcaaataaaatcaattgcaaaaacaccagcctctccttgaagcctgcattaaacacttatttcccctggcttgctgagtactcccgtactcacccttgctctatataaataatccccccagttgctgaagaagatgaagcggatcctgctgatgaggagttcttccaggagcaagccggctacgatgagttttagggtttcggcctagttcccaagtcgcgcctgtgttgtttggtccaagtcctggcttccgtttcccttttgtatgcagttgtgagctcgggacctgtccacagcccaacatgactgtacctct

SEQ ID NO: 66047 - DNA, 4585 bp, Oryza sativa
ttgatcatggacttttgtgtcctttcacggcataactttccatagctcaccaaattttcactgtgaggcttcatgtcaaatttatgctccacttttccttcacatgaaaatttccctacaacacacaaaggtcatttttgggtgataatcaaaacttagatgctattgaaacttgcaagatcccccaaaatgtaagttgttataaaaaatccataagaatcactggtgaccagtaagggtaactttctgactgggaacgcagtaaactgccagtgatagctcacctccagtcaagattcttgaaagcttactacttactaattaaatcaatccggacaccattgactttggcaaacaacatgatagtatttttcctatatattggagcaacttggacaaaagatgcacacacacgaaggattatgtgaaggccccttagcacaagtgctaaatagatggctactaaacccaaaacaagtttaggaaatactgatcttacaataaccacctagtcacccatgcttcatagtacaaagcatgcactcaaacttgtaggaagccccagacataggatcaataaatgtccaacaataagcacctagtcacctactcattccagtctgattcatgctttatagtacaaaagcatgcacttaaacttgggggaagccccaaacgtagtatgtctaaactcatacaggtaaaatcaagtatgattgtatgaacacagacttctgacatacaggaacgagtaaaaactatgtctatcaggatagtaatatgtacagagaaaaagaacgcaagcagtataagttaacaagctgggaattggactcctaccttggttagactcagagaaaacacacattggtacaaaatccttggacatattcaaggagtaactctttggtgtattgccagtgttagtttgagccatctccatcttgaactgccatgccaatagcaccatgttataatgaatgatgtaactataggcaccacaagcaaaaagaaatgagtgatgaaactaacatagaacggggaacaattatcaaacagagcagagcagtatgacgtatcccgctctaattaaacctctgcactcttcaatgcatctgattctgtctagcaattcgcaaatgggaaatcaactgaaatgttacccatccaatcaatcgtattatcacattcggcagtcaaaccctccaccactacatctatgttacggtcggtgcagaattttgtcccatttttcccaagcataatgcatgaaatctacatttgaggttcatacattaccaacccccacggccatagggtcatatcattttgctcgaagagaatgtactaccattcgaatccgcaagggagagggagtgggcgggggaggcttgcctggagggagggctcctcggagcggaggaggtcaagggagaggacgaccttggcgacgacggggttagggttggagccggcggcgtcggaggaggacacggcgccctgccaggcgtgcgagacgaccggggggcacttcatcagccacacggagcgctcggcccgcgccgtctcgaggtacttggcctcctcgcccatcccgccgccccacgctggtggctccgcgctcgcagtctgcccggcgattccggtgtcggcggcggcggcggcggcgctagggcacggagcggcgggcgatctggcttaacgacggagcgagcgggcgaaggggaggcacacgcggagggcgtgacgtgcagttagatgaacgaacgataatccggccggatcggatcaaacgctgtttgcagatgcaccgggctttcaggaatgaatcggttaccgacgaaagttgatagaattcgaataaattttactacaaattgactcagatgttgttgtgaatatatttaatttggttttttaatcctatcgatagatgatacttgttctgttccaaaatatacatatttctagtgttcaaaatttataccacaatataaatattttttagcgtacttcctcatctcaatggatcacaagttcacaaccatcactccagtcattttctataccatctctagtttaatttctatgcctatttccttctaccgatcatgataattttatatctaatcttaatcggcttaaatttatagaatttgattgtttttttatgaagccgtgctaggagctagtgcttgctatctcataatagctccatggatttcatcggaactgttttatgtttcttgggctttttcgttgcggaattagacctcctattaatgttggctaattggcttattcataagttacatcggcctgccgcttagtcgaaagctatgcaacaagtctgcgatagtttaaaactggaattggcacaatactgcgaagtggtcgtcttcgcttaatttaggtcagaccttgatgctgcgactcaggcattactcaatagatatgcaaggcttacaaaagtgcccaaacaaccacaatacgaaccgtttccaattgaaaaacaaattgttaaattgttatgatttatgctactgtaaacagcttatgtgatcagattttatattttagaacataacttataatttactaccccttcgtcataaaataagatcacttttggatcctcctatttataaaagaaaattttataaagcaaccattgtatcagagtttgtaaaagtaaatgataaatgtattaggagtagataaagagagaaataattacattatattttaatgaagttaacgtattctagtttttttactggtacgtgctagattggtgaaaaataaacgtttgttggtatagatggagcattcaaatgcggaagcgaggctgctatgtaggccacgtctcacgtctgtcaggttcgaaagcaaatgcatatctgtcacaaaacaaatcgtaataggcgcgcgtatatatatgccttcggttaacggccgcgacggccgtcggcccgcctcctccacggtcaccggctagcctgtgagcttctaccgcccgcgtccgcatgagaacgacaggtgctcgacacttggccagcagccagctcgcgttaacacatggccgcgccgcccccgccgccggacacggccaccgattcgattcgaagaaggtacgacgtactgcgacccaagctagatcgatctcctctcgttttcttcaatctccttcattttatactactgcttcgccgatcaaatctgttgttgttttttaatcaaatctgaccatagttgattactccgtactgattagttgtcttgtcctgctgttttacttagtgtacatggtgacagcggaggtaggttaaccggaaagcattttttgatgctgcggcctgcaatcagtactactccctatttctgtattcactcgttcattgtacttaattttttttataattaatattcatattattattagataataaaacataaatactttatgtttagctcaaataaaacaaacgatcaaatattatagacgaaaacgactcttaaaatcggacggagactactcatctcacagttgcggggaccaaaacttgtttagaaaaagaggtgaaccatgacgctcaggctgtcacgctgagcgccctgtgccccgaaggtgggacagaggcggtgccgaaatctagaactccggagcccagcacgaggggaagctcgtggcagtgtccgcgccacgtggcaggcggccgctcatccgtcgtgctcaattgtgcaaaccgttctcaattttcacctgcaattgtttttttttaaaaaaaaatcacctgcaattccacatcatgctgtcatttggcatgttccattccatcaagtgtgattagactaagttaattttgttccgtatgattacagtgacggaatagaatgattctacgagagaacccgtactagtttagttacgagtttatccaacaagtgtattgcatcgaccgttgtttaggttatcttcacaaccgtcggcatccaatctttattccttacttacttggatgatttcgatctttacactagttaataatcgaattaacaagtctctaacttggccactgaccgcgggcggacggcgagccctagctaccactagctggtggccccacaccaccgccaccaccaccacgcgacgaagacgaagccgtataggtgaaacgtgtgtgtatcacggcgtctcccaccgagaaaaggcgacgcgattgcaaccccgcgcgagatcgacctcgcgttccactcccactcctctccaccttcaaatccacgcgagttgttgagcgagagagagagagagagagagagagatttgatttgcgtttgcgttttgcgtccatggcgcagcagcagaggatggtgatagtgggggaggagcactgcggcggcggggaggacagggagctgacggtgaggaagacgacgctgttctgccccggcgacgggctggaggcgtacgaccacgggacggggacgctggcgttcagggtggagacgtacgggcgcggcggggtgtgcggcggcggcgcggcggcgggggacctggcgctgctccgccccgagggggagcccg

SEQ ID NO: 66048 - DNA, 7019 bp, Oryza sativa
ggcgaattcgagctcggtacccggaagaggagtccacggggattgatttgatagctcaagggggcgaggagagggccggggagcggcggatttcgaggggaagtggggcggcgtcgtgggggtgtggcggctcggcgtggcgttgattcccgcggggagagagggggagtggggcgggatgtggtcgcgaggtggaaggggtctcgggtccacgccggttgggacgaggggaggtgcgggatcggcggagggagtgggcggcgtgggcggcggttggagctggccggaggttggggatgacaggtggggtccacgggtcccacctgtcggcctgagtgagaggggaggccgggagggaggaaaagcagacttgcgccaaaaaggggaggcaagccgggccgcgggaggggaaggagagaggattttgggccgagcccgaaagggaggaaggggaagtttattttgttttctttttatttaaattgatgcaatgacctttgtgctattaaaactatttctcgagctccgaaaattcacggaaaattccggagagtacattagggcacaaagaatattacaaaatattcccggccaatgatttttaagggaaaattttaattctcccaacatttcacttggataaattgatttaacttttatttaatttctagaaaatgtattattaattgatttttaaacccgaacgaaaatcggggcgttacaaatctaccccccttacaggaatctcgtcccgagattctgggatggctagaaagaaagccggtgctggtgggcggtctgactgatctgcacattgaactgccacattctgcttcgaactgattgattgactggttgatcaaacctgcacgattgcactggctggattcgacctttctgttcctttgctttgccaaaactggaccgactggttctgcttgaactgacctaggccagaactgcggatactcctgaaacttacttatcttggactgaactgttgaggttggcaattttggtaacctgagaattcaccacgctggctataagaggatgaaaattgaatctggcatttgtaaatcatttaccctatgtccgcttggactggtcccaactcaaatgacaagtaaatccaggaaacctgcttgacctgtctaagctaagcggttgaactggcctcatgggtgtaccttagaattcaatcggttgcccggggatcggcttaattcttctgataccttgcaacttgcttcttcaagtgctaccctgattgcggcactggttgaaccttcaactaaaacagcgacgaagtgaggcaaaactcttctccgagacctacccccttacagggagtagtcttacttccgcgtggctgggatcagttgaactgttgtccttcaaatatagccaacacttctctgatttacaaagagccctgactttgaaaactgaaaacttcatcggtccatcaaattgaagcaatggcgatgcactttcaccccgacaagatttggaacttaacccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgttatgttgtgagtagacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttcacaaagaaatgccgaagggcgagaggagacaatttgcaagtagggttttcagaaaacttgtccttacggtttgaccatttggctcaacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaagggggaacacaaggacggtttgtggctatttgcataaaggcggttgtaaaacattttattgagcaaaacagtaaaactgttgagtaattaaagtaatattaaatctccactgatcaacgctacaccacgttgaacaggcccaaccaacccacctgtactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgctatgggtgcgactcgcaaaaccatgcatccacagcccaccattcagtcgcattttagttggataattacgaccataaaacatggccagatgtctcgagcacgcagctcaacaagatactagaatgtctaatactgcaattatcccatcgactgagctagtggtaattaagcatggctaagcatatagttctagctaggtcacataagtaacacaagctagtcaatttattacccaaggttgacaaagaacagatatcaagtaaacatggcgcaagcgagcagataggaaaaccctgatcccatgtaattagcaaaacatgcatatttatttgtaaacggtaaaacatttataaattgggatcaacatgctcaaggagaatgtgtgacttgccttgcttcttcactttgatcttctgaactcttttcctcgcgaccgcggacttccgaaacgacggaaactacacgctggcacgcaaaacgaggaaaaactctaataaacaccaagaaaacagtacataaaaagtaaacaaacatgtagagctcaattttagatgaattttgcaagttgaatggctcaattcggagttcgaatgaattagatatgaattttagaaggttttgagccattttaatgaatttctagaattattaccgatttattgcgcaatttaaatcaattatgacgtcatccgacgggggagaggtggcgccggcaagcgggccccacctgacggtgactcacgggtggcgggcgcaccgtggaccgagtccacgcatgcgctggtccgcgggcgcaccacgtggcagacacgtggcggccacgacggacggctagcggaggtggcgccgacgtggcgccacagaggcaccgacgcgggcggcacgggaaggccacgtggacggcccagatcgccccgaaggaggatcgggcggccacgggcgagcgggagccagctcaccggtcggccggccgggagcgacggcgcacggcccgatggtcgccggcgacgaccaccggcgcgacggcacgcacgggaggcgacgaaaagaggggaaagggaaaggagatgaagggggtcctcaccgaggagcgccggcgacgggacgaccatggggaggcgaccggcggcggaaaggatggcggcggccgacacgggaggcgacgggaacggcggtccgacgacgcccgaccatggcggagccgcggccgagggccggcaagacctagggaaattattggagcggttagggagggaaataggcgaccggagcggcgagaataccacgccagagaggagaggaatggtggggctcaccggcgaccgagaggtaccacgttccggtgggtttccggcgatgaacaacggtgaccgaggtgctgcacggcgctgcgaggcgagaggtgaagacggagcgacgcggcggcggctaaggcgacggtggcacacggctggaggcggcgtatggtggaggtggctcgggatgcacggtggaagggtggttgcggtggtggaatggggaaacggagcggaggccggggtagagcttggcacggcgttgccgacggcgcaagcggcgaggtgcggcgacgactaacgcagcggcagcggccggctgaaggcggtgtgtggcggtagtggctcggcctcgcgatgggaaggtggttccggcggtggaggagggagatggagtggatgccggggtgcggtggggtggtgtgatgctataggtggtggcggcgcagcgcggcagcgacgggagcggcggtggcgggcggctggagatcgccggcgagcggcggcgaaggggatcggcgtggagagctcggtagagggcgtgggggactcgggaaaacggggaaaaaggaagaggagtccacggggattgatttgatagctcaagggggcgaggagagggccggggagcggcggatttcgaggggaagtggggcggcgtcgtgggggtgtggcggctcggcgtggcgttgattcccgcggggagagagggggagtggggcgggatgtggtcgcgaggtggaaggggtctcgggtccacgccggttgggacgaggggaggtgcgggatcggcggagggagtgggcggcgtgggcggcggttggagctggccggaggttggggatgacaggtggggtccacgggtcccacctgtcggcctgagtgagaggggaggccgggagggaggaaaagcagacttgcgccaaaaaggggaggcaagccgggccgcgggaggggaaggagagaggattttgggccgagcccgaaagggaggaaggggaagtttattttgttttctttttatttaaattgatgcaatgacctttgtgctattaaaactatttctcgagctccgaaaattcacggaaaattccggagagtacattagggcacaaagaatattacaaaatattcccggccaatgatttttaagggaaaattttaattctcccaacatttcacttggataaattgatttaacttttatttaatttctagaaaatgtattattaattgatttttaaacccgaacgaaaatcggggcgttacaccagatccatgcttcacagaggtacttcgtagaaattccgctatcaaagctcggccaacacataggaagctaaaaaaggatctaatcgagcacatatggcaacgctatggaaacaaagaaaattagactaaaggcattgtaatataattattatatttatggttcctaaaaaatattgtaatcgtgtatcttattcatgcttgatagtattatatcaaatatatagccacacaatggtatacacaaatgcatttgtagtttatcaaagctacatgcaaagcattaaatagcttacagacagaccctctgtctgtgggttgtatgagctgtctttatatccgtctggatgataacttcgaggttcttgaagacacacccctgtatgtgggttgtacatgccctaacactcctactactaccactacacgaatagcaagttgcccccaatccgagacgtgcatctctaccagcaaaactgcgtgcgactttgacgaattctgcctcagcgagtatgcccattggctgcaacaatataattcgcttcacggtcgctgaatttttccttcccggtttccattgaccttgtactggtttgtgtgtgtcggtatttcccttacaaaatgatgagttggtgtgtgcgcgcaggcgcagcgcgctactggttcaaagcaagcagccacaccttccgcgaaccgatcgttcgatcggtccagccgcgtccggtttaatataaaccggcacccgtaaagcgattggcaattcaatcggtattggattgatcaatcatcgtcacctcgttttgcttgtctacttcgatcgccgcctccgcagccgtcgtcggagaggaggaggaggaggaggaagaggaagaggaagaggaagaggaagaggaggagtgggagatgaagaaggaggcaggggcagggagcaagctggggaggtggctgggggcgccggtgcgggcgctgtcgagggcgtgcgactcgtacgtgcggaagatgtcggcgtgcgcggggcacatgccgacgcacgcggcgggcgccatggggcggggcgggttcgcgccgggggcgatgcaggctacgacgttcagctcgcggtcgcggcgcggtggcg

SEQ ID NO: 66049 - DNA, 9848 bp, Oryza sativa
accgcctttatgcaaatagccacaaaccgtccttgtgttcccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacatctgggttgtcgcttctttgcacttcaggcgggagcactatcgttgcacttggattataattcaaatccaagacatctctaattgcttccttctcatcttccactatcatattgtgaaggataacacaagcttgcattatgttgataacgtccccctgcttccataaccttgctggtcgacgaataatatcaaagcgtgattgcagcacaccaaatgcgcactcgacatctttcctcgccccttcttgctttaatgcaaataatttgtcttccgccaactgaggggccgtcactgtcttcacgaatactgcccattctggatatattctatcggcaagatagtaacccatgtcatattgtgttccgtttacgttgtagtgtaccgttggagcttccccttttattgcttgaataaatagtggcgacttgtttagaacgtttatgtcattctgagacccggcagtaccaaaaaaagcatgccatatacgaagatctttagttgccactgcttcaagaatcatagtaggaacgcctttgttaccactagtgaacatgcctgcccaacctttcggacaattcttccatggccaatgcatacaatcgatgcttccgtacattccaggaaaaccacgagcctcattttcttgtaagattttttccaattcatcggctcttggcaggcgtagatattcgtcaccaaacttttcaatcaccccttcagcaaattttcccaaacattccaaacaagtgcttgcagcaatcctcaagacttcatcaagttgatcagccgcggttccataacctaacatcctgatagctgctatacacttttgaagcggtgaaagactattcctaccagttgcatcaactcgttgggtgaaataaggagaccactcactaagttcatgtacgatacgcagaaacaacggccgtctcatcctaaatctcctacgaaacatttcatcggtgtagataggatttgcggaaaagtaattagcgacaagatcatcatgacctcgttctcgatttcttggtatgtacctccttggtccactctgtcgacgacggcgagatacggacgaagcttctccatcacctgcagccttgaattcttctgctagcaactcttcgatgatctcatcctctgccagcaactcttctacggtgaacacttcaaaattgtcggcttctaggaagtcatcatcttcatgcggctccatttacagaatgaaaaggagtagagggtacggtagtggaaaggagcacatatacataatgaaaaggagtagatggttccattttatagtataaaattgaggcttgaattcacgttcacattcacagaaacgggcatgcacataactgaagcattcacataataaaggagcacatatacataatgcctgtaactgaagcatgcacattcacattccagaaagaaactgaagggtacattcacattcacataagcaaattagtcctctcggcactccaacagaaactgaaactgaagcatgcacattcacattgcaacaactgaacctgaagcatgcacattcacattccaacagaaactgaagtgcacattcgcatttacaaatcacattcacattaattcagaaactgaaactgaatgagacctctcggcattccaactgacctcacaggatgtatatatctaccaggatgtatacctcccagccatgaccacaatcaaatcaatatttagctcccagtatatacctccaatgatcaagctctgaatttatttcctaaatttcccctttctgatcatttgcagattctcatcaaagtatatgtatagagacatacactgaacctgctgaaagattatatatactcatctttttccctagattatatatgtatagagacatatatgtatagagagagtacaaaaagaaaaggaatgcaataaaaggctaatatgctcatctttttccctagattatatatactccatatcagtagtatagtgtatcactgaacaagctagttcatttcagttacagggttctagctaactaaatctctgcatttgagtttggctcgcttttgcgaattatctcatggcagctagttcatttcagttacagggttctagctaactactgtaaccatataacaaaggaagggattactgacattaataatcaggtagtataaacagagtaacatctagagatagcttcatccaatccacaatcaattcataatataaacaaccatcagatttttatttctctcaaaagttgaatataacctcaatatcattaggataaaatgctgcatgatgcaaaaaaatttagagtcaagtaattaaattgtagaatgccttttccaaacgagctggggctgccgccgccgcatccgaggcctcaggtgtgcctcccttcttcttcctacctgcagccgccgtggacatctcagcagcacccaaatcaagcgaggggagttggagattgggggagtgggagattgggagagattgctgcgctatatgctggagcaaatttcccggattgggggagtgggaggggagttggacgaacctggatttcgcggggaaatttcccgcgcgcgcgctctccgcgcgggatcctgccgcgccgtcgcctcgggacgacgagctcgtacaacggtgctgagcttgcctcttccgcctcggagcacgggtcgtcgccatcgcctcgcgagaggacgcagctcccgtcgcttgactcaaccggggggttttttgcataaaagacatcacagagacggggcaaaaagacccgctgtacgtgcccttagcctggccgaccgggttgtagtacaagtatagagcagagacaactgtattttgatttttgcatgtgcagctgctcaccaggagggattataaaaacgaaactgggtttcacacacacaaaacgtttaacgtgcacgttggttttatggttttgtgtaccacttggcaggattgattcttggaacttgcagtgtggatatcatcaccgtagtctactactggatgcttatggtggtgtttggatccaaggactaaattttagtccatgtcatattagatgtttgacactaattagaagtattaaacgtagactaataataaaactaattgcataaatgagagctaattcgtgagacaaaatttttaagcctagttaatccataattagcacatgtttactgtagcatcacataggccaatcatagattaattaggctcaatagatttgtcttgcgaattagtctagggatatggaatgggttttgtcattagtctacgtttaatacttctaattagtgttcaaacatccgatgtgacagggactaaacattagtccctggatccaaacagggtctatatatcttctccgacgatcatgggcggatccagaagaagatttaagaggggacttatctccttcttccttcttcaatctcccctactctcattttctctttattattgccctttcgtctccccttctatcaatggtgatctagcggggtagggggactcgagtcctcccagcacccacgctggatccgccccaatcgacggtaggagcgagtattaaaaagtggataggtctaagtgtttagatggagaagaaagaaagaaaggaaatgcgttgtatgcacaagagatgagccatgtattcatgatgtagtacatatttatatgttactattatatgagtaaactatttgattagctaaaatattaatttttaaagttagtaattgctgtactattaaacttgttctaatgctagagttgatctgatgactcgaaaaatggagtttaaggctgcgttcgagcgcaggagaaagagagaaagatagttttgttttccgcgcgcacgcttcccgaactactaaacggtgtgttttttgcaaaaaaaattataggaaagttgatttaaaaaatcatattaatctatttttaaagtttaaaataattaatactcaattaatcatgtgctaatggctcacctcattttacgtattttcccaatctcctcaatcccctccttctcaaacacaccctaaggcgtcaggtgtatgatgcaacagcaaaccgatcaacagagccatggttcaatgcagctagctagtttagtgtaatcgcacaatttcttcacccatctactaatatgcaaattgattaagactcaccacacacggtaacagctataagtctacaaccgatgtaccgaccggcaccatttgcatgcgagtgcgcgattaattcaccaaattatcaacccatgatcatcaagttgccccatctttcttgggacaaggaaaaaacacgaaagtgtccgtcacagtctcgttttctccccaacttttgaacttcctttcgaagctagccggattgtgtacgtgatcttggtgttgtttcgatttttttacttgattaatggtgttgtttccatgcacgatcctacccaaccctttattatttcatttcatcggcaaatgtaatgcccagtgacggaatttgttctgaccatgggactcaagaactgttcggctaaaaacgtcactcatttttatccaaatcaaatggaggcacagagaccggcaaaagtttgtggaagtaaatgcaccggggtgttacgagagtcgtgggtgtatgaccttattagggtttaaattccaataccaattctatagaaatttagcgaggctatgaattatcattggtctccatttatttaaatgcatgctagaaaatattttgtaggcgtgtaagattgcgttcagaagtgaggtgagaaactttacctccccgtatgtaaaacggagcgatttactaacgcataattaattagctaaaataaacttgaaaatagattaatatgatttttttaaagcatatttttttagaattttttgaaaacgctgtttagcagtttgaaaaatataaatgcagaaaacaaggacatttagcattttgagaagagcgcgcgtggaaaataagattagatggtaaaagaataccaaaatatggtttattaactactattagtacgtgtgtggtgatatgtgatacatgtgtgggtgggtgcacagagatggacaaaataaaacgagaccgaaaaccgatttaaaaaaccggaacactaatcttatgtttctagttcggtcatcttttgataaagaccgaacatttttttaggtgtcttcagtcgtctgtctcaaaggaccaaatacccgaagtgcccaaagatagggcttgcttagttcgctggccaatttttttaagtatataggcacatttaaagtattaaatgtagactaataccaaaacaaattacagatttcgtctgtaaactgcgagatgaatctattaagcctaattaatccgttattagcaaatgtttactgtagcatcacattgtcaaatcataacacaattaagctcaaagattcgtctcgcaatttacatgcaaactgtacaattgatttatttttcgtccatatttaatattccatgcatgtgtccaaacattttatttgatatttttggccaaaattttttaggatctagatactcccataatctaagtatgtgttttgttttgggatgaggtaagatgggttggactcatccttagtttcggatgcgattatctcgtctgtctatttagcacgagggatgtgatggtcttactttaaagaggatgacccatatgtcaaagaaaagtgggttggattgatccgctagtttttgaggaaccagtccaatccaaatctcaggagaatatccatttcagggatcatcccctctcacctattcccaaaccaaacaccttaaaaagtgagttcgatccaatccaacccactccgtcccttaaaccaaacacatactaatctaaccatcccaagtgcactttaactctcttaaatatatattgagccgatccataccccacaaccgaaaataatactaactcctacaaccattaaaaatgtgtaaaatctctgtggcccaagtggcctagtccaagcacctctcccactttcccacgtataggagccaactcatgaaaagaaaaacaaccaaaatttaaattttcaaatttaattttgaagttgatttcaaaatattattaatatatttttaaatttacttctaagttgttaaagaacacacgtttaaatgttttacctaaaatttattttttattttctaatgaaacattttagctcattagaaaacttgggcaacagactaggtggtgttattttctcctaatatgtagatgaagttttttttacgtaaaaacggggtggtattaacgtataattgattgagttttaattattataaatttgaaaaatagattagtatgatattttagagcaactttcatataaaaagttttcgtacgaaacgtatcgtttagcagtttgaaaaacgtgacataaaaatcttaatctttatccaactcttattagagaaaataagattacgttattacctaagggtgtgtttagttcacgttaaaactagaagtttggttgaaattggaatgatgtgatggaaaaattggaagttcgtgcgtgtagaaaaattttgatatgatggaaaagttagaagtttaaagaagtttggaactaaactcctgcaatgttccaagtttcaactcgtttcacacgagccagtgtcaccgacaagcaggacccacgtggcagattttggcgccgccgcgtcgcctctactccctccagcggtcagcctccttcccaaacaagctaccgcccagattgaacttgaacgaaaactctggagggaaaactcccgccaagataaaatcttcccccaaatccctcctccttctcctcgcaatcattcctcccaaatctgaaatcttgcaaggactccacgcccgagagggagaaatcgagggatcggcaatggcggacacggggagcctggagaagatggggcgagagctcaagtgccccatctggtgaatgtttgattccccgctcgatcgattcgatttccttttttgcgcttcgtctttggattcgcgttctaggacgatttttggttcttgggttcatctctcttttttctcggccatcttgttttctcctgatgttttgttggttgattctctccgtggtcctgaaactatttctcacgggcgattttcttttcgttcgtgtggcttgcgatttgttgtgctttgtattgattagaaatcttgttcttggcagcctgagccttctcagttcggcggtatccatctcctgcaaccacgtcttctgcaagtaagtcttcatctctcactattccgcctcgtcgtaatgcagttaaaattcacagcgtcctggatggtcttctccatttcgggcttatatgctgaaattttccccattctgcagtgattgcctcacggaatcgatgaaatccacgtcgagctgccccgtgtgcaaggtcccgttccgacgacgaggttagtgttgtgctcttgctgaattgtgtctacttaatcacgtgataggcatgaaaaacacacgaattaaactaactgcctaggtttagtgtcactcatggatcggacattgaactattagagtttcttatgtactccaaattcgtagtaatagaatatgtcacgtccggtcctagattcgttttttatgggactgaaggagtagtgcttatcggactgccggtgataaatttgcttttcgctgagcatgggcagcacacctcattcagcaatatttcaaaatttgatatgaagtactgtatttgatgaacttgacctttagtggaaacttggatatgataccttaatggcttcagcttgatatctacaaggtccaaaactgacactcaagggcttggtttgcttgcagaaatgcgaccagcacctcacatggacaatctggtcagcattttcaaaagcatggaggctgcagcaggtaccaatgttgtctcaacacaggaggctcctgtggtaaaacttgcaggtaattgtgttgtagcatgttcttattctattttctagcatatgtgcaaagtagcaacctcattgattgatttagttaaagtgatttttttgtaactccttttttgtactacactgttcaattcagttacaatgtttgttttgcatctcttctgtgctacattgtcaacataagttaacagtgattgttctgtgcttctttgtctgtaccccattattgaattcatttcaacataatgcttgctggataattggctctctatgaaaaaaaatctatgcttagagaagatggatagttgtcaatctttagctcactatcttgttcatgtttgaagatggatcagattgtgtcaacagcgggaaaaattccaaaaggtcacaaaaatcattgacacgaaaaaggaaggtaacatccgagatggaaaaaaatacagcaaaggatgctacagcttctgcatcccaacctactacaaagccttccttctctactaacaaaagaatacaagtgaaaccattccctgaatctgagacaccaataagagctgagaagattatgaagcctgaagagccaaaaaataatctgaataatgatgttgaaggaaagaataaagcagtggcatcgggtcaacctggaagtccttcattgtcaccctttttttggctaagggaacaagaagaacaagaaggctgtaccgctgagacgttaagtgaaacgcaatctttagacacacccttgcgtcataatgcaccctcttttagcgatattaaagattctgatgacgaaatccctttaaatacaactccaaatgtaagttcttctgaccacctctaccgttctttttgaatttttcttttggcttctcattttgctacatgagtttcagagcaaagctgcggctacagaactctttgacagtgaaatatttgaatggacccagagaccatgctctcctgaattgtattccactccattgaaaaagcaggtattttgctaagtgcctaagtggatcaagaggcactatacttttctcacttttttcctcttttatgacctgttgattttcatttattttgcatttaatatttgatgactcagctattttgtctgttcagagtaaagctaagagtaaactagatcaaattgaagagaagggtgatgaagaagatgtgcatattggtggttcatttgataagctgggtaatgcaagtaatgcagctcagcttgtcaatacaaaagcaacaaagcagaagagaaagaaaacaagtcccagtaacaaaaacagtgcaaaattgtccaatcgtgctgagccctgcataaaaaagtctgatgccaatcaacaaggttcaaatagacgtaaaagtgctgccctaaaatcttgtcagaaaagcagcagtgctgtagggaggaatactt

SEQ ID NO: 66050 - DNA, 5799 bp, Oryza sativa
aatgactaatcataataacgttagcctatactttatgtccagcatttttaaagtttgggtgtatacttggatacattctgaaaatgatcttccgtcttaaaataaatttatttttcatctatcctacacatataccaatacaaaattaaaaaaataccctcaatcaaatatcaatgtaattatttctcaatttatctattcctaatgcatttatcctctacttgcttaaaaataaacttattttggaataaatggatgaagccaaaaatgattttattttaggacggagggagtaccagtctaatgttttttgccgttgttcataatacattcagcaacagcattaccaataatgtcgcagtgtcaaggctcaatagtaatcaagccagtaaatcaacaatctgatattgctactcttatcataggatagtagtactttcaaagtttcgatacaatttcgctattacacctggtagcaatatgcaacccatgaatgccatgaggcactgggatattacgtcagctacagagttttgcaggctggggttgaagttttgaacatccttgtccagcctagagaatgttaaaaatctgaaataattctggaagccatccttggtgatgcacactgcctcctacttgatcacctcatagacaaatttgcttacatttccaggcttgaaatttcttggactggatcacctctcagctctcgctgcaagttggaaaatccaagtgagatcaactgatatgctacaatgtacgagcaagatttatacatgtcatttcttatacaaaaggagttttttttcctcaggaattctctgttttctgtaaaattcctactaaaatcataaaaggagtgtgtttttttttcttggaacaattcttagtttcctatgaaattcctataaacaccataaactcataatcatgtgataacggaatgaattgtgctgtgccataagctcataatcaaaatactccctccatcccaaaatgtacgacgataactaacattataaaaaaacaaaaaatccctccatcccaaaatgtacgacgacaaccagcatcataaaaaagaaatccctccattctaaaatgtacgatgataaccaacatcataaaaaaagaaacggagggagtagtaataccttttgtattttttttgttgttggaggggaccttcttccctctgccggaagccacatcgtccatgctctgcccctgcctccggtaccggccgccggaggcgacgaagccggggcacggccggtacgccttgataggccaccacccgaagccggggacggtggctatgccgccctggatccgcccctcgccgttgcaacccctctccacctcctcccgcccgcaccctctgcatcccctgcatatacatacgcagttacgcacacggcattgtcaagaaggtgcaagaaaaagttgagctggtatttttgaatttctctcttctttgatacaagaatcttactacatgtacataaagtagtttttttttttggcaatcttcagaagtttcttttttacaaaaagacaaaaaagagctttggcttacaaatcatgaatttgttactcaagccaatatatgtagagatgaatggaaaaaaagtgcttgccactccaaccaatatatatatatatatatatatatatatatagagacacacacagccactctagccaatatatatgaataagatgaaaaaaaatagggggattaagagtccaatgtcctaaccgctagaccatggaaccgcttatatccaacatcctaacatatttaaattaataaacaaaagaacttgtccctgccgattgctaggtccaggaaacactgcattatgatcaatataatggtcctatagtgttcctgttcagttgattcttgtcttgtgctgaaactctgcatatactatcaccaacctaacgaaccaccaatacttactaaatttgttctcatttcatttggttctcgtggaatcttcatagaatttaaaagtcatcaagataaaaaaaacgctgtctcttctctcctctgaattccatcagttgcacgaacagaaactgtcagtcacactcgcatggcagctgacatttgatttcccaggctcgccgccggccggcggcgccggcacgctcgcctcgtccagccacgcaccgccgccgtggctgtcgtcgccaccgccggctggtgttctgctgcgcgccggcggccggtggacggcgctaggcacggggaacggccgcggtggcggtgtgccgccgttcgattgtctttgagcggtccagattgagtgatcggtgtttggtcagcgattttgtttgggccttcctgggtgttttctgggcttcaggcccaataccacacgtatcatttccaggcccacctctttaggagaggatataagaaaattgagatatttaaatcgaggttagatgttagcacatgattaatggatgagtattgattattttatatctagaaaattgattaatataaatttttaaagtaattttctatataacttttgatagaaaacgtacgtttaacggttcaagaagcgtatgtgcgtggaaacaaatcttccatctttctagttatctcgaacgctgtcttagtttaaattttagattagactgcagctgccggagttcatggcatggatgaagcacatcgtcgccggtcgccctcacccgccgctgcggccacaacgtccatcgctaggcaagtagaaccctaacatttttaatggagcgcactgtgcacataaatttggatatagagattgtacttgtactcttgtaggtgtaattggtatgtgacttctcacagttggtggataagaggtacctgtccttatatgcaaattgcactatatatagtctataaatagatcatataatgttatagataggacaggcctggttcattatcaaaacaattaaacctgaccaaatattaggaatatagtggattttggtatacttttacactagtgactttcgggagagatttgggattacaccatcatataaaatagaacccgtctaaatgttatccccataaatagacttcactaaaatggcattctcaaatagaagctacacgctaaaccttttgcaatttaaaatgatagaaatgtcatttgtccctctacttatcttccacctccaggctcggtgcaacaattggggtgggaggcggagtcatggagctgatagggtcaacgagatgatggtagatcccttaagtcaatatcatgtgtgttcttcagtgataaggcatgcactatcactaccacctaccacattggagctccacaaaggacagttggtacatgagcatgatgagaaaggacagccaacactggagttccgtgagaccaggaacttgaggaggttgtggctacataggagcttgacgaggacaatgatgcatgggcttgaagagatcacaacgcgagagctggatgaggacgacaacgtggaagctaaaggaggttggcgggacttgtgattgagcattgggccttgagctggtggcagtgcgagaaagtgcctaggacggtagtgaaacatcaaggactaaaggacggatccagacaacaagcatggtagaggagggtcttcacatggaggacataaggaggaaccatggcagtgaggggatgaggtggccacaacagcctacaccccccgaggagaagacatggatgatgaggttcagccagaactagaaaagaagtgaaggtccaagggcatttctagtgtgcagctctttttgcaaatggtataagagtaaagcccatttacataatgatatttaggttaaacctatttttacgatgacataatttcaagtttttcgaattttggtagtatggggctctgtttggtttaaaagttcacaaaattttagtatacttttaagaaagaaagcttccaaaactatcatattttagcacgaaaataatggtcggattttgtttattttgtgcccttaaaaaattggtaatgataaatcgataagatcaaaatataaacatatctacatctcttttcttttagagggtctattcgactgtttgatatagtatacacaacacaactagccagtatatccgttgccacagacataaattattgtgcttgctagctgtgttgcagccgaacacaaacccttccatatcccaaccgtatcctctgattgtataatgtcaccgcgtgacattacttcaatccacaccatccaatctaaatcaacggccacagattaattggtactccatctaactaatcaaactaactagcagagtatgtactatgtaggtatgtacttaataggtgggaaggatttttttttaacactaaagcagtctcttcatcttcattaaacattaacccatcggcttgtagattaagaattgccccgttccgacgacagaggatgtggcagcacaaaattgatgcacaggattcacttcctccaggataatgtgctaatcgctgcatctaacaagtactaagtgaaacctaattatcatcatgtgccgattcttccaccagtcaacgatgtttgcctcttgaaaatgcaatatctgatctagggacaattatagctgcacaatttactaattagtttgattaattgcatgtcaaataatctacggccgttgatttagaatggatggtgtggattgaagtaatgccacaccgtgacattactgagtaatgtcagaggatacggttcgttccatatcatgcagattacctatctttggtatcggtacaacagctatcttatgtaaaaatttctttatgaaaaaaaaacccgtatactttttttgttttaaaatatataatattcgattagccactatactataaatgtgaaagaagcacaaagaatactactacctttatctaaacttattttataacttgaaataaatttgatccattccataataataaatctacacatattccctcctcccctcttccaaaaaacccccaaccttagattgaattttttttagacgaaggtagtccttccatcccatgaaaaacaaatatagtactggatgtgacatattatagtacaaataaatcttgacacatatgtctttaaaaaaaacttaacctaggcaagtatgtgacatctattacaatgaatctggatagtcctttgtcccgatttattatactagaaaatgtcacatcccctcctagatttagtttttttagaatagagggagtatgtatgtccagatttatagtattaagatgtgtcatattcggtaatagattgatttttgatgagagggagggagcggttcagatggaacagtagtccatccaggcaggcacctaggaaacccaggaattatggccgcatttatgttgtcggtatcacccgtatcacatcacaatacgtcaatatcacatccggatgactaggtaaaccagtgccggagtcagtccagtcactcacaaaatttactcgccggaaaacccaaaagaacggaaaagaaaaaaaaagtcaggcagtcgtcgccgtgctcgccgcggcggggtccatcggtgtcgccggcgccaccaccacaacccagacgaggggagacggcatccaggatccagcaataatagcgcgtcgcggtggtcgtcgtcctcacctaatcccccccccccctccccatccatctattctcagccaaaagctcccctcttctctctctccctctccctctcgctttcgtttcccttttttacccc

SEQ ID NO: 66051 - DNA, 12990 bp, Oryza sativa
gccaccgccaacttctcccgcgacaacctgctcggcgccggcggctacggcgaggtgtacaggggcgtcctcgcggacggcaccgtggtggccgtcaagtgcgccaagctcggcaacaccaagtccacggagcaggtcctgaacgaggtgcgcgtgctgtcgcaggtgaaccaccgcagcctcgtccgcctgctcggctgctgcgtcgacctggagcagcctctgatggtgtacgagttcatccccaacggcacgctggccgaccacctgtacggccccctcagccaccccccgctcccgtggcggcggcggctggccatcgcgcaccacacggcgcagggcatcgcgtacctgcacttctccgctgttccgcccatctaccaccgggacatcaagtcgagcaacatactcctcgacgagcggatggatggcaaggtatccgactttgggctgtcccggctggcggagcaggggttgagccacgtctcgacgtgcgcgcaggggacgctgggttacctcgacccggagtactaccggaactaccagctcaccgacaagagtgacgtgtatagcttcggtgtcgtgctgttggagcttctgacgtgcaagcgcgccattgactttggccgtggcgccgacgatgtcaacttggccgtgcacgtgcaacgggcagcagaggaggagcgccttatggatgtcgtggacccggtgttgaaggataacgccacacagctgcaatgcgacaccatcaaggctctcgggtttcttgcgttaggatgcctcgaggaacgccgccaaaaccggccatccatgaaggaggttgcagaggagatcgaatacattatgaatatcgaggccggcaacgctcatctcaaggagctgcacagcttatgatcagtggtcaattatattagttagtcaaacaacccatataatgcacgggttattatagtttttctttccgagttttctgttttgctagtgtctcctcacgtttcaaaagtaacgaatttactctgtggagttttccatttactcttaggcagggttgaaaatttcggatcgaaatttccgaaattttagaaatttcggttctatcggaccccaccatatgatattatttcggccaaaatttttatttttttatgatttagtaatattttgtttaaattagatcaaaatttattaaaaaaattcatataatttcggaccaaaatttccaaaatttcggtatttcggccacccccaagtacaaatgaccaaaccgaaagattaaaccctgctcgcagctttctacatctgcttattcaacagtaacaaatttacttgcatgaatgcgccccacatcagggttggaaattttggtcatttcggacccctccgatatgatattatttcggccgaaatttttcaaattttttaatttttcgtgaattttggtaatatttgttcaaattcaactaaattttgttcaaaatttcggaaattttggaccgaaatttccaaaatttcggtatttcggtgaggtccgatcaaatcggctaaactgaaaagtttaaccctgccccacatcatacgacaccattcctagatggccataaaataattactatcagcttacaacgctagtaattcttttaccagtgttataaatattggttagacttcgtggtctgcgagtaaaataattaccaccttcctctcgatatagcccatgatctcgtagccaccgtatagtaatatgtttattgatgtgttcaatatacagtataagagtaaaagttgatactaagaggattgttaatctgtatcacaaaatggccatatgaatgaaaaaaaattataggctcaatcacacacgagggatacaattactcacaggtgaatcaaactagaaaagaaaaaaaaatgatacagccaaaaattcatcgtgaagctaggatcctggtggctttgttggatcttgctataaggatagagaggctggtctgtgtcttgtgatggtagtggatagtggagagggaaaccgggtggtgagcggtagtcgacgttggaatcatgaaaggacatagtggcgtggtataaagatgagctcgacgttgcgcagtagcatccatccatcatctagcaagcacggaaaaaatgcaaaaacattctcgttcatgtcatagagacgacgagggaaaaaaatagcaaacaacttccatcaccggcgaactccaccctatcctctacggccaaccacatggagcacgatgtgcaaatgtaagacctgtgcagccgatcagatcaattcagataaggtaatattggagattacacgttaatttgatttgcaaacaggggcttcatgcgtgaaagtgaaggagagtatgtagatgtaaattgaagtgtcatttccttacttgcttgttctgtcaatgtcaccgacgtggagcagccgccggttattgctctcggcctaggtgaacacctccttgctggttaaggtactacctagcgtccggctgcgaggctcgaagcagcaccttcgcctcaaccgccaccggccaccaccgtcaaccgccacggtgtcgtcgtcctcctcctcctccatggtgcatcaccgatctgtgggctaggatggtggatcaattcagataacccccccgccccccaagaaaggaaataatgaagtgagggcgagagtggttggttgggtatggggaaaatataatatatactggaagcgaggaaattgcttttatcgaaataaattatttcctccaataatggtgggagcgggatgatgggacgtggggtgggatcggatgcagggaagttgtttttatctaagtaaatcgtttgctccgataacgatgggagcgggatgatgggacgtgggtgaggtgggcctgcgctgatacatgtttgacacttgctatattaggagcgcactgcgctcctagtagtatctctatttgtttggattgtttttaacgttgattatgtttttcttttaattacctttgcagcatataaattctaactaaaaaagttgatgttaaattaaagatataatgttgttctatcataaatgaacgctaattgttctcatttctgttaacaactattaaaaagctttcatattggttcatactattatttcacacgcgttgtgcaaaatgtatatgacaataaaattgatcaaaattgcctcagcattcactaccaaattaaggatggattaaaacttagataccattgcttccgtataatatataggcaaataaatcatccacataatttgtggctagctagcatatatatcatgattggtacggtgagagttagaattcttctcttccatctgttcacttattttcttcgaaaatgaatttaatttgaaatatgactgcaactatatagatcgagcacgttgatgtgctatagactaaagcctaggtttattgtttgaattacttttcctaactaacattcacgtatttagtcattaaaatatttaaatcaaaactatattgtatatgacgaccgggtcctttatgctaaaaggcaaccttttatgcaaattaattcttcaaacatctaattgatatatgaaagaatttgtatcccttttactcataccataattggattatttaaatatttctcgaaagtatcttcgaattatttttgtttcaatcaatttagtgtagatattagttttgtacgacctcgagcttagcattattggcactgcttcaagcatgtcgacagtctgtacacgttcccaatatcaccctcagcttgctcgcccgccaacgctaacctcgagttcgctagcttgccaacgttgcctccttcgaacctgcctatggtatcacttccctcgagtttgggcagtttgcccgatgttgttgacactgctacccatgttgcacactagcagacaccactactgaaaaattgatctttgctcggtcgccccaaaaccacaatagtcccagttataaaaagaaccgggatctttagtttcagtttaaaaccccatagccattctacaatctttagtcccgattggtaacaccaaccggaactaaagataatctttattccgattcatcccctgtcagcccctgtcagtcccttgtcagaggtgcacctcgctcaacctcacatgtgcccatagccatagagctctgctattgctacgatcggtatatatatttttattcacacatggttgtaatcaagatgctagtttgatgtgtctaatccataaatcatcgtcgagctttgcatggttagcaaattgcctgttgccggcccacatgcatgctgttggttgccacttgtgcttcacttggtggattttcatggtgtttgtccgattttgaaaaaaaaaaacttatcttttggtttaatgtctcgagtgatttttttaaaagtcggaacacgatcttaaattgatatatgatgacacaatcttaaatttattgtcatttttttataagttttgatgtccgattggatgacatgcaaattgccaaatacatcaaatatatttttctacttttttaggatatatctttctacaagttaaaattgtacgtgtaaactttgtcttaattttctgtactactttgaaaagagtagtagtggtggcagcgaatcatccaccccacctatttccattgtaatttaacaatttatcccattaacttctctgtattaaaatcaattaaatctaaatggatagccacatataaagttaaattaaggtgaatattccttatagcaaaatgatagataacacgtttcatggagaatatatcttttatttattttgaatattattattatatttcttttaccctagcaaagattcagctagtctattatatttataaatgctagtgaagtggtatatgatgaaataatatatagtatctcaaatgttcgaatgacttgcaaaggttctcaataaaaatttaaagaatatacatttttacaagtgaaacaatagtcaacacgtgtcttaaattcaagttgtgattttaatcataaataacacaaaaggtgcaaatagataaaaaaaattgaatgtataatttaaaaattaaaagttataattatttaattttattgttacaaataatatataatctaaagttattgtatttaaaatttttcgttggaaatatttccgtaatgaagggaaaaatttaagaaaaataaacggagaagacgttcgtaagtgactggatcctctcgtacgggtatggcatgtctcctttgtttttaatctaactagctaggtggcccgcgtaattacgcggctagcatcatacaaaattttttaattttttttacacgtggttttctttaaaatttgttaaatagtcatctcgttggcttaggattttgatagactgaaccttatcatcattgggtttttaattttatagtttttaaaattcatactagccgttacctcttactccttttctatcgctttgtttgcttccacggtccgccacgatttctacttatgcaccatgaactttaaagatcttatagctttaaagttcagtgtcacatcatttttatttttatattttttagaagtactatcaaacgtcgccactgtactcctttacaatccgcccgctgtacccctctttagtgttattttgatttgaaaaatcaaacttgatcaagtttggtttcttttttttttactttctggaagtcccgtcaataactgcgacccaacttctttatggtctacccgccacccctcctcttaattgtcattggtattccaaaaatcaaacctaaccattattcgggtgttattctatagttttaatgtcacatcaaccatcatcaccatactcctttatggctcacccttgtgccccctctctttagtatcatttgtgactattgtattctagatagattgttcttttaatattccttatagtttatttcgaattttttatttctaaattgtattcctacttttaactctttttataatttcaaaatttatttttatttttattccgtattttgattaatgttgtattgtgtttaacctagactgttctttcattattcctaatttttttattcccgcacaattgcacggctagtatccatacaaaattatatatttttataatgattatctttaaaatttgttaaattcttattgtcttaaaaaccttatcatcatcaggtttgccgtccctttgtttacttgcttgacctactatggttctatttatccttcttggaacctcaaaagttttttttttcgaattttagcatttccacgtgtattcttacttggactcttttttctttatctaattttgtattttattttattttttattccgaattttaattgtgttgtaaatggactcttttttcaatattttttatcccaaatttcaattatttcttaaatgtattcctacttgaaattttatatttattttttaattttggaatttattttattttatttcaaaatttaatctgtcgcaactagatttcggcaatactaaaaggggtagcgaacaagcaaggaaagtggatgggttatgagacaaatgctttacactggttcagaccttctcgatgagaagtaataccctactcttttccagggaaatattccggcgagtgtgttattgatctaacgatctgattgtggttattattctcgccctcaacgagtgcccgacccctccttatataggcaaaggaatcaggattacaagatagagacttcatccttacggtataaagctctacatatactttacaattgtaaccgattgggactaggggatattaccttgatacacaagttaacataatacccgcgtccttttatatacatattctatccacatgaactatcccctatagcagttagatagcatagccatgtgggtatatggtacccataatctccacagtagcccctaagaccttcatagttgacaaaataatcttctaccgagtcatctgtactaatataaaaagcaccagttcatcaaatccagatgttttctaacctttagatctaatcatccgacagctcatatcaagagttggatcaaccactgcgattaacgatctcccacgtctaaacagtggttagggatcgatcaaagcgaaaaagaaaacgaaaaaagcttctttgctcgccgcctcctcgtgcagtcgcgcgccctacctcgcacgcaccgggcgccgctgccgactccgggcgcgcgcccgccagagccgctcgcgggttcaccggcagaaaatcacgcacgcaatttgtcaccccgccgccgtcgcatgccatccttcgcacgtcgttgcacccccgtccccctccaccgctgacttcaccccgcggcgcggccgctacaagtcgctgcagccctgtcactccctctccgttccctcgcccatcgtcgcgcccctgtcccctccgccaccaacttcgccccgcagcatggccgctccaatccgccgtacccgtcccgcacatcgaccatatcccgccccgcgtcatttgccgcccacgctgcctccggatcacccatatccgacctccagcctcgtcagattggcgccgccgccgaccctaagcttgtcgtcgagcattcaccgtcgccccatctgccccccatgccgatccatccctagcgccgtcgccgattcaccaccaccaggtcacgtccatcgtcttcttgatttgctccttccgcttcttatttatcctttcttttgttgatttgatcagaaactttatcctttcttttgttgatttgatcagaaacggcaatgaattttattttaacagagagagggggggggcaggggagggggaattgattgaaaaaatgaaaactggagtttgtttgagtcaatcaaattcaaatatgaataaacatgggaattttctgtttctttagctaggccatgtgcatttcacatttgtaatgttgatggaaaagctacagataggggcagagagtaactggagaaaatagaaatagaaatagaaatgagtagcgatgttagtagcgtacatactttacgcaagtcaatgaggatcaagaggaggaggaggcggtatcctagctaactggtcgtctcgtggaggtaaaaaaaatttctttgattccggcgaacctatggctatgtttcgttgataacttctaaagttcttcctgttgttcatcctgctatacatggtgttcttttaagtctttcctccaatcgcctccttatgttctattataccagtggtgccgtaccaatggctatgatgtgcagtccatatatagaatcaatcactgaaaaaaaatgagtttagataagtcacagccattaggactatattaaatgagtaatgaatcattgtatttgcactttttgcagaatcatggcagtaattacatggtcaggttgtgaccaaaaaaaaaatcagagatacatatgctcaggttttgatcaatgaaccacttgtagacattctcagattttggcaaaaatgcacagatacactacaaactcaagacacgttctttgaatttctgagtacagacagcgaacacattcagaatttcagattgcttcatcagtcatcacagaggacacaaattcagaaaagccctgttgtgagaaatgatgattattgacacttcttgtgtcttaaggtaggtctccagcctctagccactcgatggtatccaaaacaataagttttacgggcttatcaagtagcaacaaatcaggaacctgaacaatcaatttaagaatgtaaatgcacacaaaaaacataaaatttcaattcgatcactaggataaattcaaaaatccagacccaattcataaaatgatgcagttagtacgaaaataatatatctttaaacgatatagctagctcttgtcatgattctgatggtcatttaaaatatctatttgtcaagattttataagtgaacaggatcaatggcttaggttgctttcctttgaatgtagatgcgcgtgctggcatgatatttagaaaataggttttcccttgaatgcacattctattagttaatttaaatgaacaaaatctttatgcattttttcattactttcgagagaagaggacactgtaacaaaggccaatatagaggtaactttctgattgttatatacatggtaatcctggcggcggctatcctacccacgacgaggctacccaggtttttgcttgactccctgattgattcaggttcttgttgccaaaccattctccttcggggtatcagggctactccagcgaggagcagcagccaccttactactaccttgccgtcgcacaatttctgttcatctttttactggaagttatgctaattgactaaaactgtgatggtactacacattgacttgacaattgacatatgtattgcctacaatgagggttctgtagtaggtgcttgatggaataccccagtgaggaaatttgtttttgttctgtaccagagaaaaggtagcgaggagatctgtgagtgaaaaaaaaataacagttcaatgtccaggccacccctttatatttaccagttgtaacttcctcttttgattgcattcagttgactctgcaaagtactgcatcactaacgtctgtataaacctaaagttgcattcaagtgtagtgtttttgaacttgttgtggtctatgagatttattctgaaggattatactgatgatgatatattggtgtgctttggatcaggaaggctgtctcatcctactagtcaatcaaggggaatctaattggtagtataaatatcagagaattaggtgatgatcaggttcaacatcacagattcagatattctcattttctgtgttctttaaccagtggcacaatgtgtgctatcagtgtaattaaaatagggatttcttaatatgtattgctctttggatgatttcagtatttcaacgagttcttaatagacctttttttttcatctgtgcatgcaagaggatgcaacctacttgggatggtggcacctctagccataggtttggaggagggcaacaagcagatgcaccaaagggagctcaaatatgaggaattatgtggcaaaaatagcttgctgaagaggaatcttggtaagatatgacataagttcagaaagttaatcactgctgcaaccatctctggtgagtctttttgagaaagaccacataggaaagggacgagatgagcacttctagctacagatgcttaggcaaagttgggattccatacaaaggaaatgtatttaactttgtatgaattgtacatatgcactaaaaaacatataaatctgctctcttatgtgtggcttcccaagtttgataaactagccgtcaacccgtgccttgcacgggttattggtattggtagtataaagatcaaaattttaaccatacgttcactaggttggccatattcgaattgtagcatgttagattgaaataatagttaagtactcctttcgtcccagaatataagcatttttagagttagacaacggttattaagaaagttggtacaattaaataggggagtgttgtggctgaaggagaagtggagatagctggaaaaattgaatggtagatgattgtgattcgttaagaagagaatgttggtggtaaattgttatattttgggacaaattctaaaagctagaagttgttatattttggtacggaatgaatactacttgttaattattaattttgaatcaaacaaatgctaaatttgtgatacatccaacttttttatttgatattgtggaattctggaattaattaagtatttagttgagtctgtggtcgagtttaaatttaagtacaccctgtaatttaataattttgaaattaaaaaaaatagttatactcagtatggatcctagaagatataagatatatgtaattagcttttttgttttatcattcccaaaactcataataataattagtgatctatagtctcttgtctatttgtaccggttaagtacaaattaaagagtccacgatattgccaattgcatgttttattttttcacaaaccctaaataaaacctaatgttgtgattttgtgattttgccacgatatatgctatttaacgtgaatttggtcacgtctatcatatcaagcctagattgtttactctggctgaaagtaatactcatatgaacctacgtagtatatgataatatttgtttacgtgcatgattattcgcttagtaggtttctagctagttcaaatggataaaccgtgtgtatgattaattctgaatttcgttctctttacgtcgcatgatttattatcgagaagaatatttatcccaaagagtcaggattgctaaaattatgggggtcttagtttcagtcacgtcatgtatcctatatgatactctactaagtatgcttctctctatctctctcatttcctcttccaagtagataataattaaattaattttactcctaattcttataaactgtgtactaaaaaacaaaaggtaaatattgaaacttataatgtaattatagtttatgttttgaaatttagcgtgtaattaactacaatgcaagtgtatgcaatatattgtagttacctttcggttttcataaaagaaaatgtatctccaaattaggctgctaaattatacttgtaaatgaagctctatatattaactgaaatacttgttaggaaaaattgatataaggactaacccaaacgaatgaacatgaacactgaacagaaagctgcaaactacatgtacatatgcattgcatacgggatataccgggcatatggaaaattaaatatagttgattgcattcagagaattatagatcaatatatttttatctgcttctactgtcattaaacaacttgtcaaaatcagaattgacaacttagaacttgcaagtttaatggaataaaaaaacacattcaatatgtaaaagatgatcagcaaatagttgatcattccaatcaaaaccataaattgagtgcgtcctaattaaatagactgctaaatatgtattgcaaattgaacatgcaaaccatgcaaattcaaaggaatacatatatatgtatattgtagatgcagcaatagatctgtagcagatgcagtgacggatgtgcaagtaattttttattttgtagcaaacttttttcccccaaaattcatttggttaaatttcgtttcaggttaaaatttattcaatctttatggagtaaaaacagtacgtcaaaccagagacttaatagggatgaacgatacctctggagcgatcactgattcactggaaacttttaacttctcctcgtgattgaggcaaattgtcgctgatcgggaccacagtctgggatcaaggtcgactgcagcctatgcatatctcgtcgccctcgctcacgtccttctcgatcgcgttcgccgtttctttatcgcttcttaatttccaatctgatttctcacgatggaacttggagataaattagatgggttctgtccttccatcgataactggatagataggatttgcaaggagcccactgagtttaagattgattggcccacgatgttaaagtattgcaggatctacggtgtagattaaacgacttatctaattgacgcttagatctttctggttaacgtgagagctccaaaaaagtgcccgattagtataggtatagattgcccaatttgttctgtaaccgcaagatgccatgaactatatatttaagaacttgtttcacaaaactatatatttaagaacttgttttacaaaactataaatttagtgtactcgtttatcacagaactatacatttagtgtcttcatttatcacaaaagtacaaatttagtgtctccattatcataaaattacaaatttaatgtcttcattatcacaaaactactggtt

SEQ ID NO: 66052 - DNA, 1665 bp, Oryza sativa
attattgggctatcactaggaagtcatctcaatcgggacaaaaaaaagtgcccgattaagatatagtcacgtaaacatattagatgggtataaaactcagacccatcacggatgacatctatcgggccgtagtttaggaccgattgagatagcattccatatctcaatcgggccccaagtttacgcctatcacggatgacaatcatccgtgacgggcgccaacttaggcccgattgagataacaactaggcccgttacagatgactcattcgtgacgtgctgtatactaatgcccgattgagatgacttaatctctatcgggcccatcaccgatgagtatttttctatttttcatatgaaatgtttatatttgtaagttgacctgtagtaaaataattaactacagtataataatttattttatttgtcaaaataattttttgggtagtaaataatttcaaatggaaaaattatcaaccacaaggttatataacttatcaagatttacaacttttagtttggtcatttttctatataatttttttaacagtttgaatttgaatttgaaaatatgacaacttcaaaacaacattttcaaatataaatgatttcaaatggaaaaattgtcaacaacaaacttatataccttatcaagatttacaacttttagtttggtcatttttctatataacttttttttgaacagattgaatttgaatttgaaaatacgactaattcaaaataacattttcaaatactaaatgatttcaactaaaaaagtcatgaacaataaagttgtataactcgtcaagatctgtaacttttatttttgtaatttcttcatccgataaagtgttggtaacattgttcacaaaatttacatatatgtgttatagtttataaaactagatgaaaaatatgtgaattttgtgaacaatattattatcactttgttggatgaagaaatgaccaaaatgaaagttataggtcttgatgaattatataactttgttgttgatgactttttttgttcaaatcatttagtatttaaaaatgttgtttgaagtactcatattttcaaattcaaattcaaactattcaaaaaatgttatatagaaaaatgaccaaaataaaagttgtaaatcttgataagctatacaagtttgttgttgacaatttttccattttaaatcatttactacccgaaaaattatttgaatttcttatattttaaaattcaaattctatgtaattcaatcaaacccgaatagagaaatgaccaaaataaaattggcaaatcttaatgagttctacaactttatttttgacaactttttcatacgagttcatttagtatcataaagttcaatttgaaattcatttttgcctaaaagtctgatttacctcctcttccctctccaccacttcaaaatttcagcaaccttatcttctcttctcactcagtcctctctcaatctccaccttatcttctcctcttccctctctcactcaggcggtggccgggcggtggtttggcaggcgacggcgagacggcaagagcggcggcggcagcagagaggcttggcagcagtggggagggtcggcgacgctggcctcagggcggtcggatccggggttggtggccctggagccgccagatccgat

SEQ ID NO: 66053 - DNA, 666 bp, Oryza sativa
aatgtttcactatatatggatcaaatgttgcagtgaactgaaacattttttcgttatttgctgaaacattatttttatataaggtgaaacaacacctgatttaaatgagtgaaacattttcgatgaaaccattccgatatacctagtggaacatcgtgcaatatttaaaaataattcaataataagctaaatttttttcgtcagaatatatccatgtgtggtcttgttttgaagatttaattgtaatgaatttaatggtgcaatcagatcatgatttggataagtaatttaagagaaaaatcagtttaaagtagttttgcacgtaaatcggctgctgacgtcatgctgacatcagcgcccgattttaacctcttcccatcgggcgcctgagccggagtcgcgtccttgtaagctggtagtaattcttttacagccatctaggaatggtgccgtatgatgtgagtaaatttattacttttgaagggggtatttatgtgagtaaatttgtcacttttaaatgagcagatgtgggagtctgggagtagatggaaaactctgggccagagtaaattcgttagttttgaaatgtggggagactgtaaaaacagaaaactcggaaagaaaaactaacagcaaatattttactaaacacaaaaacagaaaaac

SEQ ID NO: 66054 - DNA, 1264 bp, Oryza sativa
aagaagattgctggttggcttgtggggtccacgtgggccctacactgactcagccgccacgtcaacaaaaccggaaagcaatactatcttgaattaaaagtgatccggttttacaagattaggggttgaggaccgtttaaaactcaacgacaagataagggaccttagatgaactattttgggagacgaaaaaactccagcctcatgggcctgtgcataagacccataggcaggcgacaccgcggcagccgagcgctgcacgacctctgcctccctaatccgtcccgtctcctcgcccgtcgccctcgactcccgtctcctcgcctgccgatctccatcctgctagcagaggtggcgccggcgtcctcctgctcccgccgcatttgcatcctaatccatcccatctggcctcggcctcgaatttcgtctcctcgcccaccgcttgcgccgatccccatcctgcgagcagaggtggagcccggcgtcctccttcttccaccgcatcgtcgttcgccggtgagcatccctctctacccatacctcatcaggtattctgcgttatccctcaaaaagtttgggggttagatctgcctctacccagctccacctactttcaagttgttaattttgatttccgtttttagctgatgtaatttggttactgaatctcatccaaacacccttagaacgaaaaatgtaagctcacatactttgtactcatccaaactcacataaatttcttaagaagaatctagaccacaaactactcatagtcacacaatatctttttatcaaggtatactcttataagaaattttcatttctcaaaattttctaaaggacatactgtgacacttggcattaatctaatttaacttttttttctttatcaggttataaattttctaaaagacatttgtgccacttggcatgaatctaatttaacattctttctttatcaggttataaattgacaccattgaacgtactttatctttctgtccacacatggctaccaccgccgcgacgaccatggtggcggcggtgcaccacccccgcccctgcttccgcgtgcgcgccgcctgggacatgaacccgagcgcctcccccaagcccaaggccaagcccccgcctcccccgccgccgccgttgccgaccgcccccgcccccacccacgccgacctcttcgcccgccacagcaacagcgagggccaaggtaatctccatccctcctctccgctttcccaaaccgctggaagcttga

SEQ ID NO: 66055 - DNA, 1197 bp, Oryza sativa
tttcgcggaatggttatacgagatcgacggtatatttcttctaataaatttacattctgaatatttttgagaaaccaacgaatgaacagtgtatttttaaatttaattcttctctctgaccatctggtcttcattttagtaatgccgctaattaagcatatacttagcactccatgtagagcttgtttagatccctggcaaattttttcatcctgttacatcgaatgttggaaacatacatggagtattaaatataaacggaaaaaactaattacacagattgcatctaaattgcgagacgaatcttttaggcctaattgctccatgatttgatagtgtgttgctacagtaaatatttgctaataatagattaattaggcttaataaatttgtctagtaggttacggattaattaggcttaattcgtctcgcaatttaaccatttttaaattatttgagcccacggtttttattatttttccgagatataattgctacgtaagcgccacgtcaataccacgtgggacgaagacctagtcaaaccagccatgtagttggcacgtcagttaaaaccgccttctaaatcgtcaagggatcttgtttgtgccggttttgacagttcagggacctgttatatctagttttggggtttaaggacgaaaatcggattcggtgtaaagctaagggacctcaaatgaacttattccttatttcattgtcatgcagctgttcctggtttacccataatcggaaatctgcatcaattgaaagaaaagaagcctcatcagaccttcacaaaatgggctgaaatttatggcccaatctacactataaggaccggggcttcttccgtagttgtgctcaattcaactgaagtagccaaggaggtaacttagaagttgtctatcatttctatcgacttgcataactctaaaatgatggtctcacatttgatttgatcataaataacacaaaccaatactgtactctcttttgcaggcgatggttgcaaaattctcatccatatctacccgaaagctatccaaagcactaacagtgcttagtcatgataaatccatggttgctaccagcgacagtggtgatttccacaaaatggggaagcgttatatcatgttaagcatgctgggtacttctgcacaggtatacatctcaacaatttcatttttcatttttagt

SEQ ID NO: 66056 - DNA, 2024 bp, Oryza sativa
tttgcgcaaagcaagttttgtaattcttttcacaagcctaagacctagcattgactgatcaaattttagtaccagagtttgtatttacacaacgacggttctgtccaccatccattgtgatcccaaggatagcttcccgccattgattcgtcatggttttctgaggacgtccaccttcccgcctctcaggaagtggctccaacagcataagattcatcatgcaatatcccctcccacacaagttaagaatttagagtctagccaagtgtaatacatgtcccggtgctcaataaccgcgagcacggctattcgaatagatttggtttactcaaactgcagtggatgtacactttacccgcactccgcgactgcccaacacatgagcctcgtcccaacacatgagacgcgtcacggcaaagctttttgataacctcgcattggcagtacccgctccatgaacttttcatcctcatgcactctaggcgtacacggtttctagcagtgagaggagttctggcgcacccgggaagggaagactcacacatgcattaagttataattatgttttagattctcacatggtagtcctaccgatggcgacaccactgtagacacccgcctcgcggtcctaccaatggctgccccaccgtagagcccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggacggcactagccttttccggacaccacccaagtcctccagccaccccagtcgaaaacagttgttttactttattttcctttcacaaattatgtcatcaatatcatggcaatgtggcgcttatgtcttcacatgtcgcatctcaattaccttcccaaaggtaattgcccaagcatataacatttgataaatatgagtatgcatgaatctaaaatagcatttctaagcaagtgtcatagttgactagggactcgtacgtatctatggttacaaagatttaaaggtgaacaataatcaaggcatggtataatcacaagtaggatgttcatgattgcatgcaattttatttgtaaacaaaacaatttcgcaattgggatcaacatgttcaaagaatagcgatgacttgccttgctcaaagtcttgcgggtcttggccttcacttggatccgcaactccctcgggctctatagttacgtgcaaaaattgatttgaatttggttagaattcaaataaaaatccaaataaatccaaatgaaagtcgaacgcgaaagttgattctttttattaactttactatctgcgaactacggcaaacccaatttcgatttaaactattttgcgggtataattatttcgttgtcaataatttagtctccccgagcattgtatataataggttagaaatttctaccacgagctaaatattggacgaaatcctagaaatattatacaatttaatttagtctatgactaaacgattaaatataatatacgtctaaaattcctagcgattaaatccgaatttttaccgtgaatcgattacttatagggattacccaaaaataatctataataatctataagaattcatttatttgtttagttattaattacatctaaattactaccgcgaattgatttcttatagaaattaccaagaataatccataatttatattaaattttgcaattctacgactataattaatctataattaaattctaattattttaaattttctaaacttccccaaactccctctaatttcctatttatttccttttcctttttctccctttcctttttcttttcttttctcttttcccttttctttttctcttttttctctcttttccttttcttttctttctctcctctctttctttttccctttcttctctccctcccggctcctttctctcttcctcggcttctccctcc

SEQ ID NO: 66057 - DNA, 2579 bp, Oryza sativa
agtatgccccgcgatgggggcgtcagccacggcggcaaagacgaggcggccgtcgtcggagaggtcggctacgtgagggagaccaaagagaacggaaagccaccgaggaacggtggatcgccagcgcggcggcggcggcgcctcgcgtcgccggcgagctcggcgtcctactcttggcagccgagccttcacagcataaccgaagagtaaccatggtgcacgagatttaactttaacacatacttatgaaaacgagcgttatatgagtggtctcactaaaattctgttgaaagtccaaccatatgtatgtaatattcgtgaatataagtatttgaattcaggtgatgctttcccgaattcttttgtattctgtttggctgtctattctattttactccggcgagatcgcccagcctaatttagtttcagatcgttacaaattgcagtcaatggttttgggggaaaaaacgaatttgttcgctaatttcggactccgctgtcaattttgtgctgaatatgcccaacttagcataaacgcttggtcaaactctgggcatcatgtcaaagtaattttgtcattttaacaaagttttttttacaaagaaagtataatttctagcatttgcatcaaccaaggacgcacgcacccataacaaaatttgcaatctcattttaggctgttttggatcagaatttagttgaaacaaggcccgcctggcactcccctaggtcatatgttcagcataagatttagtccaactttcaaaactataaccatcaatttatattggaataagtttacatgtaaacttgtcaatcttaagatagagtgaagtgtacaaacaatgatagagtgaattgtgtggtgtgtcatctaggagtctcaactcccaaaatgtatttcttggtctcttaactagctaatacatgatgggtgtcatatacatccaaacaggtttcaaccaactccatgcgcatacgtggaatatcatagtggtgtctgagtattagtgggacccatatgccaataacatagaaataacaaaatatttaaaaaaatattttgtccactctctcatctctccctccctaaaatctccagtgtcagagaggagcaacggcgcagccttcatggggctcggtgacctctacgctagagagcaacgacgacctctgcgtcgaacacaagcacgcctgtcgtgcttctcaccattgtatttgtcctcgtcattgagctcatatgtccatatctccttctttagcggcgatagctgacctcgtcctcgagctcctccaagaaggaggatgtggttctagggcagggacagtcgctggctctgcccatcgtgactcatgtagttgcggcaaattagatagggttgggtggagaggacgaccaacgatgtggcctctagatccggaggcacgtagctatgggagttgtctaacagcgacatcgtggagcaagacgtcgaggtcagctcttagacgaggacgtggtcgctgccagcggcgaggtagccagataggcgcgctaggatagggcatcccaacgacagtggtggcaatggtttgacggcgggataaagcatggctgaagcagagggtggcgcccgtggtctttctagagagtcttgcaggccctctgcgtgtcgtcctcctccacctctatctccttctctagccttcgcctcgccctttgcctgttcctcgttagtggcatcacgggagtcgggcattgctccctacccatgtctcaccaccgtctctaggctctcctccaacccagctcctgccatgctccactgccatgacctattgcggcgcaccgaccgaatgatgaggacacacagagttcaggacgagctcctagagggagcattcggaaagctacagcggcgaggccgctgacgaggcatgtacgacgacctatggaccccgccccggcgcgcggacttcggcatgcctctgttgctcctcctctgcgccaccttggacttagttgccgagtcctccttcgaccggcaagttgtaagagagacatggggagagagggggggggggagaaaggtgtgagggagaggctgacatgtggccccatctttgcatgggatacaccacagcatgctatatcagcgcatggagcagcttggagccaatttggacctgtatgacaacataaagttcgaggatctgaaaatgcattgagagttgagggatctagatggcacactttcacaagttcagaaatcgcccgtgcacttcactcctgaagatacgtcggcctaatattttgtaagtgtttataggggtaggggtgtgcgtttgtgtattcataggtgtgagtgtgcacatttgtgagtgcatgcatttataccgtgtttctaaataaagtatacatgtaacttttccttaaaacaacggtgcatatagcatttgggccagtgccattggatcgatgtgttcatgctaggatccattcgtgcaaaggaaaatgacattggctcttctatgcctcccatgataatgtgttgacgagtgaaggcagtagggacagtgtctttcggcaccatggtgtg

SEQ ID NO: 66058 - DNA, 533 bp, Oryza sativa
attgacaccactctgatttcgattctgaatctgacttaagaaaccacaatacttattgacatgttcttgtatagggaccaacaatgtacaagtgaactttgggagcgatctgattcgaattccttgttctgatgaaagtagtcatgaatacgtccccaatatgtaccgtgagattgatccatcccttgaaccggatcgaaagaaacatttatccacgccgacaccaaaaggttgtcctcctccaaactgaaattttttgatcttttttggttcggtctcacagcaacattttcattcacaactggttcttgttcatcatcatactggcttcccatctcactcgagccaaaatggttgctctcatcattgatcaagtttgtgtaatatcgctctcgctccatatcatctgtccatagataaaaaatcataaccttgtacttgagaaaaaaaaagactaacaaaacacaaacaagtgataatttctggacaaaaaatgcattctgttatttgaaatttcacatgtattggatggt

SEQ ID NO: 66059 - DNA, 1162 bp, Oryza sativa
tattggataatgatggtatgcccttttgttgtaagtcttggaataagagttcaaatatgcttatatcagtcggcaaaatgtattgttttattgttgttgtggtctaatagacacatagtgtgacaacgaggctgagagcctgagactatgcctgtggtatggatcaagataggtaagatatgctagcaatgcagattgaggataaggacatccatagagaggttgactcgatgttttagtccgatagtagtggagcaaccaataggctggtgatcaggagggtggtgccacgacgagttcgagaagatgttgagccaagaggtggtgaggaaaccaagcctaatggcgatggtgtggtggagtacggagtggtgctagctagcaagcttagcttgagaagatgttgagccaggaggctgcagtgaggtggagaagggattggtgctgggatgctggtgagcttgagaggaagcggggcctggtagaggtagataggctagagaggaggtcagtgccagtgtggagtagatgcaggtctcactaggctgtgccgaggctcatgcatgagtaataaagagcaaagcccaacttctgttggattttttgcatggtaggttatagagagaaggcatgctcgatacccttgctacgtatgttagtgagcttctttttaaaagattatggatatattattcatatgaacaaaattactaagctatgaaaaatgcacttctgatcccttggacaaacaataacaaaatttatttccactacaaaataatataactgcataagttcatctactataacacggcctatatacgtcggtttgcatcatattgtttgttggcgatagaagtcaatataagccactatgtaaaagatgtatcaagccattgttcatcgccgtatagtacatataccatccctcaattgcacgatccaatgtcatctatacctaattaaaaataagtaaggtttctggtttttttgtccgtcgtttagttttccgattttgtcaaaaaaaatcgcctgtctccgattgatcgtagcgcaagaaaaaaaaagaaaccccaccgtgtcgcacttcgacgatcacgacgaccacaagccatagctcgattagttcaaagatgagattaggagttgtatgcgtgtgatg

SEQ ID NO: 66060 - DNA, 9516 bp, Oryza sativa
  unsure (1)..(9516): unsure at all n locations
agcgtggcggtcgggaggatcgacgaggacgcgccgtgcgagttcggcgccgaagacgcgcgcctcggccccgtggcggcgccgccgcacgtgcggcggagccgcagcgtcgcggtcggcgccgggcgcgccggcgtcgggttcggcgccggcgccggcgccatgaggatgggaccgggcgtcggcgtcggcgtggtgcgcggctgacctgaccgacgcgagtgacggcctccggcggcgcgtgcagcaacagtagcacgcacgcgtcgcgtgtcgtcgtcgtgtagtagctttacctaagcttaggcttgctgtcttttcatggttcgtgaatcgtgaacacgaattatttacagctttttttgtgtgtaattgtgtcgctttcggtgtgatgtgtagtatatgtacatatcctttccttgtgattactagatttgtcacgatttggaactaagcagccagtttgacatctgcacgttactttccatgcatatcagcatatgcatgtgctgtattatcccagcaagtttggtgtgtatttcttgatttctagtagtagtttatacttcatcaaaagaaaaattaacctaaaaagaaatataacctcctatagtataataaatctagacaaacctctatttaaatttgttgtactatgtgaggtcaaattttcttttatattggtttttttgaacgggggagtatgtactatttgaaaattataaatcgttgcaaggcatctgtctccaaccaagtggtcgatcgatcatagaaccaacctactccaattatctatccaatgatccgtacgttaagtttgaccttctgggatgagccgatgtgtgcacctgtcgaagtttgggcgcgtccgacttttgcatggctacacgctgtggcaacatcaggaattcaggatcgtcccagtacctctcactgtcccagtgatactcagaccctgtttagatcacaccaaacttgctttaaactcccaacttttcaaatcacatcacatcacatccaaaactttcctattcacgtaaactcctaacttttttttcaaagtaccaactttttccaaacttctcctcaattttagaaactaaacacaactttatactacagaggatcttacggctttgtatagggagctaaaaatatgagaaaacaactggggaacatatgaaaaaaaatggacgtcagagctttggttattggagtagtttatttttctaaattttgtagctaaaattatttagggtgtgttcgctggagctagatcctaactagcacagtgcacacggaaaacagagcggtcagttagcacgtgattaattaagtgttagctttttttttcaaaaatggaacaatatgatttttaagcaactttcgtatagaaactttttacaaaaaaatgcatcgtttagtagtttggaaagcgtgcgcgcgaaaaacgaagtggagggagccaggaaccagccctcctgaacaaacccttagattcgtccaaaacagatattgttgatgagcttattctggtacgtgaaacatgacggatcatttggatataaataataaactattataatcttgaaaactatatttatttgattttacaaaaattctacatataaagttttttaagaaacacattgtttagtaacgaagtagcatagttgagatcaattttagaaataattctatatataaagttttttaagaaacacattgtttagtaacgaagtagccaagtcaagatcaatccgatccgaacgcagcctaagaaactagagattatagtagaaactacatgcgcacttactaaaactatcctaaacttgacctatgcgacagggatggactcccttcgacgagtttcctccgacaatatcgatccagcaaccaggtcagctcttttcttcaccactaccctcctccatgttgccgttcgccctcgtcggcgccgaaaggcataaacctgtcagcgtggcccgtctagttttgtcccagtcccagcaccagctcaccacttgctatcaaccgcgcgtctcttgcgatcacggtgtagtctcgccaaccacccctcctccgccttccagaccatttctctaagcccaattctccatgtggtgtttttttctcctgaagataaagataaagataacgatgaagattaactgttttatgtagaacgtggtggtattaacgtataattaattgagttttaattattacaaacttaaaaaataaattaatctgatattttagagcaactttcatatatagagttttcgcacgaaacgtactgtttagtattttgaaaagcgtgatacgaatatccaaaattttattcagtttttgcagtgaaaactaacgggtttgtctcctcattcacatccggaatcctaaaccttgaacctaatcccacagctggtcgcgacgtggtctgaaaacgttcacgcgcgcgatggacgcgctcacgcgcattcgttagttagttagtttggatttccggtggaatgcgatcgggagacgggcaggccaggcttccgaccgagacgccgccgaggccctagagcgcaactcccaaggctgtagaacaatccgtggaccgcagcgtctctcagccactcaccacggcgacgtgtcatcccatccagccatccgtcgtaccccacgtccaaatcccagagcaccaccacatctcccccaattttcccagccgcgaactcctccgagttggttggcctacgcgcctagccagctagcgacaatggccgcgtccgccgccgccgtggcatccaccgcgccgccgcagccgctgcggccgcgccgggggatagccgtgccgtcgtcatactcacaccgcgcggcgacgcggccgcgcctcgccgtctcggcgtcctccaccaccaccggcaccaccgagacgacgagcgaacgcggcggtgccgagcggttctacttcaacttcaccgggttccccttcccgctcgggccgttcctcaaccgccgcaccatccgcaccgaggtaattaaccccgcctgaatccttctgctctccggcggcggcggcggcgcgtgtctaatggcgtcgaacgaagcaggcggtgaaggggaggatatggctgttcgagcaggagcaggcactggggttcagcagcgtctccaccaacacccgcatgaccgtcatcaagctcaagtccggcggcctctgggtgcacgcccccatcgcgccgaccaaggagtgcatccaggcaagcaatccccgatctcccccgtctcctccgattcagcctcgtctcatgtcgccgccgtgcagcttctcaaggagctcgacgcgccggtggagcacatcgtgctgccgaccttcgcctacgagcacaaggtcttcttcgggccattcaccaggaaattccccagggcgcagatatgggtggcgcccaggcagtggagctggccgatcaacctgccgctggagttcttcgggatcttccgggccaagcccctccaagacgaggacgacgacaccccatgggcgggcgagatcgagcagaagatgctcagctcgcctgaagttggtagcgtcactgtcaccaaccaattcgagcttctatttcatcagcaaatggatgcaatttttttttatagctgtgtgcaatggtgtgaatttggtgatttcagggattggaccctatgtggaggtggcattctaccacaagccttcgcggacattgttggtgacggatgccgtcatttttgttcctcggcagccacctgagtgtatcagcaaagagtcgttgctggcatctgccaagaacggcttggcagtgaagattttgagcaaaggaaaagaggtcccagatgaaccagttgtggacaataagctgaaccgtcagaaaggtgattgtagtgagtttgatctgtactgtctaattgcggctatgagtgccatgccatatacaagaatcactttatttttaatgtaacctctgaaaagggtggggagttcctgcttttcattaagaagaagagagtagtgctcattaagaaacaaaaatgactgaaactagtgaaatatagtgctcatggtttagcagaaatagtgttgtagcacactagatcggtatgcaccagcctctgtttatcttttttgggtctggagtgcataacgatctttgttaaacaaaatcgtaatgttcactgctttgtttctgtttctttggtttgctgcatgacattctaaaaaaaatccttgcgaagctcatttggcaattccattctctgtgaagcttcagtgtaagggcttgaggtattcccatggactccatatgcctactatatcgccatatcggttatgaggtctttactctgtattatcctcaatgctgatattcagtttttttcgtcttcgctgtaatgccaaagattattgcctgtcctcagacatttaattttctgctcaaagcataagcatctgatgaaaattacagcataatgttttcttttcatagaatagggtcatatatcttccgcattgaattgataatactagaacattgcagtaaccttgttggtgtaacaacaggatgggagcgaatggtactgcaaatattgtttcttggtccctcaaatcttctggagccaaacgcaagttttgctcaaatgtctcagaagttgattgtctccccaattgtgaagacacttgttttcagcaaagttccagagaaggtatgttcatgtggtgaatggaaactataatacactagtatctgctgaacctggctgaacattaccttctgtgcttttgatctataggattcataaaacttagaattacaacttgaatgttttccacgggacgctacgaccacacattttatcctttgggtgtcaatatcttcagcttgtcattacaagctgcctctagtcagaagcatttcctttttcagttgcaaacctgcaatgtgtatgtaaatgagtcaatcatgaaaagttgcatgcccagactagaatatgaagcagctttaggcatccttcctatgtgctaccataatttatgcactgtctgactcattatctaaaaaaattgcactggctgacttgcaagttttatataccattgaagtgctgaagtggaatgacctgagatcccaccaagtagtatttctgatatttctattttgaaaaaataaaaaaaatcttaattttttgaactagcattttggtatttcacacttcccatacatttctcccaatgtcaagccattgaaaatttgaaatcgtctgcctctgcaggtgagagactgggtcgacaggatcgctgcagactggccattcaggaggataatcccagctcacttcgcagctccgattaacgcgaaccggtccgacttcttggctgcctttgctttcctagatgagttcctccccgagcgatctccagcatcgcccggcctctcactcctctttgcctcgctcatgggcaaggcggcgagctacttcccccctgatgacatgaagaccctgtcatccctggacgagttcttggtttcagttggtgctgtcaagaagacagtttcaggcagaaagcgatgatacggagagatactggcagatgtgttgttcatagttttgtgttgagatgagcttgttgctgctgtacatggttaacactactaaactgtactccctccatttcacaatttaagtcattctagcatttcccacattcatattgaagttaatgaatctagacatatatatctatctagattcattaacatcaatatgaatgtggaaaatgctaaaatgacttacattgtgaaatggaggaagtatgtagttagcctttatccaggattatattgtatataccttactgcagtctatagaagaggccaaaatgtttacaactcagctgaacatctgatgattctctatgactgggtctgggtctggtctatttggcatgactccggctacaacttcagaaaagtccaactaacggtttcagttctatctaaaaaagagtgaagttgctgaagtgattaaaaaattaactagtgatgtggagcaggtttaaatcgctcactatgtagcatctatgtcgataattcaagcattgtatacgtcattagttcaattcttcgtaggaactacccgtgagcttgcaaaatatatctgtttattataaagagatttgttgttcctgaccctgcttcacctccacaattttattacagactacgctcttttgtagttagattgagaaggccctatgagaatttctcttgcccgggctagcagagaggcattcatgtttgtcattttaatgggggtggtggggttcagtttagcatttagagagcacaagattagaatgctgtgcacggtgtctgtggagtaataattccttgttcagatcgagccaagttcagttaatgcagaaggtctgcatccatgagccgtcacaagccaaagtacatcatcttctgtatcctcacgcgtcagacattaaccccattataaccactaaccaacgcgttatacaacttctgatctaagtgcccactccatcactttcctcagatagtacacgcttttgcactactaacagcgacttgtacatgattttttcttaaagacacatagttagatccacatcaactctgaaaatgtgaagaaatagtagttcaaagctgcacacaatcacttatcactgtattttacatgcctttgcactactaattgtgacttatacatgttcttttccctaaacaaacatgattagctccacatcaattctgaacttgtgaagaaatagtagtacaaagctgcacacgatcactactactacaactgtattttttcagactgagaatgtgtaaacctcgattcctactccactttcctagtgagcaaaaccatcaaaacgtccccaaaattagcacagctcattgcacacgctcgctggacttgtctgaactctgaactcagaagtcagaactgacatccttgtcaggcaaaggtagttaagtcagttaccatcaaaagatctgaagaacggtaacataacgaccaacagtgacaaattttactggagtacgttaactccctgtaactgaagaagggttcagattgcaggctgtaaaataaaaactggagcagtaaatacgaaggcaggtcaaaaccgtgagagttaatgcgaaggggtgaaactgacgacgagccgccattaatttctccaaccttttctccgtcacaggatgaggcagagcaccatttactcctcggcgccgcgacgccaacggcgacgccgaccacagggtgatcatcatcagatcagaagcaaaagagcaggatatatacacacgcatgacctcatgaactactctcatgtacagggtaaagagatgaaaaaaagaagatgatatgcctttggcttctcattgatgatgtccagcccatcagccacagggagaaagagatggattatggaaatgacaaattgtatacagacgtcactgctgccagaaaagaacttccaattttttttctttttttctgcattgagaaatgcaggccaagaaagctacaagaaacatggtactagatgttgccaagaattgggaggaggaagaagaagaactagcctatacatgcaattctatctatgttattgttgccatgctgatgtagtaagcatcgatcctccattgtaagtcctttccgagctccaagaaagtgcacccggaaagcaagaacaagagaggacgacgtcgacggatgatgagcccggctgcatgccgatgtgtccaagaaagcaagaactgaccaacgcctcgccgtcgccggcgtcctcagttgtgcagcgggttcggccccgtcgggacgagccgcttggcgacgccgtagcgcaggtcgacctcctcgtcgcgtcccggcggcggcgccggcctgcggtggtggcgcctgaccccgccgcggtggcgcatgagctcgtggcacaggggcagcggcggcacgggcgccgcctgcctggacgagccgccgccgcacaccctggcgaggatcgcgtcgacgtcgacggcggacatctccggggcccgcggcgggcgcggctgctgctgcgcggaggcgaggacgagcagcgacgccaagaagacggcgcgggcgacgctccagctccaccgccacggcgcggacggcgccaatccccccatggccacggcgccccttcttggtcaggggagagagagagaggaagaaagaagccaagctcaagaagacgacggcgcgcggcgatggcttggctggtggccgcgggcgatgatgatgatgagatgagacggggacgcgcggcgcgggggaggtgggctttaaaggcagcggtgtgaggtgcatgaggaagctggaaaaacaagcaacggctgctagctgctgtgctgaggtgatgggcgggctgatggggtgatggctcggtcgctcgcggagtcgcgggatccccgatttcccaactaaatttcgggtggaaaaaacgaagcgagacgggcagttttccccgtgcgcgcgcgtgtacgggggttagtacgtacgcggagaggaggaacccaacacccgtgacgccgtgaggacgcggaactcgaccggggccgggatgacacacacagccgggtccgggccagttcaccgcgaaagcggaaacgcaatgccgacagaatatttcgctacagtcggttacgtgaaggctgcagggagaaaactaaacggagggccagttttcaccgcacggatgctgctcgccaaaggtccatcagaatggcagtgttcatcaccgcactgatgctgctagctgaaggtccatttagaatgctcattcgcttggcagatttggtttgttcttttaaactttttttaaaaaaataccgaatagcacgagatagtatgtttcatatcgatatgccgggaaaaaatttcaaagactacaactcgaaaagggttattgttagaaaaagggaaaccaaaacacnccnccacttgctttaaactttgagataatccaaaaaatgtcactgacaggcgtccaaatccaagaaataatatcgacaagtttgagttccaaaaaataccattgtacaagcgattttatccaaaaataccattgttgttaggattccatccataccgcaccattaagtgctacaggatgaacaatgtatttatcgacgtggaatggatagaaccctaacgacgatgacatttttagacaaagtcgtttgtacggtaacatttcttagaactcacgcttgttgatggcatttcttatatttggacgcttgtcaataacatttctttaattatctcttaaactctaacttttggtgagctgaaactgaggactgaaatacattgcaaataattcagtttaagaccggggaatttgatttttggttagctcggtttagtcttcagtcatgactgaaacatctggtagttttatgagaaaaaaaaacagat

SEQ ID NO: 66061 - DNA, 15056 bp, Oryza sativa
ttctaccagagagttcagagcggcgccgacttggatggagtggacaatggacttcggccttcttcttgggctgttttcatcaaaagcgaagaatgcttatgctttggattttggatttttcttttcgagcaagagaattctcctacgaaactgattttagggtaaaatctgtttgagtttatggtttcggtgataccaacattgtgacgtcattactgcgttgctgttgcatactccctccgtctaaaaaaatctaatcatggggtttgaaccgggacaccatccaaaaaaaaatccaatcctagatttgaacctgaacatgtgtgtgtctaagttcaaactcaggattggttttgtttttttgggacggagcgagtatgatcataagtttaaattttgtttccatatttactagtaccgctttagacgtaatcttacctaccaataggttattaattactctctccgtcccatattgattttttatagaatggaggatatatgtgtctatttttctattatatctatgttaaataaattgatgtgttacattgacatagtactatattccgttggcttggagtgttgcttttggaccggaagacttaagtttaattcctattatcatttgtgggtggtcaatttttatattgcacggtgtctataaagacaatctcaccttagtccacaaataataagaagttggaggaagtactaaccttatttagccatatagagtattgtgaagcaaacatctaataatgaatagttatacgtattacacatgatcttgcttcgaacatgatgatatacccgcaagtatcatatctaacaccacacagatattagaaaagcttgcctctaaccctgttgtcgtcaagcccctccaccttgccttgtgtctcgtgcttgccggcgagaactcaaagatgatactatccttcctactatggtcgctagattaggaggtggggtgtgcttttctcatttatttaggacgtgtctgctccatggacaactaactagttcacgcttctcgcgtgggaaagtggtcttccgcagatgagcatagacgacgccaccaagcgaggcggctttgtcattggctagattcatgacaagcgatccgaaacccttcttcatgttcctgttctaaatccaccgctttcctcacccccctcgatgctgggggacggtgttgtggagcaggtgcatccgatcgctgccatcattgatcgtattagcggatacgctgatgaaaacgtcaacgttagctggtgcaacctgatggaaggctgccttgagaacattgtcgctctcgccgaggacacaaccaaacacaaacatgcggaagctatgcagacccacattgtcgacggagggagtaccatgcagggacgagggacatgtcgcgtagcattcccgctaataatatatcatatttattacacttttttacgtatcttgcttgtttgctagaagaaaactttcacacttaacaaaacacaaaactgtttagcattaaatggaaaaaacaagtaagcttaaaaaaaactttcatttcgataacttcaattggaaacttgtattttttattaagtacgcgcttgattgaactacaaatgatgcaatagtagtagccaatcggagtctagatcctactagccgtagcaactctgtcccatatatacaaccgtgacgataataacttatttaaattttatatataggattgaaacacaaatgtaacttatttaatcctctcggccaactaaactttatctgtaaaatctatactacttatctaaatctgatgatggatttgacactgttcttttcagtttattcaccaaattattgaaacgattagttgcttcacactttgaaaaatatgtttttcagataatttttttcacgacattgtttagatcacttttttttaagctacttgtaaaatttataccttagaatgtttggtttatttatataattaagtagataatcgtaacaacattccgattccgtttgataatatataaaccaaacaggtaaaacaggagatgtcataacgcttgagtcgcagataggtaacgcttgtgttcggtatcttgtccaaataggatccgaccgattacactctctttgggaaaacacttgaccaaatcttacccactaccgaacacaaccctagtgcactagctatccgcctggttttcgagtttccaacgagccagaaggaagcccaatttttcccaaaagaaatccacccccgatatcaaaatcccttctccctcccctctcgccgccctcctcctcctcctcgtcgccgtcctcctcctcctcctcgattcgaggggtgccgccgccgccgcagctccagcatccgcgagaggctcgcgttggggatcgccaatttccacgccacggtggccaatcccccgcggcgcgcgctggtgggcgatgcgatcggatgaggtgttggcgacggcggcggcgctgcgtggtggtggagaggaggaggaggaggagggcgtcgagcttccccgcggcggggtttcggccaccgcgcctaggaggaggaggaggagccggtgatggcgcccgccgttcagccgccgccgtccccgcccccgccgcggcggccccgctcgggccctccaccggggctgaagaatctcggcaacacctgctacctcaacagcgtgctacagtgcctcgcgtcgacccctcccctcgctaccttctgcctctccttccggcactccaatctgtgtacgaaaccctagctcatactttcttcctgttctaattgattgtatgtatttgggcgattcgccaggaagctgatatgttcgcctgttggcatgcaggcaagaaggtgttgccgaacaaggacaaggagtgtgtgttctgtgtggtggaacggcagatctcgcggctgcttcggaccgaagcaggggcgctagactcgccagcgaagatcatacgctgcctgccgctctttgccgagcatttccggtggggccgccaagaggatgcgcacgagttcctgcgctatattatagacgcttgtcacaccgctggtctgcgcatacgcaagcggctacctgcgtcaaacgccaatggggacgctggcgaggaggaggtccgggtgcaagggccatatatggtgatgaaggagacatttggcggtgcgctgctcagccaagtgaagtgcctcacctgcaagggagagtcaaacaagaccgacgagataatggatatcagcctcgacctgcctggaagcaattctgttgctgatgcgcttgcccgtttttttcagcctgagatattggagggttcaaacaagtacagctgcgaaaggtacattttatccgctagttagttgctgataaattgtcaagtggttctaagtcgcctaggcagtacggacgtgggcatggcagcatggtgtctagctccttgtcacactacgcagcatgctggaggcaggatggcacctagctcctaatcggactatgcaaccgctttcttgttattaccacgttagactggatagtgacacgtagcgtgagggcaaactaactacttttttaactgtattttggtatagcttaattagggcttgtttttgatgagggatctagatggaaatataattattctaagtccaatagtaatttttttatttagtttcttgaaaaaaaaacacactaatgttttgttaaaaaatctcaaggtattttgttaagaaaaacaagtgtattctggatattttgtaaaaaaagttgtagtgttgaatgcctaggttttcgaatgaaatgtccaagtttcaaaatctgctaggaatgtttttgctttccgcttgattggactgcttaacccctgtggaaaaggtaagccagttacgttttccttatatttcactggaatcaagttttctgttcaaatttcctggaagatttcttatcagggaatgattgatctagtggtcgtgtgcttgcttaatcttgctgacaacggctttaacatttggtacatttacaaaaaagaacctgtgttccaaaggaaattggaaaaccttgcccaatttggaggtccaattgcctttcctatattggcagtggtccatccaataatttataagaaaaatcaatatattatataaaaagcaatcattatacattttacaaagtgcgcactcacttttcacaaagggaaaagtaggtaatagatagctagcctctttaaccttgctcgttgaggtatttcccggacggggcagtttatgcttataaaggaatgcaaccctgccaaccacacctttagggtcttaggggattaaagtgagctcaatacgagaacctgttaatattaactgtgctatcagtttccatttatattcttttcatgaagccactataatgcttgcccattcatagttttgaacttgggtttccgaaattcttcttatgtgttccggacatgccctaacttgcgaaaggcaatttttttttgtatcgcagatgcaagaagctcacctcagcacggaagcaattgtttgtccttagggcacctaaggtgctcgtcatacaactcaaggttatcaatcttcattcctgatatttttattctatagaacttgttattgattaagatatgttgctgatgacctctgtttacttccattctggtttgttgccactagagatttgagggaataaatggtgggaagatcaacaggaacatagaattcaaagagactctctttctttctgacttcatgtataataaaaaccaggttcagaatatcctcttgattgttacattagtatttgttgcttgttctacatgtagttaataatgtcaaactagtcgtggaaacaagttatgtcaatcgtagcaatccatcaagcagtgaccacatgctggctgtttatgtaattttattgtgctacttttttgcatttatgctacagcatgaagtcataaatctttaaggatcattttttttctgcaattattgttaggtgaactctccaagaatgttgtttaggatcaagaaattctggattatatatgtcttatagttatattttgtggcgtttatgtggtatgaccctacaagagcttcataaagttgcaaagaaaagttccatagggtcaaactacatctggactatgacacagcattttaggattattcttcacttgaaatcactttcatccgcatttttcattgtttgtttttaacatttctgctaatatttcataccaagaatcagatcagtttgttttaattatattgctttgcatggatctgcaggattcactgccagtatataatctttttggcagtattgttcactcagggttctctccagattctggtcactactatgcgtatgttaaggtaataataggcttttccccagtacttaaagtcttcaattattttgccctgacatctaactaaatgattgttgactatgctcaggatgctattggtcgctggtattgttgtaatgattcccatatctccccctcaagctctcaggatgttctatctgagaaggtctacatcctattctatattctgagtaccaaaactcaaaagcctagtacaaatggttactcttctagtgcagctaaatcttccaacagcaatggaaatggcatatcaaatgccacatctaatgagcccctgaagataccactagtaaaacagaatggactatgttctagtaaaggtattgcaccgccacccctgaagaatggcaagattgcaccaggtatgcacctcaagccaatccacttgaagaataatggaacggggaaagtttcttcaaatggcaaggcaagcatcattccgggcaataagctagaagttagtgagggtttaacactgccagcagtgaatggccgtgactctggaaaatatgcagaacccggtaaaatgaatgctaatggtagtgtttcttgcaataagacggatgttaattcacagagagtgttgcccaatacgaatggaaatggaaatccaattcacttttctgatcttcaagagaccattgatgctaaggctacatgtgctgagcaatattctgaaaagtcatctattgccagtttggaggattctaaaaatcctgtttcatgccatgaaatgtctgcagtcatagtaaaggatgtggtatcttcgggtaaggacagttcttccttgaagcaccatcttgaagaagggaagtttaaggaaatgtaagtctctaatgggcaggaactattttgcttttgttatttgtagctatttccatgaagcactgattgtccattctgctttatcttttctctagcagtttcagatgttatacaacttgctgattgtatgtctgaaattttatgaagttatactaacaattttcatgctacaactacaattattcacacatatttaaaaaatgtttactgcagtttgtagtgtatgttgtagaatcttcacacatattgttcattggaggaatatgtaatggttgcctttttttttgtttttgaatttggaacatctttttgttgaacttactgtgcgttttattatttaattaaaaacaggcttgctgaatcggcatcttctgagcttcacttgtctggttgggtggatgatgtccgtaatttcatgcacactataaagagacgccgtctacaaaatacaggcacgcctcaagatagtgacacaatgaggtactttgatgtgacatttttgtgcaactttatttttttttcttacaagattctataggtggataagctcgtatgcctttattctttggttgttttgctagttatatctttttgtctggaaatgtttccttcatgttctgcattattgccccaattcaaccttgatccataactatgcgttgctagaattttggtatttcgtggctgcagcatcagtattatagttttagttactgacaaaatacccatgctttgctatgggtaaaagaaaatatatattatgtcaaagacatgtttgcttatttgaatacatgatattcatttgattcaaataaacattagactattgtataatatcagaaaatataagggactaatttgaaaaaagtacaaaagtagtggtgcactagtgtcttttatagtactctctccgtttcggaagccccacactgccacacaagtcatacgtcaaacatgattcaatggcttccatttctcttctgtgctattgcttacatcattcaatggctctaatatttgtatatttctctctttttttggcaatgcagaaaggagctgataagcgaatctggaagaatatttaggtcaaaaattccagaatcgctgagggagcatctcattcaagccctgcggtcatattaccaggacaaattttcactgggaggataaattttgtgcggcggttcattagaaacttaagaaaatgtatctgtatttaccattttgtagaatggcaaattgatggtggatgtatgttccatgtggtatatgtttgctctggtaattacctgtttgccttctttatttatttattactatatattgctctgcattgctaacttatcttatgcttggcggttcaggttcaacggaatcctgttggtcaactaccagctccttgtgcggcttatttttgaggcatttttgttatccaaatgaggttgagacgtagagtggccaaattacatgtaaaatattgtcttctttttgctgttgctcctgattctataggcttaaacaacaccaacaacccccattccttcccttctgtctagaatgtagaaattgttttttcccttctgtacaataatagttcgcagattagcagtgtatggggtttttgacctttactgaaggaaaagcccgtttgtggcttcagtactgggtttgttctgaattagtgtccattgcatagaattgctggtaaaatcatcagaatataaattatccaaaagcaacatgtcgtttggacaattagacttaggacttgttaggtatcgcgccaggacaagcatgaatgtttggttagctaggggaaaaaatagcttagcatagcatccaaacaggcctacatctattagttaccatgttcactgtgctgatcatccaattgccattgctttgactttgcgtacagcagcacggacatttgaacatattgctggttggtgcgtaatgggataagagagcatcgaaaatgaaaaaaaaaagaaaagaaaagggaagtagaacaataaaaaggggtggttcatgtttgcttgtcgctggcgtctgaattgttcttcgtgtctgcatcattttcgaatcggcgcgtgtaagctaagaaagcggactgaaaacctttaaaatcggatatccatccccgttaatcattgaatcctgaaaacaaatgttttgcatgcattgtacatcgaactatcaatcgacaatcgttcgccatcccacataaattgcatcttgcctgtttcaaaggtacaaaaagacaaacgatcatcttcaagtcctcgaaaacctgatgctaacatttccaagatcaaaacggtgtcacgagctcgaattatttcggcaacttgcttttgtattgttggaagttggctggccagcgtctcctaccggagcaaacgagccaaggagcgcgagcgcgacggcgagccgctcgatcccgcgcaccgacggctcggatccaccctgccgtcgccgccgccgccggccaaccaccgcgggcattatccggtattccggtgcagcgcgcacgtagtacgctacgtagacgtgagctggtttgtcacctgtcaacctcgcgctgagacgagcggcagcatcgccagcgagcagcatcatatcctaccgaacgaacgcccatccaccaccaccgcgtttcacctttcacgccaccaccgccggtgagctgtgtgatgggccgtactactgctggtgtgtgttgatttgatgctctcacgagctcgtggtggactggtggtggtgtttgtttacacgctcaaagattaaacaaatatttgccgatgggtttgttggtcagtagtgtgtagacaaacaacgcaattatctatttcgtccgttttaaaatatttatatctaatatacgacgggatactattttagtataataaatttgaataaagaatattctagcattactatgtggtaatattttagaacggaggttgtactcctactgcaataaaaaaataacataactcgaacacgaagtcgtcacaaaggacctgcctgcttcccgtcggcacatccctgttcctgcttccggcgtgaatctgaacttgtttttgtaagaagctgttgtgcttaaatgggggtacatagtctaagggttcctttaatctgacaggatgaacaagatcatttcaagaagagcatgcaaaagtttttattcacttaacaaaggaggatttacaaatgcgaattacagttcggttatcacgatgatcggccgtatcgattgagttggtccagatttataaaccgccaggttcaaaacaaattcaaaccaaaattttaacttttggtaaaatttatttgagttctacccaatttcgtcgataaccctagctttaactgcagtagtaaagaagtacttactgcacttaggctgagttcggcacttcatttccctaactcacttctttcgttttacttatacaaaagttgctttaaaaatcatattgatcttttttttaaaaaaatagctatacttaattaatcatgtgttaaaagaccgctctgtttttgcgtgcaggggatgggttctcatcttgcactgctgaacacagccttactttgtctactagagtattacttctatttcaaaatataaaaacttagaatcggattaaacacatattatctaaatttgttgttttagaaacactaaaatgtgtattttagagtgaagtcggtactagcctctgccttgcctagagattcctggcggtcctggagtaggtacggcgccgttaacatcccatcagccatcaccaggagtccaggaaaaggaggcaatcagccgtctcctgtctcccccgtctccgtgcgggcaccgcacggcatctgcggcatctgcaggcgctgcactgcagcagcagccacccccaccacatccaccaccatttcccaagggaatccccacccgaaaaggccgtgaaaccggtcgttttccccgcaccccccacctgcgccttcacctgcgatgccaagccggcaggcagcggcgccccctccctcctcgagatgccaaagcacgcacgcacctgcgcgcgcacacgaaagcccgcggcctcgcacggctcggctcggctcggctctcccgaaggaaaggagaaaagaaagacggggagagaaaaaaaccgtgcgctgcactgcaggcagcatcagtgcatcaccaccaactggcgttcgcgtcccctcgctttatccaatttacaaatggtctttattaaacaaaaccgatggttttcttttgaccctttttgtcttcattaacacaggaatctcgcgtgtattgtgacagatatttgtgtcattatgtgcatttcttgaaatgtttttttggggtataatttcactagtagtattttaaattggtttttaggctaaaaagtgagtagcatcttttgtccctggataatttactagaccttaataggagtattcagtacgattggcattagtgaggatttcacagtttttaaataaaaaaggagagaggactgacaatttgcagctcgcaccgacactgcatagataattggcgtcttcagaactgacaaaactgacttttgtttttaaaattctctcttcaaatttgtttgtaatttgagaaaatttgagggatcattctgcattttgccgaataaaagcgagtctgcaagagattgccaaccgtccacctctctctctctctctcccacgccacgccacgccacgcttctcctcctccagatccggttcgcctcgccggcgatggccgaagatccggcggggtcccgccgctggcggtgcgacgccggcgacgagcacggctgttggctctcctcctccgccggcggcggcggcgacgaccacttcgaccgcctccccgacccgctcctgctcgtcatcttcaaccgcatcggcgacgtcaaggcgctcggccgctgctccctcgtctcccgccgcttccacgacctcgtccccctcgtcgactccgtgctcgtccgcgtcgactgcgtcatccccgacgaccccgcgtcctcgtcgtcgtcgtcgtcctcgccgtccgccgcgccatcctcccctacggcgtccgcgcgcgcgcgcaccgtcttctcccagatcgcgcgcatcgtgctcggcggcatcgtcaagcccatccaggcgctcggccagatactttcccccgccaactccgcctccgtcctcgcagcatccgtcacctcctccccctcctcctcctcctcctagtcctccttttagccgccgcttcccggtgacgtgtcgcaccactcgccatcgaaggtgctccgctccttcaagaagttacgccgcctgcggatcgagctccccgccggcgagctcagcatggaagaaggcgtgctgctcaagtggaaggcggacttcgggtccacgctcggcagctgcgtcatcctcggcgcctcctccgccggcaaggacggcggcgcgggagcagctcccgctgttgactgtggcgagtccgacgagacagggagtattccggagtcgttctacacgaatggggggctgaagctgcgggtggtgtggacaatcagctcgctgattgctgcgtctgcgcggcattacttgctgcagccgatcattgccgaccacacgacgctggagagcctggacctgacagacgccgatgggcagggagtgctcaccatggacaagtggcagctgcaagaactgcgggtgaagccggtatcggcatctgggggctcacacaggacgctgatgccagcgcttagcatgcggctgtggtacgcgcctcacattgagctgcccgggggtttggtgctgaatggagcaacattggtagccattaaaccaaccgaggaggcaacaagggacacggttgggagtgggattgctgggtctgcaggtggatgctgggtttcagatgcctttgaggagccgtatcggacagccgtggggatgctcctgaagcggaggacatatagccttgagatgaactcgttctaagctgatggcaatttggaagttctatccgtgaggtaaattctgcactgcattcaatactatgtttgtctaattatcttcagcaattgctgtttgcgatgccatgctttggcttctcacattgtagcatttgcttcaacaacattgttgcttattcgtggaaaaattaacacgcgctcaccagtataaacttgcatagtagtaaacagcacgagtcttcgaatttctgaaatttggtttatgaggcttgccatgacttcagttaggttgtcataatcaaacaaaatagcacaacctttcgctaatttgaatgcgaggttgtaaggagttggaggagatctgttgttttagctgactcgttatatccttgagtcttgtggttattcctactagtatatagcaagcttcccgtatcagtttacatgatctggatatgcatttcttggctgccaaattaatggaacttgattcacatcatatcttccactaacatcatgtgctttgaaaatacatcgttttccacttgacatctaatcacgattttctgtatccagcagtaacaaatgaacaaagcatcattcatttttcttgaagaatactctgtagctgaaagtattcttttttgcggtaggcacaataaccttcactgaactgcactgaaataaataaaatcactcatcagtggtgatgtacaaaacatatatcgagttttattttattttttgtccatgttgcttatgagaattgttcctgtaaattctgagagtctggcaatccaccaagtttacatccagaaacaaaggggcgttgcatgagctactgtctttctttgcaactagtagaagcaaaacaacctagatgaccaaccctctttacttaccttaatgtattgttacagggtatgaatcacgcataccaatatgtgccacggtctgtaatcttttgttgttttttcttaccattcttgtataagaactgtagtcatcaaggaccatccattccattgctagtttgaaattatgcaattagggaatagaaaagtaccaaaaagggttaggctattaaaaggtgtgtatggtttttatggtgagaatggtgttccaacatttatgatctatgtactgatcatttgattgtacatcaccaccacggaatcgtggatcacccagtatggccccacatgatacatactttacttctaaataactaattacttaaccagttctcatggtggaatcttctgcacctccttgtattgttggagggcgtgtcacatgccacttccttaactcttgagattcgttttagccgtagatctgctgcacgagagaatagaaagaggaaggaagatcccacctggatgcaggatccacttgttttttttaaaaaaaactttatagatcattttgaaaccctctgaaatagtcccctttcatttcgcaaattgcaaaaaggaaacaaaatcagcaattttacttaagaaaatgtccaatgccttgttaactcatgcatgtgcacttggatacttgatgcaataacaaagatatttgaaaagcagagaacatatattatgtttgcattatgcttgttgtgttttgcaagatcaacagttccaccattccactgtatgtttccatggtgtagtagtaagctttaagcaaccaatggatttgtttttggcgtgttgctaacatcttatatttctctccttttcaggatgttaatttattgcaagttgcaactcaaagtactacgcggcataagaaatggagtagaagttcactggctgcctgttttactccggcacacgccctacccagacatgctgcaagttcttatttaacgcactacttgtcttgagcatctgtcagcaaggacctgaacggaggctatacaaccgatgatgacgagaagccgaacatgcatcctagtttgttggaattgctgggctactcaatgttgagcttgttgtttgcctctttgaggaagcccgtacctctcccagacgttggtagcacggataatttgtgccatgccaagctgttaagtgctaatcctaatttatcttccagtactcaggagtcctgtaccgtactttttgcagaaaaagtttgtagtagtacatgcgaggttactctgtttctgtacatcaatattcaagggcacaactagcagaatcttgtgtaattgagcactgacgtacgtagcattatcaattatgcagtgaatccaagtgcttacgcatgcatgtgtttttcgtcgctgcatcaatattgctctgcgttttcctcatgctgctcgatgtatgtcgtctcgcgatctgcgaacagtattttggattggatggtgttgtttgtcgcgcgtatcggtgagaaactgagtataatggaaagccagatcgagatcggtggcatcgccaagcgcaagcggttgcctcgcctggagccggacgacggtcgcctctggtcgagtgcctcccgtccgacgcacgcgggatatccgtgagctagcgccgacggaccacactgcatatgcttcgcgatcgatcacggattcgcaggcgcggagggagccacagcccacagccatgtggcacgggacagcctgagctgccgggggaaggatcatgaagaggaccttgaattcgttcgtggatgctaacaatcttgaacattgccaaaacttatctccactgcaaaatttggtaattatcttctaacataaagctcggcaaaagtaacaaacaaaatacaacttgtgcttctcgaccttatcaaatattgaga

SEQ ID NO: 66062 - DNA, 8758 bp, Oryza sativa
tcaaattgaagagaagggtgatgaagaagatgtgcatattggtggttcatttgataagctgggtaatgcaagtaatgcagctcagcttgtcaatacaaaagcaacaaagcagaagagaaagaaaacaagtcccagtacaaaaaacagtgcaaaattgtccaatcgtgctgagccctgcataaaaaagtctgatgccaatcaacaaggttcaaatagacgtaaaagtgctgccctaaaatcttgtcagaaaagcagcagtgctgtagggaggaatacttcaggtagaagaaacaaggcctctagcaacagcaagccaattcatggctctagtgataactccccagagtcatatcttcctaaggagggtttggatgttgaagcacctgacaaacccctttctgaaaggatccaaaacttggagaaaactagtcgacgaaagggaagtgcaaggaagctggaaatggcagggaaaactatttcagatactacagagaagaatagtgagccaagaagtaagagagtcagaagaatgtctgaccacgctatagctaaaccggttgaagttccttcaggatctggaaatgaaacagaaataccacagcttcacaccctcacaaaaggcagcattcaacgcaaatcctccaacgctagaagacatagcaaagtttgtggagaacaggaaggtaagaataaacttgagaacacgacaatgacacctattattttacatgggaaatgccaaaataaagaggcagtatgtacagctccttcagtaaggactgcatctgttaagtacaagcaagcaaaatttagcgaacaaccagattgttttggaacggagaactttggaaaccttcaagcatgccctgcacgtaatgttttactgaagaagtgtgaggtatctactttgaaggtttcctgtgctttctgccagaccgatgtcatcacagaggtatcttctgacttctgccgtgtttatatgcaaatgtccttttctccaaatctaacatattccctgctaatgaacatactcctagaagataaccaaatctccctccttttctcttttaggagtctggagagatggttcattatcaaaatgggaaacaagtccctgcagagttcaatggaggagccaatgtggtgcactctcacaagaactgccttgagtggtttgttatcctttctagtgcaagataatatcagaaaaaaaaaagatttcagtatgcaatattaatctgaatattttttattattttcttgaagggctcctgatgtctacttcgaagatgattctgcctttaatcttacaactgaattggcgagaagcagacggatcaaatgtgcttgctgtggaattaaaggagctgcacttggatgctttgagatgagttgtcggagaagtttccacttcacctgtgctaaactaatcccagaatgcagatgggataatgtaagtccatatggtgttctttatatatattttgaggcagtggtttcaactataccagaatcatttctgaacgtttgacagccataaatctgtaccttattgttttgtttcaattttttcattggcaggaaaattttgtgatgttatgccctctacatcggtctacaaagttacccaatgaaaattctgaacagcaaaagcaacctaaaaggaaaacaacactcaaagggtatcttttgaacctgttgtttgaaacatgtttcttaatggttgaacattgacatgtacgagcacttactgtagaataaccggcttttccaggtcatctcaaataggatccaatcaagattgtggtaataactggaaatggccatctggatcaccacagaagtgggttctctgctgctcatcactttctagttctgagaaggtgctttcgaaaattagtcttattttcctgaccctgatcgaattaatggcatttccttcatatgcattacaactgaaacaaaatgaataaattactcaggaacttgtatcagaatttgcaaagttagctggcgtgcctatttcggcaacttggagtccaaatgttacccatgttattgcatcaactgatctctctggtgcttgcaaacggacgctgaagtttctcatggcaatcttgaatggcagatggattgtctccatagattgtaaggccatgtgctactaatataactgtgctgaacagcctatattcatattgatctggtgccccttgttgctaactgacaactttgtgtcataggggttaaaacttgcatggagtgcatggaaccaattgatgagcacaaatttgaagtcgctactgatgttcatgggatcactgatggtcctaggttaggaagatgcagggttattgacagggtaaacatttcttgccattgttatgtacctcattttcttgcaaggatcactaaaaaaatcttttgatagaacaaaattggtgttaacctgaaaacagtgccaaatctacttgtccgttggaacaattttagcttgatataaaagaggacaagcagaaagtaccaccaacatgatatgttgctatgaattaaaagaaacaggccgtaatacttcatgcagccctgcacttatgcatgccatagaataaattcatagacctggtgttgacaattccacacatttggaattttggatgtgttctaacttctaagcaatctcacgtgggtattttttacgcctaacaatcacattgttttttgttcttttttacccttgcagcaacctaagctgttcgacagcatgaggttctacctccatggggactacacaaaatcctacagaggctacctgcaagatctcgtggttgcagcaggtggaatagttcttcagaggaagcccgtatcaagagaccagcaaaagcttcttgatgacagctctgacctcctcatcgtttacagcttcgagaatcaagatagggcaaaatccaaggccgaaaccaaggctgctgatcgcaggcaggctgatgctcaggctcttgcttgcgcttctggaggcagagttgtgagcagtgcatgggtgattgactcaattgcagcctgcaatctgcaacctctttgaatctagaagactgcctggtgccaaaatgcgagttcgatagagtaagaaacaagatagaaatctaagatgcacagggctttgtaatgagacttaaattatttgaaaataagtttactatgcgttgcaaaagaaactagactgcatttctatggaagttgactggatagtcatgcgccagatggttttcctggcctccttttgtaatccgttagtgcacaacacaaacatacaagaatgatggcatcaggcaccaaaaacgtttagcaacaataacaaagattaacaagataattcttagtagcttattgaaaacagaacttgagtaggcttggcgagctggatcaagtgacattggccctatttgggagagttaaagattctgagaatttgatggagaagctaggttgttcttataatataggtgacaatttgtattgtttggagagttgtagattctacaggaagttgtagttaccggaagctccccaaacagacccattatcagtctttaggctgtgttctaatgtccaagttcccaacttcagattttcaatagaaaaagttgttgtaaaaaaatcatattaatctattttaaagttttttttataatacttaattatatgttaataatcaaccccgttttccatgcacggggaaaagtcggaacatagccttataagttaaactctttagacccaaacacttggcccatccacctttacaatctttcacaactaactcggcccacttaggactcacgtgccaaaaacatggcgtcgccaaacaaaaactatgccaaagttatttgtaccaaagcgtgtaaatttcaacttgttgttctgatagtaactactctcaacttgtcaattactccctccatcctaaaatataataacttctccaccaacattctcttctcaaccaatcacagccctccaccattcaattttcccacctgcctccacttctcctccaagcacaacattcctctatttaatcctaccaactttattaataaccgtgtccaactctaaaaatacttatattttaggacggatggagtacttatactgtgactgcaatttactctttattttactattagttgccacactattcacattacacagttagttcaatggtgatctaacatacccattatcggtctttaggccatgttctaatgtccaagttccccacttcagatttttaatagaaaagtttttgtgggggctccagccccccaacatccacattgtatccgcccaatggacaaatgggatggacaaataaggagaactgctatattgcatagtccccatctttcagtagctacggagcaacatgtatctgttatcccattgttttgcatctgcatcgtaagaatttttcgctatccttgtcggccccttgttcaccataacctactacgaattagacaatggttttctccgttaagcatggattgtcgtaaatagagccaaccttgtatgatatgaacgatgtcggatccaccacgacgggccgatgtgccaccgctaccatcagcgcgagctcactgctgttgtcgctctgcttgtaacttgtgatcgatgtggtgtggtgggcgagcttggaggcatcacagttgcattccttgcctatggatagtctaactgcatggtgatcccgtcattctcggcaatccactccaatgccctcctagatgtgtggttcaaggcgatgtcggcgtagtccaccagttgctgctcagatagagggacgaggtgctctgtcttgatgtagtgggcgctctccacagttgccatggccacgaaggcccaacacgaatccatattgtccaacttatacataggcctggtttagttaccaactttttcttcaaatttctaatttttccatcacatcaaaactttcatacacacgcaaacttccaacttttccgtcaaatcattccaatttcaatcaaacttccaattttggcgtgaactaaacacacccataatccacttacataaaatttattgtttatttcataatcaccaataagactcatggtgtaagcacatgcaaggtttgccatttcgttttacatatttatattggggctaaaattttgaaatcttagaaatttcaggacacaaaatttgaaatttagatagattttgattgagtttgaataaattttgaccatattcaaatttttatagaaaatttcaagcgaaatagtttcatgccaggggtccgaaaatttggaaattttgaactaaaatttcaaacgctaactacaaaagcatatagttactagtgatatgatactccacatcacatgtcagagtaaaatattaagggtcacaagttaaacaaaagatagttcataaatgcctatggttaatggttaatagtacctcctgtcacaaaataagtaatgttttagacaactacacggtcaccaatgcacttgttttattataatattttaaaattttatttaatataaatctaaccatattatttttgaaagttggatcagaatatttaaagaaaaattgatcatcaaagttgtattccaaaaatttgtgaatgatggagtacaacattggagtagtacactccaatatggtgatcgtggcaacgtggtacctcaacttgtttcaatatggtgaccatggcagcgtaacacctcaacttgttgagttccatggtgatgctctccaattctcactcgagagaacggggagggggcatatgtcccccacgaccaaaaaagctatctcatacgacgggaaaatcaaccaagcctcatacgacggtaaaatcaacggtcttggtctctcgtactccctcctatatataatatatttgaatatattattagacaaggttttcaaagttgaactataaaagttaaatatagtatatttttactagggaaagtgaaacaacaatccaggccatgcttcaaaattttccattccaaaacatcctggttgttcaatatattttatgtgattgttcttaacatcccgccatacgacactataagcatgcaagtgaccagcagcggagccaaggcccggccaggctccgcctaagatgctgtagtagattagcacttcattaatcatgcaacaatagaatattttttaactaattaccctaatgaatgtttgattagttgagaaaattagcaaagcatataattaaggctcatgccatcacatgtttgcattctatatatgccatcacagctcatatacaagcgtacagctttgataatacacaataatcgtcatatcgattttaactcttacaccaattagctcgtactgttaattttacttgtgtcaatggtaaaatggtccgtagagttgtacaagttcattttcatttgtagtactagtcatctgtcagtggcttgcccggggtcaataaaattttttagatccgctactgcaagtgagcatgtggtcgctcagtcactcaaaacaatgtgtagattcatagaagctatgattatttcttatgcaggataatgagtaccggaaccattggtctattcatcatttcaaacggtctattcatcatttcaaacttgcagctcatccaagtcttcattggcaagcttgatgcaaatgattcaacaacatcaagttcatccctaaggatcataaacaaaagataaatacatctagccttagaattatttgaatagaatgctgtcaaaaaacaagaatttgctgacgtgtttaaaacatgcgaaaatcatcatcaaagacattctttttgataattcatcatataccacagttcaatctagcatgtatatctataaacctagaataacataaaaaattacaacgagcaatcagcgtagccttacagtacatgggcacattattagcattcgcatttacctctcacccagatgtccaatgtagacaaggacacttatgagaccccccgaactgacaattctgctggcagcttgcaaagccagctcagttgtcttagctacagtgatcattgatttatctcatcctagaagatagcccaagttgaatgctacaagcctagaaaataaagagtccttaataattcaatcaaaacataaaagatcttaattacttgatccaataatttcaacaataatctgttatgaaccctgttaacaaatgagtaggtagcttctaataccaatgaatcagaatggctagctcacctgacagggaaatctttagggacaacctcctccattctactttgacagattgtaaacaacttgacaagttctagctgcaaccaagaaaagttattgcaacgaccacaaaactgcagacatttcatgaggcaatgatgctttgtttctatatactaaggtctgagcataacaccacaaaaagcatatagagtacccaaaaaaactcaacacatatgagtatagttagacctttctttactgtatatcaacaacattatctgttcattttcattttcatttctcatttctaaagaacaataaaaatatttgaaaatgagagagaaaaataaatgtatcccgtatctaggatagttaatttctaacacaatgtagcagcaaaatcattgttcccacttcccctgaagttgctgcaaatgcatacctcatggctattgacggccattttcagaaaagaggaagtgctggctatcgcggactcctgaatgtccaacccatatacacgaccttgtactctttgtctctttcatcagctaccattttaagcatagcgaatgtatcattgctgttcctgcatgtggcatcaaccacagtatcccctttccgaacaatacttctccacaccctaatcatacaaccaaaagacaaagatatgaatagctaaagcgtacatgtattcttttacacatctccggttaaatcctagagagcatttcccattaatggaatttccatcccatactctgtcaaaaaagaatcccatttcatagttgcccagtacactgtaaattgcactaatgtagtagtagtgcttacttttaggctgaaaggtaaatatctcacgcataacagaaacgaaattgctgtacatttgtcgaatgattttcggtggctggattcgtcgttttttcggccgtcccattacaaactgtccgtccgtccatcgtgcaagccagccagttgctactccctccgtttcaaaatatttaacactattgtctttttaagtacgtgtttgaccattcgtcttatttaaaaaatttaagtaattatttattattttcatatcatttgattcattgttaaatatactttcatgtacatatttagttttacatatttcataatttttttaataagacaaacggttaaacatatgctaaaaagtcaacggtgtcaaatattttgaaacgaagggagtatcatacttaagctgacacttttttaacctaggaaaaggatagctatccctcgcccccgccgccgcagctcaaccagcttccgatcaagacacaggccaaatttctcggtctcggagaatgtccagctcgtttggctcgcgagcttgcagtcgaggaggcatcgaaggctcgcgagattagatgatttttgctaattgagtgctcatgggaagaaacaaatcttgggaagaccccggggatcctctagagtcgacctgc

SEQ ID NO: 66063 - DNA, 6054 bp, Oryza sativa
taatttgctatatagacaaggtggtagtgttacaatgaagtttgaccaccaactgtcattgagtaaacactattctttaaaaaaggtgaaagttatctaggagagggatattgtcctttttatatcattctaacttcttccaggaaagttaccagtttgatgtgaactcgttatcaacgaatgtcaaaattaaagctaacactatcccagaatagttattctagtgctaaaaaggaaaaaatatattagacaactatgtgatcttctaggaaaacaaggaacaataaataactcattaaattgcataaccatatcacatatagtttattaatatctaaattggacttttcgattttataaaataacagttaagcataatctatgaactcgcttggttgtgctagctatgggcaataccaatagctaagccaagccaaatttcttctagcaataatagggcggctgcactagccggctagccctatatttttgctaatttttccttatgtctttttttttgcaaataaattacttaaattaaaggggtgttcgataatgttagatgtgattaatttacaacctacagctacagtaaaaacaagaggatctatggtggcagctgcagctacggctgtacaattgcaatgtagcatagccgaacatcctctttgtaattttattggcatccattcagttgataaagaccacagagtcatagtaacacagaggatcctagcaaaaatactcttcctctttctctcccctccagcgcagcttgcaagcctccacgacccaccatcatgtcatccgtggcttaatgacaccccttccataatcttctccattttgacacttatgcccctgccacctcactgcaaccatggtgtcatctgcaggggtagacatgtaaatctctcccaagttcagggtggctttctggccagcccattatatatcactctcatggcaaggtggctcctgtactactctgcccattgataggctgctggtgatcacaagctacacaacacatcacacaagcaataggcatctctctcttctttctctttctcctccttgcttcatgtaagcttcttcttctctagcttactttgatcatttccatggtttcatgcatgcatgtttagtttcatgatatatatgaaatatcctatggatttttgttctgtactttttttaagaaggggtttttgttatggattttttattgctgttggacagttggagtactagagattaatttcttgaaggagagaaatgacaagtgtctggaagaccaaggttctcactggactcaacaagctctttgacaaggatggaaagaaggctgctgctgctgagttcttgaaatcattcaacaaggtagctacgaattcatacacagagacacttgaaagttgtaagtatagtttgtgtttattttcacaattttttttattgattgggtgtcatatgtatttgtgtaggaggagattggcaaggagattgatgacaagaagacagagctagagcccaaggttgtggaggttgttgagtcatctcctcctgagattaaggtaataatttttcaggtgtttcataggttgcttgaggacatccttgctcaagaaataataatttgcatgcttatctgtaaaaatattgcaggctttgttgaaggacaaaaaaacagccagcaaaatcaagaagaacggtcctgcagtcactaagttccttgaggaattggctaagattggtaagaattggctaagttctaattggcttgtatttgattgcatggggtattgactagaataatcacaatatgtaacttgtcccctttttttatattttcgttcaaaaatgcatttttaatgaaaataaagaacctttatcacttatttccaaaatgaatcgtaacataaaaaatgagttatttttttaaaaaataatttaggtgtcatttatgaatcacctttttttcccttaaaaaatagtagaatccgtagtttcttttagcaatcatgtttattcattttcttatgtttttattcgatagagacctatactatttgccctctgagcaacaatctagactttattccctcttgctagaaaattgaacttcagaggaatcttctcgtctaccatgtttccttgaacagaatctcacatgcaaactccgtttctttagctgacgcagacaagaggccaaaccagtcgaacaaaaaacaaacgaaactaacacagtttttttttattaaacttcagccacttatttttccaatcatatataaaaaccaatccttttatagtggattaattttatagtcttaagaggtattgggaggcatcaatatttttaatacaagttttggtacctcctaatactggaggtatagaaaggtattaaattttacattaagaaatatcggtaaaatcaattttttatatatctgaaaatatttgaacatgtctgttcctgaatagacatatttgctcgttaggtagtcctaaaaattatataatttttatgcaaacaataaaagatattttaaatttccattaatatttttacaatgaaactaatgcaatcctctttttttttttcagatttccccggagccaagccggtgagcgacgcggtggccaagtccggcacgacgccgctctccccggcgatcgccttcatcctggagaaggtcgcgcctttcgttcccaaggaggagcccaagcccgagccggaggcggaggcggcggcggagaccacctcccgggaagtcgccgtggaggaggagaagaaggaggaggaggcggcccccgccgagcccgccgccgccgccgcggaggcggcggcgccgtcgacggaggtggtggaggagaagaaggaggaggagaagccagcggaggcggcggcgccggcggctgagccggagaagcagtagtgatcactccagaagcaagcaaagctaagctagcttagctaagcttagctgatggtaattaaaatcaagattaaggttaatgtgatcacactactctctctcagtctctgcacaaaaagtaagtaaaaatcaagatacacacacttggcatgcaagaacatttgttattgaattctttcaccctttgatcctttcatctctctcctatatatatatatggtcgcctcatcggttgtaaattaatttatgtggggtttcttgttttttgggggtgattaaacatgtgtaattatattcatatgtttgttggtcatgatcataaggagcttgtgtatattatccatatctttttttttcttttgtttacaaattttcggcttgaggtgtgatgaagatagacatatatatgcaccctctccaattgtaatacaaattaatggctgtggatatatgttcatatggtacagtttgttgttgttgatccattggttaccttggggggagaaaatctttgcttacatgtcgtgatcaacttaatttgattgcgtatacatactacgtaaacaaaaatatggataggtgggaaggacatgtctggcctttgcaattaattgttccatgagtgataccatgtatgatatgcatcttctcgtacatactagtacgtacttcatctgacgtttggagcaatattcaatcaaatttgtagaattttgaccatcaaatctaatgatattatgatgccaaggcaaatctaactcaaacatttggaaaattattgatagtcaaagctttaaaagtgtaactaaatcttatcctaaatgtttaattcggatctatagaatcttatcctaaattcggggtaaaggcattatctagaaaattgccacacatatagattgttgttctgccggccaataaattaatttgaccatggtatatgtataaaatctagtaacaaaagtgtatttctcaaatatcaatattacacatatatatcccatatttatgtatcaaacgtttatacataaataaagtccaccaatattcttttaggaaaacatcaacgcgtcatatagaaaaaaaaatcaaagcttgaacattggacttcaaagctactggacctaagtaatgacatcaccttgatatatatatatatatatatatatatatatatccaaacttttcctcacaagataagcacgaggaataatataaattcagtgacaaataagctgggcactactactactgctgcatgtgtaccaaatcatggcacggaagcttaattatttagagataattacttaggaacctgaagcaagcaagcaagcaagcaaactgagccagatatcaatcagtgccacggcgaaaacgacgtgagcttgatcctaatcacgctctgcttcttcaatcgatcgtcactgcacgcatatctttaaaggggaaaaagagagagagagagagagagagagagagagagagagagagagagagagagagagagagagagagagagagagattgagaggggagttctaaaaagaaaagagttcttaaaaaaagattgaaagggagaattaattaattaattcaacaaaaagagaggacagagagtgagggctcaaaaagaaattaagaaaaggaggagtaaagatgttgattgatatttaagttttgccttgatattttcttttgttgtttaggacaggggcaaagtagtcatttcagctctttaattttttttcccttctaataccttgggcgctttgtcgctgttttagttcatcactcaagcttgcatcacaaggtccacacacatggagtacttcaatgacaatataccctgtcgccaggaatgtcaccgtgaaaaataggctcatagtatgattaaatctagctagattattcatctattggcttaattaattgggatttattcactttttacctatgaaataacttcttgttgattcgcttcgtctggttctatttactgagagttaggctgtgtttggaagtattgtttaggtgggctaattctcttttttcaccgttaacatgctttccaaactacttaaaaagtgtatttcgtaaaaagctttctatatagtttttttaatcaaataaattaatttttttcaagtctgtagtagttgataattgatcacgtgtttttcctagtagttacatataccaagttcgtttagctagaacggattagctgcaaccgagcttgaacataaacagataaatacaattgcttacagctgaatgaattgcacaagaatgatgtggctatttttaagtttatgcactcggtagaaaaaatgggaaagattcataggaatctaaaccatagggaaagctggttgtcaaaggcacaatacataataaaccatgggagctagattccttccattggtcgttttcggaaaggataggtttttgataaagacaaacaggggatggaatattctttttagtggtatttaccttttctttgactcgctttagtttgtctttatataatttgtatgatcatattatctattatctagggagtaaataccataaaaatatatttcctaaagaaagtgtattatagaaaaaaaaactaactcgacacatatactctttacaagttatagagcatgctgcttagaaaatatctaccatacaacactatcgagttagtgagaggaactatttctacatacagttggaaaaggaattgaagaagatatttccatgttttttccctaatattagctagtgcaaacaattcttttaagataaaactgatctcatgttatcatttctttttggagtttagttggacaagttacatagagttgtcttgaatgattgtgatgtgttggtggttggtctggtggtttagccaagccaggaagtccagggggggcacagggctaggagaccaggaccaccataagtatggctcaagaatagagattgatggttcccaggcctaattacctcatgatgataaattgaatatttgaatttactagttatcattacaattatgaatttcaaatctcactgattgtccatatctcctttttattaaaaaaaaacttagaaa

SEQ ID NO: 66064 - DNA, 5199 bp, Oryza sativa
ctaaaagaaatgacaaatttgttgtatgtaaattagaacaatctgaaaattactgaaggtggcatccggtattcagatcacgcctcctttaccgaccaaccaaacaggcaccaagaacagggtgcactgaatgacggagtctgaaataattaagtagtgttctgcatttcttcctcgcatttcctgcactgcttacagcgcattcgccccccaaaatttacaacttctgttatacgatttaccgtgtaaaaacagcatcctgattcctagacaggtttgctgctgaacagttctagataggcactgagctgcgtggtagtaactgaagaaatgtacacaaaaatgtggtcagtccttgagtttagcaggattcaccactcagtcactcaccacgaaggtttcccagtgcatcatcatcatcatcatcatctgaaaccctgaatgacgaacccaaaatgtttcagacaagtaccccagatgtcaagcaggatcaccatggcgcagtggcgatcttccgcagcgcaatgtcatggttcctcacgctcgactccatctcctccatctcggcatcgatcttcttcagcacatccttcactgtcaacatcatggactccagagccttcaccttctccccagcacgagaccgctcaagcttcagctcattgtacttgctacactccgatggatccctcggttgctcggggaggccgagaatatcgtcaacgcgcttgagcaagaacgcaacattcattcccagcaggtcgaatgactgcagcgtcttcttccagatcaggaagtcctcttgcgaggaggtacccgccccgcaggccctgatgccctcagcgatgttgatcgtctccatgatcacccccacgacgagcgtgaggctcagctgcctcagcagatgcctgtggaggaacgacttctgggcgcagcacagctcatagtacgtcctgcgctggtgatcggggaacttgcagtcaatgaccaagccgtccacgacgatgttgaagttactgtagctcatcacgtcgtcaaagctcatctctgagtctgaaaacctgatgccgtctattgcttcatgaactagattctgggtatcatcatgagccactttgctactgactctagtagtctctggatcctccttaggcttggtggcattatcagtagcttcttctgtcatgtagaacacagcacatgattcgggagattcaatagttagtgtatattcccatgtctaacacatttcaaggtgcaaaactaacaacataaactttgactcactagatatcttccgtttcttgcaggcgtaaaaactcttgagaccgggtgctctgtcagttgggctgatgtttttatctctaattatatgcacctgaatgtaaggcatgaagaaacaagaggtaattgtattgttggattagggaagactgaacccacaagggaactcaagaaatgggtatgaatgaagattataaaggaacaatcaagtagtagtagtagatttggaagaaagttatcaagcatttcagaaacacttgccttgaattttgttgtgctcacaagctcaaagaccacaacatcgccaaccttgatatcatggttaatcgcaaaacctctccatccagcactgagtccctgcttaccacccaggtaatttgtgttatggttgttcccattctcatcttcgagcacaatgtcagtgtcatgctttgggagatacttgttgcagaagccagctggtagaccctgcagaggagaacaataatcagatgcagagaaaaccaaaaagaagtttctaggtggcttgtgcagaactagtgtcagccattttcataaacacaataactcaagcagtaagagctaacatgcaagaaatgtacataagttggatataacttgtatgtgtgagacttctcttcctaaaacaaaatttaatgaaaaagattagaagtttagaacatgttaatagggtagtaggaagttttaaataagatccataacacgctttaaacttttactttctaattttagtgagagcatttgtttgacaaataaaatcttctaatagtaaatgcaatttgtatgtttctgcagaaggtgcttctccacagcctgttcataagaaacaattatctaaggcttcataaattgacaagcataagaaaagttagtaatctacaacccttaccagccaaaatccgctgacaacatgggaatgtaacatatgttcgacaaagctaggatgctctgctggtaacttcgtttgaatctcttgagctctcttcatagcagatccacagaacgcctgaacactagatttttttggaagataactgcgtgtgattgaacaagcttgtgagctacataagtagtttttttcataagaagaacaaggagagctggaataccttgcacatttattttggcccttaactggcacctgttaagtcacaactcattcagttatgagtaatggagctcaaaagtgcaacggtttcgtatacattatacaggaattggaaaggaaatggtaaagtccactgaataaagattggagatgtgttccaggattacattatgtgatctttttttttcgaattggaaaaccggagatttcagccagccaatcgaaatcctaaatgctatggcttatgatataaaaatctttaggggtattatgagctttatagatgaaaactgaaagtcctcttacaattacattcatactgcattcatacaatacagatagagttggtgaacatatcttacttcagtggtgttagtgcgtccattgctagtgttctgggtattgcatgtttgaggaatgccaggaaccgttctttgctcattttccacctcctttggcatcagcatcttgcacagtaagaaatccaagaaaaatcagaacacttaatcaataagttgtttttgagatgagaattaataaatgaagttatgagataacaaggaggacagatattgtgagtttgtgcaattgaaaatattgttgctacatagagtgctatcaatgatgtagcatcattgacagggatgctctaaatagagcacatgtagtttatatcatataaacttacaccattgtaaacagataatcatataaagggaaaagtctatttgtcccttgaggagacatccccttgttttgtgcatgtcgcccaaaacatcataaaaaagtttaagaagatttgacattatagatcaatatgtgacacgatagaacaaaacacactatttgtaatcaaatttattgtttttgtttttctacttgtataggtcgaatttgaacttgcatgtttgtgaagagatattttacatattgatctatcttatgttttcaattttttatgactttttgaacaacatgcacaaaacaaggggatgtcttctcgagtgacaaaattccacccgctaactaaagcagcactgcccttactttcaaaggaacaacctccatcacgtcatccgtatcatcttcatcacaatcaattattatagcctgtggagcaacaacaaaagcaagattataattctgcaagtacaaaaagaacatatattcttgatatcatggtaaatacatgattcttataatggcatagatccaattaacccttgattattataggggctaccagatgttaatgagcattaacagaaaaaagaaacataagctagaaataccccctcctttccataattcaaggtcttttagttttgtcctaagtcaaaacttctctcattcgatcaagtttatagagaaatatattaacatctatagtactttatagacctggataaaattcacagttaacacataaagtgaccatttaagcaaatacagcatctgataatttgtcatgacttacctgttcagagttacaaaatttgtgaacctacgggaaactctttttaatccctctttcttgtatgtcatccaaatagttatgaaaaaaatttgataagatactacctccgtcccaaaatgtaacagcttttggctatgaatctagacacacagttgtccatattcatagctaaaaatgcttatattttgggacaaagggagtagattaatatgtgatatgtcacttcataaacatgcaagaacgagcggatagaatccagattgtgaagtgacatatcaacatacagatgtgctgcgatacatgaattattcagggtagcatttaagtagaagtagataatattatcaaattaagaatccagattgggcatacacccaagtattgtagtatatgcctctcccattttttccagttagaacctgtcctgatttgaatgccttgcaacaacaacaatgtatgtatcgcatcaatgggaaatgataatgcaagaatctcaccctcggcccaatatcgtcatccctgtcgctgccactgctgctgtcaagtaaggcgagcctttgatggactagttccatcttctgctccatcttgttcttcgtgttcttggaacctggtggtctccctctcttctgctcaagaacaaccaaccaaaggacaagcgaattagattcagattacccatggaagtaaacaccaatatttcagtcattaaacagaaaacaaaaatcgtatccaagaacgagcagtacaaccaaattgatcaaagaggaagcaaaatctccaagaagatcacagataaccatataacatagctgaaatatcagatcactccgtcatccgaaaaaaaaagcatggggaaattttcaagaacacgtctctctctcacacacacagaacactctcttcagtctcccactcggatcgaagaatcaaaacaagaaaagcagctaagaagatgaaatctaacacaaaagacaaaaacttttagcccccaaatccgccgccattaatcgatgattcaagagagagtggaacaaatcaaagaaccctcggtctctaatcaaccggatgaacagtgaataagcgaagcaaatgacccccaaaaaaactgggtttaatcgagaaacgagagatacagatagagagggagaggaaagaacttgctttgatgggctgatctatcgccatcggccggcggccctcgggttgatctctccgaactcccgctcacctcgattccgaagtttgtgggggctttgaggttttgaaatgtgaacgggaaggagaggaacgagccggctcttcagct

SEQ ID NO: 66065 - DNA, 17342 bp, Oryza sativa
  unsure (1)..(17342): unsure at all n locations
ctacggctgcatccgggtgtccctcgtcctgtctctgctgctgctcgccgtcgaggtcgccgcctacctccaggggtggcacctcgaggaggtggcgtcgctcctcgccgtcgacggcctcttcgccgcctcctacgccgggtggatgcgcctccgcctcgactacctcgcgccgccgctccagttcctcaccaacgcctgagtcgccctcttcatggtccagagcatcgaccgcctcgtcctgtgcctcggctgcttctggatcaggttcaagggcatcaagcccgtgccgcaggccgccgccgccggcaagccggacgtcgaggctggcgccggcgactaccccatggtgctcgtccagatgcccatgtgcaacgagagagaggtaagcccaaagcaaagctccaatcatttgctccattgccctcttaagttggaatttcagattggctgttcattctcttgctatatgtacatttgtatcttcctggatcaaaatattcgaattattttagctgcaattgggattcgatcccttagttctagttctcctctgcgcgaattcagcaggaggattctgctgattttgtgtagactctgcattagattggtttggatctttgacctgtgttcctctttgacccggagatgttctgcattaacaacaacttgggtggtttctgaagttttaagttgctgtgatcttgcttgctcaatacactataacaagagcaaaaatttggtgtttttaaggttgaattttgccgttgggtgtcgtacctttcaagcatacttattgccctgattctctgtctggatgttgtcgtcaaccagaagacatgctaattgaacatcaaactgggcagcatagcgtactccttttaagactagagcgtgctacgcacaatttggaaatctgaggctcaattatctgagaggctaggccaattcaattgattccatttcatctggatgtttgcaggtgtaccagcaatccattggggcagtttgcaacctggactggccaaagtcaaacttcttggtgcaggtgttggacgattctgatgatgctaccacttctgcgctgatcaaggaggaggtggagaaatggcagcgggagggcgtgcgcatcatataccggcaccgggtgatccgggatggctacaaggctggaaaccttaaatcagccatgaattgcagttatgtgaaggattatgagtttgttgtcatatttgatgccgatttccaaccacaagccgatttcctgaagcgaaccgtgccacatttcaaggttggactcaactgaacaatgctggcagttgtaaacacgttgttgctttgcttctatgactatgaaccgtattagttatattttctgacatcttgaatgttgaattccaggggaaggatgacgttgggttggttcaggcaagatggtctttcgtaaacaaggatgagaacctgctgactagactacagaacgtaaatttgtgcttccactttgaggtggagcagcaggtgaatggtgcattcctcaacttctttggattcaatggaactgccggagtttggagaattaaggcgcttgaggattcggggggctggatggagagaacaacagtggaggacatggatattgctgtccgagcacatcttaagggatggaagtttgtcttcctgaatgatgttgaggtacaatcaataatttcttcgtggcttaagcagaatctgcattgtataaatgtcaaagactaataatttgattcatgtgatttcccttgcagtgtcaatgtgagttgccagaatcatatgaagcgtacagaaagcagcaacacaggtggcactcaggtcccatgcaattgttcagactctgctttgtggacattataaaatctaaggtacgatacttttcttctgtagcactgtgaaagctaaaatttccagcaatgcatgtactagcatagcctgtaactgtagtttctttgctagagtcactttcccaatatgttatgggtttaatgagaatttacaagatggagtagttgttgagaagcatcaaccatggtacctttttacatgtttgggcaaactttatgcatattatcttatattgaggcacaatataagaaaattgaacaagatgatgagttgctaaccactcaagcaagttaccaatgtccataagaattctctgtcggttcacttgattgaaatcatcaaagaacttatcacaatctcgtaccaggacatatactaattaagttttttttatcccttcttcatatttgatttctacctattagtccacagtttttatactgtttcattggataattaacctaatatcgctgcctaatttcttgtgcagattgggttctggaagaagttcaacctcatattccttttcttcctcctccgcaagctcatcctacccttctattcattcacacttttctgtgtcatccttcccatgacaatgtttgttcctgaagctgagctccctgcctgggttgtatgctacattccagctacaatgtccatcctgaacatcctcccagccccaaaatctttcccattcattgtcccataccttcttttcgagaacactatgtccgtaaccaagttcaatgccatgatttctggattgttccagctcgggagtgcctatgagtgggttgtcaccaagaaatcaggtcgttcttcggagggcgatcttgttgggctagttgagaaacactccaagcagcaaagagtaggatctgctcccaatcttgacgcgctaacaaaggaggagtcgaatcctaaaaaggactccaagaagaagaagcacaataggatctacaggaaggaactggcactttccttcctcttgttaacggcagcagctcgcagtttgctatctgctcagggaatccatttctactttcttctgttccaaggggtctcattcttggttgttggtctcgacctaattggtgagcaagtggagtgatagaagatgaagagtttaatggggttcttttttgtttgaaagaaaacactttgcaagcatcaaagggctctttgtaaagggaagagtgatgcaaatgttcgatgcttacacatggaagctttgatccctattctaggggtcaagattcatcacatatactgaactgtggagatgtagatagatatagtttggattaagcctgtgggatgcttttattccttcaggcaattcttttgtaagaatcttttgtgcctagatgggttcttcttctctcttaacaaactttaccttcaaatgaagataatacatgtttctaccatgtactttgatcgattaccttgggtatccatatacatgtcagattgtccttttttttcatccagtatatagaattaatcacttgttcagaacatcttctattgtcctcctgtttgttgtttgtgaatgaatgaatgataatagtatgttctgaaagaacttttaccttactcccaaatggagcccctcattaaggggcctttgctccatgctgtctttggctttgtcatgtgcattggctaggccaggttgttttgatttctgttactatcattgaaaaagacaagtacgcccaagtgtgctccttgaattgcaacagtccatgtggaggcaaataggaaatactacaagtgacctgtaaaccttgtttggcctgttgcctgatggtgcatgttctcctaaccttccaattgttattttcatatcagaagctacctactcaatatttcctctccactgaaaagtacatctgtttgatggcacggctcttgtattatttaccttcaacctctagcaattgttttcttgcccaatggaacgcacatctgcttgagaagcttctcacagaactcagttttgaggcagtgattcttctcctccatcttctcctggtccaaagtataaaaaaaccagacagctttcactgcatatcaggccagaaattctgaagatgtgatagggaaaatggatatgaaaatgctcgccggtggcgcgtgcagacaaggcacatggcgccgattctcgcgaggaaagagaccctgtgtccatcgctctccgagatccaggacataatcagacacccttactaggctgctgctgctcctccgttcgccgagttctcgtcgtcgtcgtcgcatgtcgccgtgacaccgacgtgccatcagcctccctcccccctcgttacgcttgtttttcatgcgctatcaccgcgatctcgtacgtattggcatccgggagaagagaagaagagagagctgaatttgaaagcaacgggtgcctgcctgcaacatgcatgggatggtgtgttgccctttgccatttgcccctcccccatgtgatcgcctcgtccagttccttaatctgctttggccgcgtttgactgcccccgcgcgccggcccgcgcgacgcacgcaggcacccggcgtcaggtgcggattttggtgcgtgcgcgactctctcgcgaggtacggcgcccatgcgtgtccccagatgcggctcacatgggctccatctcacgctgcccccgccgcgccaagctaggcagatgctgagatgctcccctccctcgcgctgtgcgtgcgtgagaggcgccgcagacgcgcggatttccccggtgatccggttggttttgtgctgctccactgggttggctgctgtgtgcgaccgtgactacgttgctctacggggccgtgccgtctgccaatctgttggcgcggtcggctggctccgcgatagattatactacccggcaacagcaaggcagctacagcgtctacagcctcacgcggcagcagcgatcacctgacctgaccgtccttcctcgccgttgaacatctcttgccagttttactgcatactaatagtgctctactctagtggttgggccaaatgaatcgccattggttgttcaacaatcaacactcagcggtcacgtgtggatgattagcattattgaagcggatatttgggatctcaagcatgatgataatccaaagtacggtgagcaaacagtagactcttgtcgtacgaaaagagcggcgacaaggaaacttcagatcaaacacagtggttgtagtacgtaccttgggttataacagcacgcccagagggctctatgtacaggcagagaggtcaataatacagatgtagtcgccatcagcattaacacgagctgaggcattgccctatcattacggctctaagcagggtatcccagactgagcaagtttgggggttcatcacttcatgggcctaataataacaaagtaatgatcccttaatgcgtatctgccgctactgaaatgaagccagcatgtgcttatgggactgtcggaaagtgatgattgcactgggagtctgggaccataccttgagcccgcctagctacttcgctatccctttattgccatcgtcatcgtcatcctccagatcactgaacgatacatcttcctcctgtcccagtgaagttctgttaccttctgtgccaaccacctcttctgcatcgtcgtcatcatcaggccattcatcaacttcatcttcatcagtctcggaatgaattttgggctcgatggctaaactcttggtttcatttttcactgacaactcttcttcaattaccgacttgtctactatttccatctctgtaattgcaatggggaacttttcagcctcgacatctggcgagatatcagaactgggttcttcgaacgatgaaacctctggttttccagctttgttttcaatgcttgaaggttgtatcactttctcttcagcaggggcagaggacataatcacagtttttgatgattcctcttcctccggaacctcagatcctcgcttattcttagtctgtaaactttgcagcaattcctcccttgcttgtaggatctgaatggaagagaatgtttgaagtggaatcagactaaaaccttggcatcagaaaatgtaaaccgaggaaagaagttgactgtgttacaacacaagaactgacaatgcgcccagctagtcaaaataaagctgcatctagattagagatactgggtatactaccctggtacacccttcaatttatttgtgtgtaaacataaggggtggagtagtggaactagatatggtacaagtccaggccagccaactattttgggctgcctttgcctatccatggtgataatgagcacaaattaatgggccagttccaggccttggaccatggcataggtggcccaaggtctcagtccaccgacaccgccactgcacataacagtacttgagggtagcccattctaggcacaacctgtatgcgctaaccaagtcatcaaataaggtatttcacatgtgaaggggtagggtggttatcaagaatttcgtggtaactaagatagtggtgctaaactactatataagctggaatggctcaatttcctccccttcttattttggtttaagaagctcatcatgcatttcaaggaatacaacagattccatgataaattacttgttaaaaaaatattaattgcacgataatggaattacctgtggtgttgaaagaagttcagcgtcttgcttgttgagtttcgagtgcagaagcacaaaatatatcttccagaaacatgcttcactcatatcagtagagcaaatggcagcttttatatctgacaggcttggcacaaggtgctccatggataatgcatgcacatactgagcatccgaaagttcaaagtctattaaaataacacatttgttagggagtagatcataacgttagcatacagtatgacatagtattatactgcaagatgtaaaatagtagtgttgattattatcttttgcagctttgattctcaaagaaagctggattttcgaaaaggacacgaagcattcaagaagtttgctgtttaaagctattaaacacggtactaccttctgatgaataaatgatattcttgagacattatatagatttgaacaatgaattcattgacagaactttaataagtatataaaaaatatgcagtccaccagacggccattatccaaaagaaagatgagatttgaagccagtgtacatacaggctatacttgcaaaatatatgcttgcactaatacaccataataaacttggtagcattcaacagaaacataatgaaatttcaaaatccagtatgatcttaatctgtttcatttcctgtgtggaactaagccatcttgtcattgtaattagtattacttctgaatttccataattaattcatatcttcctagtactattgagtcagtctcgaagaccagtgcacgaaataacggaacataaaatcaactaagaatgttaactttggaatggaaacatgagtcataaacaaaactctgggccctgataattgtctcctcaagtcaagcaataatgcacaaatccaacataagtactagcacaattcagtataacctgcccgattttccacagaacatgtggacatcaccaagtccagcatctactctttcaaattgttattggttttatatagtgaaatgatgagaatatttatcaccggttacgcaattttgctcaagttgacatgacagccctcctaagaaatcataagttaacagcaaagggtttcctgatttcccaactccaatgaattatcttcccacaaatcacaaccaaattcgctcgaattgagaccagaaagtacaagcattccatccctaatgcaccaaattacacaaagtaagtctgagacatcaccaaggcagtgaaacttaccatctgcatagcgctcactgatgaacagtgggaaatcgagccaagtctcgggcctggtcgagatgtgccgcacgaacaccacaacctcctcagtgacgccagccacgggctccccctcgtccgcatccccctgcccaaatggcaggagggaggacgcgatcttggatatctccgccaccgctttgttgctctgcagcatcgagatgccgctcctcaccctccccccaatctccgccagatcgctccggatccccgcgatccgcggcgactgcgctgactcctttttcccatccctacccttctcctnctcnctcccgngcggggtggaggactccgccgggggcgggggcccgaggaaggaggcgacgccccagagccggcgggtgagggtctcggtgagctcggagatgtcgtccttgacgccgcggcggctcggggtgtcgggctgctcggcctcgtcggagtcggggtcacgcggggaggaaccctccggggaggacgccctgtcgccggcgtggtcgggctcgtcggcgtcggggtccggctcgccgcgcggcgaggagagcgtcgccgcgatggagcgcgcgagccacgacattggcgcgtgcgtgcgtgcgaccgtgcgggtgcgtgggcgaagatggagatgggtggcgtggcgaccagccgaacttggggctcgtgtcgtggagcgtacgccgcgggtggtggtggatcagtctggggctctgggcgactcctggtgtgttccgagccgtccgatcggaaagcgatggccaagatgatgtttgttatcgggtgtgggtgggggtaggtgagaccgtgagcctttgagaggcatatcaagcactttcagaggtttatcacagattcagaattaagaatatggagatctagagtttgtggtcactttggtttgtacgaaatttgtgggaaaactggaggatttcaatccctatataggttttgtcactgtcatccattttggaatggagaattgggacattggaaaagcagaggagattttttcctaggaattcaaacatctgtgaacacctgtttttttccttagctaggtccgaagcaaatcagcaatggaagatataaaggaccataatttgaggacacttgaccatagttttgctatgattaacaacgtaacatcctgaaaatgtgtcattttctaatcttgcaccatgctgattcttatattcttaataaccttctaaacctaggaaaatataattagcaggacctcctaaaactaacttgcataaaacctctctggtatttagtcccttttgtatttttcatttaaaaacatatttggtatttcttgttggaattctgtttcgaatattaaactttctttcgactaaagctcttttattcaaaatttagtttgaaaaccatttttactattatgaattatggaccaagaaatcctccaattttgccttgaacctaaaccgaagtaattccaatctcattggaattaattgttagcccatcctttgatcttaaactcatcctttaattcttgatccaaatatccaaattcctcattttaatctagccatcaatttaatctctgtggcttgattttctcttcggcacaagaatagtattgttgcaaatattgtgaataattgctcttgtgctaagaaaattccaacttatactcttcattcaatttccctttttagccacaaatatacattctaccaattttagaattggagccgagcagctgtgctgaaagctgattgggatttgggagccggtgttcagagtacatgaaagctgattgcagaagagactttagatagcaacctgtagcttgtactactcccgaagagttttggttttctttttgcttctgcaatataaacggatttacatgcttcaataatatggtgtttgttgtgacttatgaacatggtgttatagacagggtttaatttttcgtttggccgattctatcggacatcattgatataccgaaatttcggtccgaaatttctaaaattttgaacaaatgttgatcaaatttaaatagaatattaccaaattcacaaaagaataaaaaataaaaaaatcggacgaaataatattgtatcgagagtccgaaatgaccaaaattcattccagaatttcttacactggttgtagacatacatatgtgttttacaatctatatatccatctgttcttggttagcagcatatttaggctgtgttcgggagtgaactctctgacacgcaaaactaaacagcgtttagcctataattaattaagtattagcaaaaataaatttgataggattaatatgattttttaaagtaacttttatatagaaatttgtttgaaaaaacacatcatttagccgtctgaaaagcgtgagcgtgaaaacgagggaggtgggttaggaaagtagagataaaatcagccttatctattctgtcttctgatgaaacaacggctcaattccatgtgcagtcggtaaccgtggcttggcgtccgttccaacgagctgaggaagacatcggcttaactcaaggaaaacgcttggctgcagcaatgtgatgggacacgcgtcgcgaactagcaatttcgcaccaggggggcgctgattgtcattttttcctctcttagtctctcttctctacagcacatgtatgtatatactatatatatatatacatgtgtataaattttgtatatacatatatggtttatatgcagtatatatatacatgtgtgtatatatacatataattttttatatgtacacacttttaatataaaaaaatatacacatgtatataaagtttatgtgtgtacgtataaaaaacctaaaatatatatatatataaactttatatatgtgtatacaaactttgtatacgtgtataaaatattgatatatgtacatataaaaacccacaaaatgcacgtatatacaaacttatatgtgtatataaactttgtatacgtgtataaaaaatttgtaatatatatgtataaaacacaaaaaatacacgtagcatacgagtatacaaactttgtatacatgtatataaagtttgtatttgtacatatacaaagttagcatacgtacgtattaaaaccgaaaaaataaaaaaacaaaaaaacgaaaacagaaggtacggaataaacacagaaaaaaagagagggaaaaaacgggagccaacgcgcagtccgccgcctcctctcatgtcgcgcggagggacgcgcgcggtgcggcactgccgcagaccattttttgccagccggaaaatctatctgtgcttataaatagccattatccaaagaacacaatccactaattagtcgaatccagagctattaactcctctccgttcgattggctcctgcgtctgccatccatggccatcttgaatcactccgacgccgccttccctgtagctgctactacgccactactcggccgccgcccgctggacgccggcgagttccggcgccagggacggcaggtcgtcgacttcatcgcggactactacgccggcatcaacgactaccccgtgcgccccgccgtcgctccaggcttcctcgccgggaagctcccggcgacggcgccgtcgacgccggagcccgacgcgctcaccgccgggctgcgcgacgtccgcgagctcatgctcccggggctcactcactggcagagcccacgtcacttcgcgcacttctcggcgacggccagcaacgtgggcgccctcggcgaggctctcgccgccggcctcaacgtcaaccctttcacgtgggaagcctcgccggcggccaccgagctggaggtcgttgtcactgactggctcggcaaggcgctgcacctgccggagaggctgctgttcgccggaggcggcggcgggacgttgctggggacgtcatgcgaggccatgctttgcaccatcgtcgccgcgagggacgagaagctcgccgagatcggcgaggagaggatcggcgacctcgtcgtctactgctccgaccagactcacttctcgttccagaaggccgcgcgcatcgccggcattcgccgtggtaactgccgggagataccgacgtgccgggagagcggcttcgttctcacggcgacggcgctgcaggccgccgtggccgcggacgaagcggcggggagggtcccgctgttcctgtgcgcgacggtcgggaccacgccgacggcggcggtggaccctctgcgcgagctgtgcgccgccgtggaggggcgcggcgtgtgggtgcacgtggacgcggcgtacgccggcgccgcgtgcgtgtgcccggagttccgccacgccatcgccggcgccgaggccgtggactcgttcagcacgaacccgcacaagtggcttctcgccaacatggactgctgcgcgctgtgggtggcgcggccggcggcgctcgtcgccgcgcttggcaccgacgacgacgtgatcctcaaggacgcggaccgcggcggcgaggcccgcgaggggcgaccaccaccaccacgccgcggtggactacaaggactgacaggtcgcgctgagccgccggttccgcgcgctccccctgtggctcgtcttcatctgaaaagaaaacgctggcttgcgcgccgtcgtgcgctcccacgtccgcatggcgnccgcgctcaagcgcatggtgcgcgccgacgcgcggttcgaggtgcccgtccgaggcagttcgcgctggtctgcttccggctgcgcggcggccggcgccgccgcacagctcgtcggcggcgacgagctcacggccagcaacgagctcaacaggaggctcctcgaggcggtgaacgcgacggggcgcgcgtacatgagctccgccgtggtgggcggcatgtacgtgctgcgctgcgccgtcggcaactcgctcaccgaggagcaccacgtccgggaggcgtggagcgtcgtgcaggggcaggccgccgccgtcttggccaccgccggcgccgccgctgacactgctcgtaccaaggaccacgccgccggcgacgaccatggcgcagatcagccgcacgcgatgacgacgacgacgacgatgggatgtcgctccggtccatgggagctgtgaactgtgtatcgaacactccgttcttacgctgtgtatttcctcttgggcaagtaaattggattacctttggttagagaggacagctggacatgccagttgttttttcaaaaaaaaaaatcgtatttgttaggcgagtttgaccggacaattaattataaattagtttttgatgatatgatatgccggatatatatatatgctgtcggtaccttttccattgttttggaggccgtacgtctctaaaatatttgatgatcagcgtaaacgttttgcacgagcttataaacaatgggcggaaacaaaaataaggcaattgggtgattgttgggcatgctcttagtagtaatggccactttgaatcaaaggaattataaaggaatttcataggattgaaatcctataggaaattttcctatgtagccatttgattcaaaggattgaagttttctaaatcctacaaaatttttatggaatggcttattgcatataggttttgaaggaaacttagcaagaggtccaacctcttggtaaaaatcctttgagtccatctctgacggagcgtggggctcctcaccgggagaccgcgcaggcccccctttgccggttcggccggggactcagggtgagattctaagctctctgtatgtggaaggttcgcgagaccggaaacacacaagacacgggcgatgtatacaggttcgggccgctgagaagcgtaataccctactcctgtgttttgggagatctgtgtctgaaggagctacaaagtatgagccaacctctcccttgttctgggttcccaatctggaaaagtccagtccccgatcgttctcggatcgttccccttttctaagtgggcaaggtcctccttttatatctcaaggggataccacatgcaccatctctcttttttgtgtggggacttatcctatcttttcataaatggacggagatttgtatggttgccgtctgaatgaccttctgatgggacggcccatacctacctccacttccgccggaagcaggcgcgacgtgggaacatgactgtctgctgacgatatgaccagtgtcagaccggtcacaaatcggtcattcttgtccaccacgcgtcagtttatcaatctgcatgttcgcccttcttcttcatacaatatcttgcttgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccacgatctgaccggtttgtgactggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgaggcgggagcagtccgaccccctcggggagacaaagaggagggcgaacacatcaccctcgggcccgacgccccccgagggtgccaggccacgtgggcgattgtgtctgcctcaagcctctagtcatgatactcccggcctcatgtcaccgacaatctctctcatccaatttctatgtttttcctgcagtccaatcaaacgatcattcctgtgtttttcctgtattttgtaatcctctgttttacacttacatccctattagaatcgtatgtttttcctattccttcgtttttttattcctacaattcaaaggggccccggtgtatttgcttcctagccatactttaccattatttatcaataaatattgccacacttgcttaagttaatacgatcaaattattagccacaccttagcaaatctaagggaatcttgccacactttcataaatcaatgacatatgggacccaatttattagaaaaaaaaatcttaccacaactatgactataaccaacaactgtcaatataatcaaatatgtctaaccttagacgtgataatatgtgactagcaactaaacatgttaacatcccctaataattaacaaacaaacgaagcagataattcgttggggcctcctcatgcctcaggacactgtactggatctagggttggacgaaaagctcatggctcgttagctcgcttggctcgtggttagctcgtctcagctcggctcggcttgttaggaattgttaacgagccgagctcatgtatcggctcgttagtcataacgagctagctcgagctaactcacgagccgctcgcgagccaaaacgagccaggcatcactggccaggagcccaggcgtgtgtcaaggcccacgatgcagcacccacgataaagccttccaatgtcaaccttatcctttcaccgtggtaggtcaatagcaaccactcaattgactcctcccgtcttgtggcagcattgtcggccgtccagcccgtcctgctcggctgctgcctgagctttaggcacagcatcgatcgagggaagcacgaagccgtcgccgagccattggcgcgcgaagcccccactcccgtcgggtgcggccgcagccaccatcgtcatcgtcgtgtcctgcggagtcctcgtccctactgccgcgcaagtccccgccgccaagcaccgtcagccgtcgtgcggagccatcgccaaatccacgtgaagcaacccctgcgtcctgcatccatcatcgtgcagagaggccagtgcctccatttgttccattgatgagtgaactgatttgcatgcagctggaagttgggagttaaatgtttaattttctactccagtttgtttgatttggggatctcttgctttgcttgatttggggatcacttgctttgcgtttctttttctttttcccatcgattaatttgtcgagctaaatgcagatggattttggttggttttggttttattttggttggaggggtcttcccaagatttgtttcttcccatgagcactcaattagcaaaaatcatctaatctcgcgagccttcgatgcctcctcgactgcaagctcgcgagccaaacgagctggactcgagattacaaacgagccgagccgagctagacttttagctcgttaggataacgagccgccaggccgagccgagccgagccgagctggctcgatatccagccctaactgggtcaagggacaagagacgtcgcgattcagatctctgttgtgatttgcagctcgagaaatgcaaagcaatttcgtctgtacattccgattttcaacaatcaaagagatacggatatgtcggacgaacggagagggtacgtaccatcaaacaacttaattatcaaaatatggacgattattaatcgaaatctgatgtttgtgattcccgtccgctcttcatataagagcttcaagcgtacacgtctattatacgaccgacaaatagaaaatggctgattaatcgctaatgacggaattatgtattcgcaagcgagtgatagagcatgcattgtctaaacgtgacggatcgctcatggtatacgtataaacggccataccaaccgttgatccgtttaaattagatacagtaacggtaacgtaaacaacgtttcgtgtcatgctacagcttgctatacatcaaacggtggtacgcactcttgcaatataggaccataaacagtggttttgtgtgtgatctgtcctgtctaaattagatcaaacggtgagtagctcttaattaacttacagtcactataccgatccgggaccggggacatcgagatagttatgtgatatatgtgatttgtcatgatcccgaaagaggtaatatatcgacaattatagatacacaagatagatctgtcattcctatacatcgggaggacacaataataaacggaaaatggttctaaactctcgagtggatgtttcagtgttttttccatataatttaaatagttatatcaaattttaccaatcctttttttttttttgcagggagcaatctcaatatttgataaggtcgagaagcacaagttgtattttgtttgttacttttgccgagctttatgttagaagattaattaccaaatttttcgtgggaggataggttggagcttgttcaacattggaagcatcaccaacgaatatccagggctctttatgatccttcctccggcatttgaggctcgtccgtgccacatgggtgagggctgcggctacctaccttgctgctaatacatgatcgatcgcgaaccatatgcatttgttgtacgtgccgtgctagcttacatgatattccgtgtgcgtctgactggaggacttcaccagaggcgacccgtgctcggttacaagcgaggtacccactttgcgctgagtgatgccgacgatcttgatctgg

SEQ ID NO: 66066 - DNA, 4509 bp, Oryza sativa
tagcctttttcctttttgtccatggaaaaaatggttcccaactttccaccgatcgcttagcttagctagctagctttagtggcttgtctcgatcgatcatctattcatcttattgtcgatcagagaccaaccatttcggcatatcgttcgatctatcgcctaactttgctgctagctagccatatatatttggatttatattgttgtcaaatactatatcagattgatcgatcggtgatcggtctatgccgttgctgccgatgacgaagctggagctcggccaccgcggcgaggcgtgggagcccggctgcctccgcgccgtcgccggcgagctcctcttcaccttcctcttcgtcttcatcggcgtcgcctccaccatcaccgccggtaaatcgctcacgactctctctgtactaaaatataagatattttaggtcaagtttttattcgtctttgttattacaagaacaacattaatcgattgtgtatgatgagtatatccgtatttaccacgtgcggttaattattttttttttcagggaaggcggcgggtggggccggcgaggcggcggcggtgacggcggcggcgatggcgcaggcgctggtggtggcggtgctggcgacggcggggttccacgtctccggcggccacctcaacccggccgtgacgctctccctcgccgtcgggggccacatcacgctcttccgctcggcgctctacgtcgccgcccagctcgccggctcctccctcgcgtgcctcctcctccggtgcctcaccggcggcgccgccacgccggtgcacgcgctggccgacggggtgggccccgtccagggcgtggcggcggaggccgtgttcacgttcacgctgctgctggtgatctgcgccaccatcctcgacccgaggagggcggcgccgccggggacggggccgctgctgacggggctcctcgtcggcgccaacaccgtcgccggcggcgcgctcaccggcgcgtccatgaacccggcgaggtcgttcgggccggcgctggccaccggcgagtgggcccaccactgggtctactgggtcgggccgctggcaggtgggcccctcgcggtggtggcctacgaactcctgttcatggacgtggaggacgccggtggggcccaccagccgctgccgcaggagtgaagtgaagccggggaaggcgcgctcacgtgaggtccacgtggcttcgggagattgcacggccgtgtgcgtgcgttttcggccgttgattggtgtaatctccagatggaattatttttgtacgtttgatttttttttccatttttgttaaaaaaaatgggaggcgtgcgtgtaaatttggggtttttttttgtgtgtatgtgccggtacaagtgaggttttgctcgttgaaaatatgatgaataatacgtatttcaaatattgttcgtgtctgatacaataacatatatgagatgagtctcttctacagtactttcctttggcgtgagtcaatgacatataggctcgctaaacatgaagccaatatatcatacacgaacaatatattaacctgctggaagtgcaaagctcaatgtaaatgcaacttacataagtgaaactggtgaagcaagtgctaggattatcattagagattgcagggggttagtgctcttggctgtgtataaaactctgcaccagtgtacctcagcagctgaagcagaatctttaacatgcttagaagggctaaaagaagcaatgaagtggattcatatgtcgattattctggaactagacaacgctgaagttgttcaggcgttaacaaagcaggtggcctcaagatcctcttgggcgatgacaattgcagaaatcaacagtgtgatacaatgtatctaacgggtgcaagtgcacaagattaagagagaagcaaatagggttgctcatgttttagcgcaaatggcaatgagtattaggtcgtgtggggagtggaggttgtgtgccccctcaccaatcctagacttgttaaaccagaaatgtaattgtggcccggagacacggtcgaagcatgctcgcaccgtgtgcgtctttcaccacatgctctggtcccgggtttcttcctgtggtcttctagcgttagaagaagtcatctgcaacgtcccctcacgctgttttttggggggacaaacaaagatcaggaaaagacagaccgaacccattcggtgactttcgcggtcatcctcactgaaccgacttggatctgaactacgattcagatcaagtcttaccgaaatttgatttccttttcatgccatatgttgtttagactttactttttccccctttctgtcctttcctctatttggttgatagggtcttcgttctattctaattctaaacccattgtcgtccacagttttcttgtcaacgcgaaggggcaagcagcccccaaacaaagaactcataccgcggttgtggcttgaaggcctcgctatttagccattaataaagtttctctcttaccctaaaaaatatcagtcacttttttcaattctaagtgggttattgatgttgatcgaggatgatttggtggatagcatcgtgccagtaatcaactatcaacattatgcatacatgacgacggtgcaatgggactatcatttgtgcgacgtatatatactacggtttggtatgctattattgactaaaaattgggcaacaaaactttcgatttttcgatttgtctttgcggaggagaaaaattctaatggccgcacgatgtacttgcgtacgttttttttacacatatattttatacactctatagctatacaatatgggaagggcctacgtgtcggacacccgatgctttggggaaaaatcgggcgctgacgtcatccgatttacgtgcaaaaactattttaaactgatttttctcaaaaattacttatccaaatcatgatccgattgcaccattaaattcgttataattaaatcttcaaaacaagatcacacatggatatattccgacgaaattttttttagcttattattgaattatttttaaatgttgcacgatgttccaccgggtatatcggaattgttttactaagtagatcggaaatgtttcactcgtttaaatcgggtgttgtttcaccttatataaaaacaatgtttcagcaaatagcgaaacaatgtttcagttcactgtaacatttgatccatacatagtgaaacattataagtacactagatgaaatattttcggtagaaaaaaaaataaaacgaatttccttaatagggggtttctaaaatatgtgggttttttttgttgcaatggagtatttcagttcactgcaacattagatctatacatagtgaaacattgtgaatacactaagtgaaacatttttggtggaacaaaaaataaatcaaatttcccttaataggggatttccaaaatatgtgagtttttttttttgcaatagagtatatggtgaagatatgtggcaagtagtaaggacacatggtgggtgtcagggttatggataccacatacctaatagtagtcgactaaatctcggcaggacccaccacataccgtgtcctatacggaaacaatcttcggatataggaggagttccgataaggaaaggcaaccaaagttctacatggaaacgatgagaactactcggattgtatccatattggtttccctagttctacttggacaagggaacacctatgggtataaataaaagcccccctaggaggagagggggcgattaacggaggatcaacactcaacacaatcaacatagaggcctacatacgccaagacacgccgccggatattgacttcagggataagcacggctagtaccctacggtgtctccggatactgtcaggagagacaaaaacgctatctctgatctcgccgggcacggattcgaggaggaaggctaccctgttgtcgactacgagtcagatcgtcagaccgccatgtcgacaacagttagatgggctaccccaaatattatactggtgtgattatcatgaataaaagcaataccggcttcggccaacagaatgtacggttattacctgataacttaggggcctgaacctgtataaaaatccctgtctccgtctcttttacctcagtctcgcgtatatcctaacaccaacgatccccatactgtccaaataccgtagtcgtgacatcaaacgtcgacagtggggtcccagtagaaacacatgggcacgtcgtggagggaggggggagcgcccgattttctcctcctcctctgggcgaccgagcggcagcattttcgtacaatatgagtatactacagtctacacttatatttgacttttttttgcggattttctaaggaaagttatatatctcgtcgttgtatttggtgtttgcggtactcatgctttgtgtatacggagtactccctccgtttcgaaatgtttgacgccgttgactttttagcacatgtttgaccgttcgtcttattca

SEQ ID NO: 66067 - DNA, 2505 bp, Oryza sativa
ccttttattacagtgagccaatgaggtcagggagaggaattatatgatgagatgtgcaggagacactacagctgcacaatatctcatttcatgagtaggtgttattccttgtacgttaaaacaaggggagacaccatacctctggctttcttatcaattctttcagaacagcatcaagtgttacgcgaagttgcttgaataggacagcagtctgtgcagcagctgccagccttaaccatccatctatgataaccactcctgtctgttaaaaaaaaagacaataagtttccccactgattacaattagctaaagataccatttaatagttaatgcacaaaaatatacacgataagttaataaccaacagtttctaaatgaatttcccttaaacaagaacatgggaggaaaaattgcctaactgatttaaacagatcgatgtgaaactgaaagccctaaaattgatgcaatttttcacttttcacatatattactcacaaaaactaataatttatactgagtagtttctcttttgattgacaagtgccaatatctaacatgtgatgtgagcacaagaaaaggcacaggcactgcatcccttatagaaataagaggatgggggttcggtatcttaagcctaatagtctaggattggatagagaccacaatacctgatgttggataaccatggtaccaccaaacagaaggagcgagtaaggagaaataacactagtatcacgtagaaataccttacttgtctcaacctgaatatagggaatagagagaatcaaaagtatcagagattcaaaaatacaatattttttcctcagatcaccatcgtaaatacttttttatatggtatatcattccacatttctacaagtgtatcttatgcaacataatgataatggtgcaccccattcatgttcaagtcaaaaggataccttctcaagaaacaccaaaaatggatattgaccagctttcaagctgtggttcatagatgatgggtgtatgtgaacttctcgtcgtccatcataccatcgaggacggtcctttccagacagaaaatcagatggcttcctgccacctagagctcctggatcaacaccctctaaagtagctgcaacattagggtatagacctgcgcatatgactgactgcaaatgccacataagcattttccagaaatgaaccatattagcgtcaaattgaactaagtgaaacaacagcttatacagattactaaaggtaaacaagcattacactaggatattaatctcatcaacatgatcatatttattttgtactttggcacatgttaaaaaaagtcaaaaatgtttagcaatcatgccattaccttgacaactgaggagtaacgagcatataagttaaatggaagagacatattcgcaaaccaactctcaagagtatttttcctcgttccatccacaggcctctgaaaaatattaggattaattgacattagaagatcgattatgatgtctgtccccgttcaaattagaaatagaggactttggcagcatttggctgggaaagtacattaccaatttaagttagggtacccttttaaagttcccaaaaagaaactaacttgctccctcaaatttagtccttttttaacattatctaatttttagtcttcatgtgactttgaccattgcatttataacttttcattggtataaattagtcaattgtaatatatgaagtgattgactgaactagtcataaggttgtcactaaggtgctaagagctacaggagcctatgtttccaactacaactctatatgtactgtagcatttagctgtccaatcatgtgatgattatatattgctagtcatcatatacttagcttgtaggacaaaaggactagagatacaaaattgtcactgttatgactcagtcaactaaagaaaatgaacaacatgatataagtctgcattccagtaaagatgatatccctagtgcaattctccataatgaaaagacataccaggctatctttaggaatatccaaaagtccaatgtctgctaataatgtcccatactgtagtcgcatgtctctgaaagggtaaaaaagtgttattgtgaaatttagttactccctctgtccattaatataaggacttttacccttcattggagagactaaggatgagagaaaaggatatatgcccctcattaaatgagtattagttagggagggaagggtggttctggattttttgcaatttggtccttttcgaaaacttattttacaaatagacccctagaaaaatttattccatgaatggtcctttttggggcgccagagacgctagtgctgtggtccaactggacggtgccagcatctttggcgctgtccccgtgccaccacgtggctgccatgcgctaacgtggcaggaggacaacgctagccatactggcgccacccctcccctcatggctccagccataatggtgcactctccccagggggccggc

SEQ ID NO: 66068 - DNA, 2088 bp, Oryza sativa
aattgacacacgaactaaacacggccttagtcactggatacaaaaattgagctgatctgacgtctcaagtcaatttgtcaaaatgaatttccttttcaactagctacaatttttatgatacttcttatctgcctttcacagggttgggctaaacatccaaatgtgtcgttcatgaaattttaatctaatgaaaaatatgagatagatagttgctctatctcggggttgtcgatctgctggtgaaaaataaaagaggtaaagtttgctcctcgggtagtatgttgtttattctctctctttttaccctggaactattatttgattgtttctgttcacacttttgggcaagaatagcacatgggtgatgggtctatcctgcttgtactgccgctgtagtatatagcaacacatcaatggcaccaggtacacaacattgtaatattctgctggatctatcttaacttccctgttggatggcatcaatggcatgtttggctgtatcaatggcaactgggctctgatctatcttaacttccctattgaatcacatgttaccttgatctggtcaatccaccaaaacaatgcccgccgcgttgggaggtgcgtgcactagacgagtatggtatttactcctataaagtaagacatgcaagaagccacatcagcaataattttaagccattagatcatattagtacaaagataacaaccgtttgatcaagaagctacttaattattcatccaattcaatcgttgttttatttagtatttttgttgcaatagaaaataagatattgccaaaaaccattacgcttgcaaaaaaacatgttctatcatcacaattttaatttttttttggcattttgcatagtacatggctgtggtatgttacttttcactattttctgttaccacgatcaacaaattcgttgcaatgaaaaaaatgtcatcttataatttaacttaattttttcatatggacatggattgggacaaaatttatatgaaagttatagctctcgataagatcaacaattttataggtgataactttttcatttgaaatcttttagatatttaaatccgtgatttaaatctcagttagatatgctcaaatgaaacgatacacttttctaacagaattgatgagtaggtgagttggtaaatgagagcacacctaaaggataggtcttgtgttcgaatctagcgaagacaaggtatcaaataataaatagttaggatgtagaacaaaattagttattaatatttaaacttttaatttggtatgtaaaactaatgtcacatatggagtggtggcaataattatttattgcaatgatgtgaagtgttgcaatatgattttttgccacatccattctatggcaacatcaaaatttattaccaccgaataaaaaatgttgaaataacctattaccacgctatttattatcacggctagcaatgattttaaaattgtggcaatatgtatctatcgtcacaattttagtattgatgccatgatttttttcgtgatgacaaattatttttctagcagtacaccacagggacgtacccagagggtagtccaggtaggcccagaattgccctaggatttggcccagaaaggagcatgtatttttttttcatggcccataaacaaatcctggcccaacaaaaaaaaactctaactttcctactagcctcctcccggcctcccagttagggatggcaacggggcgcggcggggccgggttggacaggaacggccccgtcctcgacccctgactttatcccccggccccggcccctactggtccccgacccagaccggggccctgcaaagctgtagagaaagagggcaaaccaggactgtagcagccaagacgcggtggctcatcgaggaggccagcgtcgcggagatttggcggaggtgcagaagccggcgacgcgcgatgaaaacaaaggcgaagcagccggcgacgtgcgacgaaggcacaacagccggcgacacgcggcaaagttgcagcagccggagacgcagcgaaagtgcagcggccggcgacccgcggcctagacggaagcgcagca

SEQ ID NO: 66069 - DNA, 1557 bp, Oryza sativa
tgagctacgtagcagcagtaacccattaattttgctccgtgtccatcataaatactatatcgatttatataattttcggaatccctagttgtagatccgaaaattatattaccttcttttctttgtgatttgtgaaaaaatagatataattttatcgattctctcttaaaaatgcattatatgaaaatatatatgtccagatgtacgtatatactagttatacgttccctaaagctcatgttattagtgatttattttttagatgatgtggcaaattataaaggattgcttatatggattaattaatattgtatactcctttcgtttcatattgtactcctccataaacaaaacacttatcattttgaataactttaaagtttaaaaagtttgactataaatagtttctaatatactccaaatcaacctgttacgctagccgagaacttgaccatccccattaacacatcagctagcccgtccggatgcagacgagtggttgggtcaaatgagatcgacaatagccaacgttgacactgcattcaaagcggttgtggcataagagcaggtataatagcaggctataagacaaaggtataaacatattttaaaagataaaggaagagagatataagtagcgggctacagatttatagccagcggcagcacggactctaagacgtactgtgtgtataataggtaggaccagatattaatagtacagtaaacaactattatatgaattagctattacattggctatagatggtctgtagctaataattagctatactattaagcgtgtctcctaccagggaccgcgaggtagaagctaagccgaaaatcgtcccaataagaacaaatctccgcctcgacaacaaattaagacactccccaaacgatgccgacgatctccgacagcccatcgatcgaggggttggagggatcattgtcaagacaattgcgataactgcatgccgggctccagaccaagatgacaatcgtggccattgcgaggatcgagaatgaagagactctctcggtcaccccggcggcaagatgacaataattgttgttctcggaccattgctcctgatcacggtgacccttcctctttgtccttgtcctcctcaaacaagtagtacaaaactttccctttctttgttcaaacttcaatgattgactgcaaaattctaatcattattagaattaatagatgggtcttagcccattcaaaaattaatctttacaaaatcataaaagcccacctcataaaatgacatgcatggagaattcagcaccatcttatttattctatgagagggggacctccttataagggaggatgtaatcctagccacttaagcatgtgaggtggagagaagaaggggaacacacgcgcgtgcttgcctcgccttgtatggcatgtcatggcggtgcgcgtgcacgatggtacgtgtcgaatgttccgctaaaattggctcctcacccttgcgcatatgcaaaaatttagaaacactccgcgtggtacgtgtcgaatggcaaaacctctaatgg

SEQ ID NO: 66070 - DNA, 8014 bp, Oryza sativa
  unsure (1)..(8014): unsure at all n locations
tttagtagtttaaaaaacgtgctaacgaaaaaggaggaacagctaagctgaactagctcatttttccaacttaccactctccattttccacgtgcactctttttaagtactgaacagtgcattttttttaaaaaaaaattatatacaaaagttgctttaaaaaatatcatatgaatctattttttatgttatttttagctaatacttaattaattatacattaataaaccaccacagttttcgtgcggggagatgctgcgcgtaggtcgctgtccatggcgagaagattattttatttagttgtcttttttaccaatatcatgagcaatggttcgtaattacggactaaaaattgttggaatttcgggtctatcaaatccctgataaaaaaactgttttacccgaaagtttggatttatttggcaagaaatattcaaatttgacctaattttaattaaaaaataaattactttagaacaaaattgccgtaattttcgaaattttggtactgtcgatacccaaccgaaataatgaacactaaaacttcttatcatcagtagctgctccctccgttttaagtgataagacgttttgactttggttaaagtaaaactactctaagtttgactaattttatagaaaaagtatttttaacctaagaaaaatatattatgaaaatttaatcaattatagatttaatgaaactatgctggtgttataaatactagtaattttttctatataattagtcaaactgagagtaatttaactttgactaaagtcgaaacgtcactgaagttaaactgagagtagtttaactttgactaaatgaattggagctagtagttggttatactattaaccttgctctaacttttatataactgctgcacggtgaggagtccaaatggccggcatcacatattcatttattaattggtcatagccaccagtcctgctggtgtgttattattcaaaggtcaaaccatgtgttattgctctggacaaagttcagaagcatgtgcctgctaaagcttgaatcagttggaagtaatagttgaaattacatgtgtacgattaacatctatctattatattatataataaaagttcattaaacttcttacaaacgatcctaaactgccacctaacgcttcctacgaacattcctaaattgccatgtggtgctccttcaaacacttctaaaccgccacgtggcactttaaaactaaccatcgatttttacttggtgagtttgttatttatttaccattaaattagatccatttaaaaggtccccgcttcagcttattatcaggtatatacaagataatttttatgagaaaaattgggagggcgctacgcgtcgggcgtccgatctggggtgggaaaatcgaccacccacgacagctgacgtcagcatgtatacgtgcatgcaaaactactttaaactattttttctgttaaattatttattcaaatcatgatccgattgtaccattaaattcgttgcaattaaatgtttaaaacaagacaacacatggatatatttcgatgaaaattgttttagcttattattaaattatttttaaatgttgcacgctgttccactaagtatatcagaattgtttcactaagtaaatcgaaaatgtttcaatcgtttaaatcgggcgttgtttgaccgaagttgaccgtctacgtggcattccacgtaggcagctcatttgcaaatagccccttcgcgctacagtagagcactgggcaccacaaaaatccccaaatctctcggccgcctccgtcgtcaccttgcccgccgccgcctcatgtcatcctcgtcgccgcacatcgtcctcgtcgcgcaccacggctgtgtcgcctcgctcgtcaagttctccggcctcgccgtgtccctagacgtgcactccgccgcagcgatcgcgtccctcccggcgtcctccgtcgccgccgtcgcgctcccggaggtcaagctcgacgacaaccccaccggtgggctggcgccgtacagcccgccgtcgctaagtacctcaccatggacaccccgcaggacgccgcccgatggcgagatcctccacctgctccacctctactacctggttcttgccaccgaaggacaggacaagcgacagcggcggcggcggcgtgggcagcaaggaggaggaggacgaggcgtgggacgagtggctggcgaagccgatccacgagcggatgccatggcagatgccgccggcgacggagctgcaggacgccggggtgatgttccgcgccaagaggccgccgtgcagccttgtcgacgtcacgttcagccggcgtacgtgacggcgtgctggagatccccaccgtggagaactacgccaactgcgccatacccgctaacctggtggcgtacgagcagaaccggggccggtgggagatgcagcgggtggcgagctacgtgctcctcatgtcgtcggccgcagctggaggccgtgaccaactgctacggcgagctgtacggcgacatgatggagtattgcggccggagctggaagcctggaaccggcaccgcgccatgctggtgcatgactgccatcccaccgttcaaccctactacctgttaggatttacgtgaaatattgtttcatacggtttggatagggttgttagctctagataaagtttgttgttatccctctgtattaggagatgagctcaacaaccctgccggctgtatatatgcatgtataacttgtgatcagcctgatttgaggcttctgaattaacacgaaaccacccaccgaggtgttctccacgcttgcacctctgttctttacatggtatcagagcaaaactccatctagattagtctcatggcgagttcctcctcctccaccgcttttgcaaaccctttgttcggcgtccaagtttctgagaaactcaccaagcaaaatcactccctctggtcggcgcaagttctcacagccctaagtggtgcgcgactggagggccatgtcctcggaacatccgttccgccagaagccgagcttgagcagaaggaaggagaaaaaggagagaagaccatcagagtcccaaacccggcgtatggcgaatggtttgccactgaccaacaggtcattggttttctgttcacctctctgaccagggagattctgtcgcaagtcgcagacgcaccgacggcagccgcggcatggaagacgatcgagaacgtgttctcgacacgatctcgcgcaggcgcgatcaacgtcagattggctctcaccaccactcagaagggccaatcgactgtcactgagtacgtcagcaagatgcgtgctctcggtgacgaaattgctgcaacagggaagccaatagatgatgaagaacttgttgcttacattattaatggtcttgattcagagtttgatccagtggtggaagccctcgtcgccaagaatgcatctgtcacagttgcagaggtctactcacagcttcttggctttgaaaacagggtgaagatccgaacggcgtgcgctgctatgagtggaaaccgtggcggtggaaatcagggacgtggtggcggcaacccccgtggccgcggcgctggacgcggcggcagtggccgaggtggcgggcgcggccgtggcaatggacgcggcggcgctgacaacagacccacctgccaagtctgtcacaagaaagggcatgtggcggcggactgctggcactgctacgacgagaactacgtccccgatgagaagctaggaggcgctgcgacgcatgcttacggtgttgacaccaattggtatgttgacaccggggcaaccgaccacatcaccgggcagctggacaagctgaccacacgggagaagtacaagggcaccgaccaaatccacacagctagtggtgaaggtatggatatacagcatattggtcattcctatgtgcctacatctagccgccccctccatcttaaaaatattttgcatgttcctaaggcgtcaaaaaatcttgtttcagttcatagacttgttgctgataattatgcattccttgagattcatcaaaagtattttttaattaaggacaaggtcacgaggaggacaattcttgaaggaccatgtcggcgcggtctctaccccttgcctgccggagatccaataaaacaagtctttgctgtgatgccatcgttcgagcgatggcatggtcgtctagggcatgcctcaaagcccattgttcttagggttattaatcaaaataaattgccttgtagcaatgagtctcctagtgagtctgtttgtgatgcttgtcaacagggaaagtctcaccagttgccatttcctaagtcttttagtgtctctagtaatcctttggaacttattcattcagatgtatggggtcctgcctctgactccgttggagccaagcgctattatgtgagtttaattgatgattatagtaagtttgtgtgtatctactttcttaaatttaagtctgaagtttttgagaaatttaaagagttccaaagcatggttgagagacaatttaatcgtaagattctaggcatgcaaatagattggggaggagagtatcaaaaattgaattccttctttaagaaaattggcatagcacatcaagtgtcgtgccctcatacccatcaacaaaatggtgccgttgaacggaaacaccgtcatattgttgagattgggctatctctccttgctcatgcatctatgcctttgaaattttgggacgaagcttttcttgcagccacttatctcattaatcgcttgcctagcaaagtaatcgactttgacacacatcttgcacgcctttttcaccaacaacctgattataaatctcttcgaacttttggttgtgcttgttggcctaatcttcgtccctacaatattcacaaattgcaattccggtccaaacaatgtgtctttcttggttttagcaatttacataaggggtttaagtgcttagaagtggcaaccggtcaagtctatatttcccgtgatgtcacctttgatgaacaggaatttcctttctccaagcttcagccaaatgctggagcgcgtctacgtgctgaaatttcccttcttcctgctgatcttacatcgcatgcatctgatcaagggggagtagcacatagcaatgatcatatgcataatatcttacctgttgttgctgattcctcttttgagaatgatgctgcagatgacactgaggcagatgctagcgacagcaatgcagagattaacgcagaacaacctgatggaactcatcctggtgcatcaaccggggtacacacagcagaaacagaagtggcggaagaatcgtcgtctcgtactgatcagtggcgcgccgtgcaggcccccgagcaacctgcgaccgccaccgaaccagcagccgccacgtcgtcggctgtacagagctcccgcgcgagttctcgctccatcgcaagccaccaccagcccggaggtgacacgtcgccagggcctcgtcatgatgcggcaggatcgtctgcggctccggaggttattgctgaaatagagcaaggtgagattaatggtagaccaaaaactagactccaaagtgggattagaaaagagaaaatttatactaatggtacagtcaaatatggttgttttacatcctctggggaaccacagaatctagctgaggctctaggagataggaacaggaaagagtctatggataaagaatatcatgcattaatgaaaaatgaaacatggcatttagttcctcctaaaaagggaattaatattatagactgtaagtgggtctataaaattaaaagaaaggctgatgggagtttagatagatacaaggctagattggttgcaaagggtttcaagcagaggtatggcatagattatgaagatacctttagcccagttgttaaagctgcaaccataagagctgttctatccttagcagtctctaaaggttggagtcttcgtcagttagatgttcaaaatgccttcttgcatggagttctagaagaagaggtgtatatgagacaaccaccaggatatgtaaaatctgaggcacttaactatgtgtgcaaattagataaggcattgtatggattgaaacaggcacctagggcctggtattcgaggctgagtacaaagttgaatgagttggggtttgtgtcatcaaaatcatatacatctctgtttttctatgataagaatggagttactatgtttatgcttgtatatgttgatgacatcattgtggctagttcttccgaaaatgccacctcagctcttctgcaggatttgaatcaggagtttgcactgaaggatttggaagatcttcacttcttcctaggaattgaggttaaaaaggtaaatgatgggctagtgctaacataggaaaagtatgcctcagatgtcctgagaagggtaggtatgagtgactgtaaaccagtgaatacacctctgtccatctctgaaaagttgtcaagtcaagggggagcgtcccttggtcccaatgatagcactcagtatcgcagcatagttggagcactgcagtatttgacattaacaagaccagatatatcattttcagtaaacaaggtatgtcagtatttacatgctccagctacagatcattgggcagcggtaaaaagaatattgaggtatataaaacatactgtgaaacttggtctacagattaacaagtctagttctttgcttgttagtgcatttactgatgcagattgggcaggctgtcttgatgacagaagatccactggaggatttgctgtttttgtaggacctaaccttgtatcttggagtgcacgaaaacaagctacagtctctagatcaagtattggagctgaatgcaaggcattggcgaagtgcagcagcagaagttatgtggatacagacattacttcaggaacttggtgtaaaagggcctagagccgctaaggtatggtgtgataatattggagctaaatacttaacagcaaatccagtttttcatgccagaacaaagcatatagaggtggattatcattttgttagagaacgagttgctcgcaagttacttgaggtagagtatgtctcatctaaagatcaagttgcagatggctttatcaagaccttgacagtaaggcagatggagatgtttagaaacaatctgaacctggtaggttgagattgagggggagtgttaggatttacgtgaaatgttgtttcatacggtttggatagggttgttagctctagataaagtttgttgttatccctctgtattaggagatgagctcaacaaccctgccggctgtatatatgcatgtacttgtgatcagcctgatttgaggcttctgaattaacacgaaaccacccaccgaggtgttctccacgcttgcacctctgttcttttcactaccatccccttcccagctaatcacacacgtactattacatgtatcgtatcgtcaccacgccgctgatgttggcgccggcggggacatcatcgagcttgacctctaagagcgtgacggcgtcgacgaaggacgtcgagagggacgcgatcgccgcggtagggtgcacgtccatggacgaggcaccacaccagctcgaccatcagtatgatgtggccggcgaaggggctggcgacgaggacgacgtgtggcggcggcggacgangtgacgacggaggcagccgagggatttggggatttttttttgtgcccagggctctactgtagcacgaaggggctatttgcaaatgagctgccttgtagacggttagcttcggtcaaacagggtatggaccggctacgattcattaaaagatctagatgtgcaatttataagattatggacctaagtgacacccgcactcaaatttaaggaccagcaatatattttactctaaataaaatattgatcacatataatagttatattgtagtgctgaatacatagggccgacataattatttttaaataacttagccaacatataataa

SEQ ID NO: 66071 - DNA, 5843 bp, Oryza sativa
tgcacgcgccgtcgctccgacgcccgatgcagccgccaccgctcccgcatcccgtgaggccgcgacggcgcgacggcgctctgcccctcgtgccggtggcaggcctgcccccttcccgagtcccgacagcgccgccacggctctcttcccctcacaccagcggccggcctgcccgccttcccgagtcccgactcacgccgttgcggttgcaccgcctccggcctccccgacgcgcgtcggcgcgcgcgtcccgccccggcggccggcggccgccgcccggccggcatcccgcatctggcggccctccccctccggtgagcattgcgccactgcttctccggctgtccggctctcctctccctcagtccctctgctctcccccttccaatagtcagcaggtagtactacctccgtcaataagttctttatatccatgattccccaattggagatatagtaatttgtatagattaccacaaaattgtgcgccacaatgaacctcatatgacatttttgcatggtgtgatggttgtcaggagattgaggaatgaagaagtcaagcattgtatttctttttcagaagcatgaagaaaaaaagttgcatcttgtgatctaccaatcccacctgtggatgaagggtcatctgttcctgctgtagatgatgctccaattctagttgatgaaggggcatgtgaagaacaagaaccacctacacctacagatcttgttgatgaaggggcaatttacattgtcatttaggtaagttttaaacttttttgttattatccacttgtattgaaccatttagagttatatacttgtatcatttactaggttttatatcgaatcatgatgtattgcatttagatttttttcgctaggcctaccctgggttcaaatcctaggtccgccacttgtacaccatgtacaaaagaagtacacgcatttctgaatcctgatatcaagtgattttgtattcaatgaacattcgacgcacattcaacatattagcaatgaagggtgagcatagatatatatatgtgaactgatagacctttcccttgcaaagcatagttcaccgcgtaattaaccggtagccaatggccaaatgcaagttcacaattattagactagcaaaatttacctaaagttcttttgggtgcaatataggatagcttgttgagatgaccgaatgatctatggtattctcctaatctctacaatagaagtgaaaggcatcgggaagactagtaaaacaatcatcagagttgcatctgaaattgttcgactaagaggatcctcgatcgccgcgtcctgactgtggagactaattaaactgggccatgcacgaccccatggagatgttttacgaataacttcctgtcgactacaaattactcattaactttatataagacagatagaaagacaaggcgcctaattcagatatgaggataaatttggcaactcacacttctggcaagaaatcttggaggtgaaagagagcttttacaaattttgtaataaaattgtaggtgatggtaggaacactttattctgggaagatggttgggggtagacccctgaatgaccgatttcctgagttatataatgtggcagtgacaaagaaggtaactattgcaactttgaaacagaaggggattgattccgtaaagttcaggagatgtttgtattgtgagaaactcagagactggaacaaaattaaaaatagatgggtgatctgcagctgaatgaaaatgatagggataagatttggtggaacttgacaaaagaaggcagattcactgtgaagtccttttatagtgctatgaaaatggaacaagtaaactttccacagaaaaaaaaacattgaagatcaaagtttttatttggctgtttgttggaggaaagggggtacgaattgtcaattttgtgatagagaggaaacaattcaacacctgttctttgattgtcctatggttagattactttggaacattggtaccaaattaattacagaatccgtcaataaatagcgagacaaatttattaagcctaattaatccatcattagtaaaagtttactgtagcaccacattgtcaaatcatggagcaattaggcttaaaagattcgttacgcaaattagttgcaatctatgaaattagttatttttagcctatatttaatacttcatgcagttattcaaacgttccatgtgacatggtgaaaaatgttatggtgggatctaaacagggcctagggcctcagagttatacccattttgtactcaatgaacattccaagcacattcaacatattaattagagacaaatagacgatgggtgagcatagatatatatatatgtgaactgatggacctttaccttgcaaagcatacatagctcaccgcttaactggtagccaagttcgaaattcttagactaaggaaaatttacctaaagttcttttgggtgcaatataggataggatgatgagatgaccgaatgatcgatggtgttctcctaatctctactgaagaaatggaaggcatcgggaaaatgagtaaaaccgtcatgagagttgcatctgaaattgtttaactaataggatcctcgttcgttcagtccagactgtggagactaatcaaactgggccatggccccatcgagatgttttacaaataactctttatagactacaaattactcattaacttgagttaagacagatagaaagacaaggcgcctatttcagatatgttttggcacgatcgacgacctcaagactctcactgtggcacccaacaaactaaaacttcaaatctgcacatttgatcaaatttcaatgtattttgacggaaaaaaacagttactgaatttccttatatgtcattttgttctgagattttgacatatgcaattaaagcttttgagtagtgttgtttttgctagtattcaattacggataagtaggtttccaaaaaaaaaaaatacggataagtacggcaatacaaatgtccttgaattgcttcagcagctagctactgtgccgagattttgacatatacagcatctttaagtagtgtagtttttgctagcattcaattatgcataagcactatagatataaatatgctttcctaagagcatgcccaacagtcactcaatatttgattcccaaaaaatctgaattaggaattccaaaataagaattaggcccaacaatcaccccctcctccaagagaggcccaaaaattaattccctatcatttgttagtttgccacataagcaaggtgggcctagttcggtaccgatcaatcgtctccctcctcgcaccagcgccgagacttctccctcccagcaccttctccctcccacaccagcgccgccatctgagtaaatcgcatcatcaccagccaaccagtgtcctgagtgctgcggtttctacaaaaacggaataccaaggatatgccatagctattcgtgtcatcaaggaggtaatccctagcaaatcctattgatctcttgtgccctagtcaatatctgtctctatttggttatgtggatatctattgttggaaaatattaagtttgatctaataattaattttatagattgattattgttgtattcctgccatcggttctctccattgcacttcatccctgtggtaaacgctccaaccctgtggcaataaaaaagagaagatgagtcgtcgaagtaccctcctccaaatgctattggatgaggagtctttattggatggctacgaagaatttatttcttcggcggttgatatagtgtacgatgagttcgacgatgatgaagttccaaagcgtggtggatctgttataggtcatgcagtaattaatcgggaaagattggctggacatcggagattatataatgattatttttctgaagaacctacgtacctcgatgttcagtttagacgcaggtttttagcagtgctttgttttgacaatatttgtttgcaaaattgatattaaagataattaatatcgttaattactatgcaggtttagaatgagacgacctctgtttttacgcataatgaatgctatagaagcacatgatgaatattttgtgcttggactgtcatgtttgcaaaaggtaatagcagtgtcacgtatgttaagttatggaatagcggcagatgcagttgatgagtatgttcgtattggaggtagtaccgttattgagagttttaacaggtttgtggtggctattgatgaagtttttgggagaggagtatttgagaacaccaaacgagaacgacatagctagattacttgctcagggggaagaaagagggttcccaggaatgttgggttctttagattgtattcattggcagtggaagaactgcccgactgcatggcaaggccagtataaagggaaagagggagttcctactatagttttagaagctgttgcctcacgtgaccgacggttttggcatgcgttcttcggttcacctggatctcacaatgatattaatgtccttcaacgctcaccgctgtttgcaaagctagctgaagggaaggctcctaaagttaattatagtattaacgggcacgactacactatggggtactatcttgcagatggtatttatccttcatgggcaacacttgtgaagagcattaagctgccacaaggaaataagagaaaatattttagcaaagcacaagaagctgctaggaaggatgttgaacaagcatttggagtgcttcaagctcgcttttctatagtccgtggaccagctcgtttttggaaagcacttactctgaatcagataatgagagcttgtataatcatgaataacatgattgtggaggacgagcgcgatggtgattttgatttagtttatgatgagatgggagaacaggtgggtggttcccatgaacgtacgaccaactttaatgattttattagtcagtacgaaaaaattcaagacaaggaagttcacaaccaactaagggaagacctcatcgaacatttgtggaatcatcatgcagaccgatattaattttacattatatattcttatagataatgtcatagattgtaataattggagattcacagcttgtttttaaattagtacatattgagcttatagtaattatttattgacaatgtgatttattgttgaattcgatacagtacaatagactgaaaaggacagcagtgcatatcctttttcaggactggatatatatacaggatatacaccacaagggtgtacatcagaatatgcactgctacatatgcaagccgatgataaattctggcatttttgctacatatgcaagtccatgaactgaaggttttacatgccaatcatcatcgaacattgctactagttctgacagttactttaatggactgaaacttatttcaacccttgtaaaattgatgcctgaatggctctgtaacaaccgggttatttcagcactagtggacaacatgaactgaaaatgcacactatcagtaacagggccatttgagatgaagaagcaattccatcaacaacaatttccagcaattttcaacaaaaaaacaatttccagcaattttgtagtagtagcaaatgctccggctacataaaacagtaccaaaacaagatagtacaatttactagtccattaagtaggctctatagctaaagatctaacaaattttgaatgctaattgatgagtaataagactaatttatgcttgagctgaacgatgacttagaatttgattcttcacatttttatagtactcctgctcctcgatgctcattgcactagtatcagtcctcaaaagctt

SEQ ID NO: 66072 - DNA, 1160 bp, Oryza sativa
gatcacacgctgtgcgcgcgctcgccgccgtcgccctcgtccgcttcactcgatcgtggagttggggaggaaaagcgacaactcgcgtcgcgcggttgcgatgcgagactaagccatatatagaacgagattcgtttttttttaaaaaaaaaaaactgccattaatctttttttttcgttatcccgacaaaaaggaggtgttttgacacgttcttttttctttcttttttagaacaatttgacacgtcccgaaatggcatctactacaagagcttagggaatattgttagtactattttgttttctttctttatgctaatagaagaatatacataaatgattgctctgtttttattaatataggacgttgtttcgttttggatggtgacgtttaaccattcgtgctagaataaagtttaatgtgcatataaaaatatgtaagtcataattaaagtactcatgcggttccatgaaacaaatcacaataaaaacaaggttactagtagttactataaaggagattggtgtatatattaagtttttattgtataattacttcttatatggtcaatgctcttcacaattttctttttaaaaacaaaaaaggttactagaaggagattggtacatatgggaagttaaaaaaaaaaaacttgcttcgagagcaatgaattctatcgtctttgtctcaattctaataaggccttgtcgccttgaagttatttttaaagagtgtcatgtagattttcataataatatggaggagatgagctacccttgtataagacgcacactctacaagatacaagagacgaaagaaaattttcataataatatggaagagatgagctaccctcatataagacgcacactctacaagatacaagagatgaaagaaaaggaccaataaattaagagtaaataagttaggtatttgggcagatatactacatgaaatatgttgtgtgtgtcctgattaatgagcactacactactactagatgatgccgctggaaaatcctagtgcacaaaatgatattttcacaagctttgaacgtacttctccgtgcgctaatatagattagtgcaaatgatattttcactagtttacgtaaacttgatgcagaaaatgtacgcagagagctgtgacaatgggcctg

SEQ ID NO: 66073 - DNA, 1625 bp, Oryza sativa
aaaacagagccgtgtcaaaagagcatcgcgaagaggcaaattcaagattttgtattgaggccttagcaaatggaggccaccggctttggtgcttcgctaggatgtggcatgtagacctacacatataggactgggaaacaccaggaaccaaaggggtgcactataggtaggcaaaccaagcctactcaagaatatgtgttgaggtagccaacataaaacttgtatggtttcactctaacacagccatgtgagtatggctcccgcacctgcaacgtcgagttcggcagccgaatctggtgccgcccctccgcaacgatgctcggtggtggccggatccagtgccacccttcccacccggtgcttgggggctaccggatctggtgccattccccccgaccggtgctctggagcggctggatacggcgctaccccccaccagcgtcgcacctcctctccgcctcttcccaccagtgcaacccctcctttcggccccttcccaccgccgctcgggggtggccagttccggcgcctccttttttggcgccaccccctctttggcacagcacggcatgcaaagaggtttctccacgatggtggctgaattaccagggcatgtggactaacttctattttttttctgatttcttcatcttgttctttatgtttgatgcatgcaaatatttcctgtaatgaattttcattggagtgatgaatttttgtgcgaaaaatttgtggttcaatttcttcgattttgctctagatggatgtgggatggatggatggtgatatgcggatgtgggatgaggagctactcaatgcattggctattatcaagcaaatgcattgatccgacttttgttttgcaatgcattggctgtctgctagatgcagattaggaaatctggcacccatgagggttttccaaccggcacacattgttgtttctgcagtatgtggttgtcttggctaaccagtgagttcgacctacatgagtgcattccttgaagagatggcgcctattatcacattatagtagcacacagtagacaaaagtggttattcggccatcctctaatctgcaactgatatgccttccaaactatgttatgaaagagtactattattcatgtaacagcatggtattcccgtttagttttgttactgaacataatagtatttttaaatactcacagcagtatattgaaggtcttaattaattaccaaatgcaacaaggccaaggtccgagctacatactcgcttcgtattttaatgtatgacgccgttgacttttcgattaacatttgactattcgttttattcaaaattttcgtgcaaatatgaaaatatttatatatcatgcttaaataacatttgatgatgaatctagtcacaataaaataaatgataattgcataaatttttttaaataagacgaatggtcaaacgttggataaaaagtcaacggcgtcatacattaaaatatggaggtagtattattcatgcctaaacacatgaggccccatataacctactccctccgtttcaaaatgtttgacaccgttgactttttagtacgtgtttgaccattcgttttattcaaaaaatttaagtaattatttattat

SEQ ID NO: 66074 - DNA, 1411 bp, Oryza sativa
aagctagactgtttgagggagcttctgattctgggagaagctacagcagctagcagttctccccaaataggccctatgatagaaattgcaccatctgctcccaagcttattaagcaacccaagaagaaagtgtcgacgagtggtactcgtagaccggatgattagggtattgggaaacgttggaacgaggatctacgtaatacgacatcaagcaaataaaagacaaggattatactagttcaggccccttatcaggtaatatccctagtccagtttatatgagattgatgacggagaaccacagattacaatggaagttagcgaaagtgcgaaacagacgataccgacaagatcgtaatcgatgtattcgacgagatctcccagttagttagctccgcatactccatctttgtaaactatggcgggtgtgttgagatgagattcgatgccttgcacccctccatgggggtcccttttataccgtggatcatcttgattctcaagtaagactcagaaacattggatcttgtacgatataacacaaactctatcccttccgagtattactttggaaatcacttgtcttggggagatattttccataatttataacagattccaacagcgtatacgggaacgatccgtatacgtgaaggtataccttatctgtgtattccataagtcataggatagaaggtatgacttatccgtaaccctgacagtagcccccaacatcaacttaaatgaattcacgttgtcgcccgcgacttctccggccagcgccttgtcgtacttactttgtcgatctcggtgcagaaccgtggagatgcgaagttatcgacaacgctagagggagtccaatggttcaaatatgaatttaaattgaagtctgaacaaccgcccttaacaagcctcaggatttttcggcggcaatctctttccttccttggaatgcgaaccgtcaggtagtgcgcctatttaaaggggttttgggatccatttcaagttcgtttgccaaaaatcctccagcttcatagcagcctcggacccttcgtctccccaaaagccttaggtttcttcgtcttcctccggcgatccccttgcaatggcggacctcggcaaatcttcctccgatgcggcctccttgaagaatctctacacagacggggccatccctcccaagcaaaccatggcgagggaaaaaggaggtactaatccctctcctgctttaggccgtatggtagtggtagaggatttcatccgctgtggttttttgactcccccttcggaattacttttgctgactctcaacttctatggcatttcgcttttgcaccttaaccccaactccatcgccttcctgagcatctttgctcacctttgtgaggcctacattggggtagtgcccttc

SEQ ID NO: 66075 - DNA, 7455 bp, Oryza sativa
ataggaaattagagggagtttggggaagtttagaaaatttaaaataattagaatttaattatagattaattatagtcgtagaattgcaaaatttaatataaattatggattattcttggtaatttctatgagaaatcaattcgcggtagtaatttagatgtgattaataactagacaaatagatgaattcttatagattattatagattatttttgggtaatccctataagtaatcgattcacggtagaaattcggatttagttactagggattttagccgtgtattatatttaatcatttagtcatagactaaattaaatcatataatatttctaggatttcgttcgatatttagctccaatttgagtgaaacttgaacctaaattcatctaaattcataagctttccaatgatatataattcactatttgataaaatatagttataaatattaaataattaatatcaagatgatgcataatagtcaacttaaaaatatgctaataaataaaattagtattgtacagtagagtggatgtaataatatttgtctctaacatgtcttgccactgtaacaaccacacaaactaattttatgtgatgtctcaaatgaatggatgtataggaaaatactagtacttatttaatattcgatggccatggcttataggttatttaaatcaagtgtagccttatgattatgcaactaaaatataaacacacatagatgaatctttaacctgcttaggagaataataatagagctagatgtggaggaatcactaagtaaattaatcgacgcaataccatatagaatagcttatatatgcctaaattgattaccacttattagtaacccaatagaaccagtgcttaaacttatcgcatcacatatacaatatcactcatagaaactagctaatgtataattaaactacaatatattcaggaatcacttggagcattgggtagtacactttctaaataagctcatgtagagtaggcgaccaaaaccttatacgttgttgcacacatatattgtacatcccattatagttacacaattaatttatctttttcatatattaaactgggagtatataacaaacatgaatagtagataagtactaattataaatcttgacctcatatgttcatagttcaattgtaactccggattgttcattaagagataatatgtaactataatattataaacttcccgaatttaacatatagagcatggataattattaaccttttataatttattgtgacaagtaaaatatgttcataatcaaggtaaagcttccatcaataaaataaataatacaaatgattcactgtaattatttgattgatcctaaatccatctaacaacataacctctagtatatgactgtcctatttagatggatgcatgcttagccataatccttccataagccatttgatagactaaaccaccgattagccaaatatatatgtatcccataaatgctatgatggttaactcctaaataggccacgttgacaatagaaagattaagaaaccttagcccctagcgtggttgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattccttgaacatgttgatcctaattgcgaaattgttttgtttacaaataaaattgcatgcaatgatgaacatcctacttgtgattatgccatgccttgattattgtttacccttaaaatccttgtacccatgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgcgctcgcggttattgagcaccgggacatgtattacacttggctagactctaaattcttaacttgtggggaatgggatattgcatgatgaattttatgctgatggagccacatcccgagaggagggaaggtggacatcctcagaaaaccatgacgattcaatggcgggaagctatccttgagatcacaatggatggtggacagaaccgtcattgtttaaagtgaacactggtactaaaatttgatcagtctatgctaggttttaggcttgtgaaaagaattgtaaaattagctttatgcaaaaggacctgaagccattccttgaaataccctctatcatatgcattgttattatggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcctgtggcatgttaaccgggcccttatgttattttgtcttccgctgttgttctctgatagttgttggcctacctggccctaatgtaagtatttaactcctttagcctaaattcattcgtgatatgttgtgatccaactatgtatgtgtgtaccaactactgatccagggattggtacggataaacacagaagatttccgattgccaaaatcgggggtctacagggttggtatcagagcctatcgactgtaggtcgagaccctagatagaatggccgttagttgcaggaccttatattttacaaatatatttttaaaatgctaaaaaaaagaggttatgaaaacattcaaatattgtttctcatcttacctctcttcaaaaatatctgattccgatacgccaaaaagaaaaaaatatttttgataccttacatctcaacccttcctttgacaaggcgattttatcacttgatttgtgattgaaaaatattggttctacattctcatccacatttcaaaattttagaataagaaccgaaagcaattaagacgctatagggatattattgattgtgccgaaacctcatcctcgaaagtagacgattgcatcatgattatatgaaaaacaaagtaaagaaaaacaaaagaaaagaacagaaattaactcatcaatcatgataactcatgattgttagtactagtttgctctagtcacacactcgtatagtagaagtgaagtctcgactaagccgttagtgaccatagaagctcgacctgcgacatggaagttcataaagaacaataaagagaaaagaaacagactacgtatttatgagaaagcccagcaagaatactaaacatacaaggatctaaagattatggatcaagaaggaacataagatgctacgtagatatggaaattcaataaaaggaacccttatttggataagagtacatggacgaatgatgaaagagatttgaatttattggatattagcttgagggttgcttcaaaattccaaggacaagtcgaactcatatggcttaaatcctctgaactttattttataaaatgtctttagcaaaatatcgcgaagcaaattaatttttgcattttgaaatatagccttacaaaaaaaaattacttcaaaaaggaagaaaatgtttgtttcaaactatgtaattgcaaaattgtccccagagccgcactgaacttatattaaattttgggaatggtcgaaattagccttgaaaagaaaattttctctgaaaattatttgtgaaattttgattccaaataatgtattgcaaagttttccaaaataaaacttcattcaaaaccaatttttcagtgcatgtcttcgaaagcctcctttcaaaaggttttccaagctgaattccaataattatttgcctaaagctttgtttaaaaataataataataataataataataataataataataataataataataataataataatagtaaaaaaataaatttctttcatgagttttcctttgaggtgttcaaaattattgttgtttcaactttgaaccatgcatacaatctatatggtattttggccctattggcaagagtgctcttttgcgaaataaaatcaaatgttgtttaaaaaaaaaaatttgattacaaaagtttttagttgccatgttgctttttgttaaacatatgtatgattatacaaaatcttgcttgaaaaatctattttcaaattatatttggtgagaaactgcatctcttgaatattttaaatgttttgcaaacatcacttccaaaggatatttctgcaaaatcattttgaaaaaaaaaaatcttctttgtgaacgcaaaagcatatctccttttaaattgctttcaaaatttcttattttaaggggggtagcctatgatggagaaacctcgaggaaatcaataacttgtgggaaaatatggacaaggaatactatatatcaaggtatatttgcccttgtacagggaatttgaagtatcattggatagtaaaactgcaaagggtgtgaccttaactctcgtcggcaagattcataataaatattaaggaacgaaggattgaacaaatgaagaagaaaaacaacaattcagcattgtcatgctactattgatgactagtatagtagtttactaactttcaacctactaacttctaacaagagaaacctaccacaggacgtgaagacatggacccaatcgacatcgaaaaacaagaattcctccaatctacaagaccccaaaatatgggaataaaccagcccatgctactctttgaagatcctccccaagcttccaggaacaaaggacgagtccaagcctcactaaagcctgaagactacaccatcaatctgaatcacctaaagcaatattcttcgaatgaaaggtgccacctgactccagcaaaacgaaggataaatgtcacgtgttatagatgtggcgaggaaggacattgtgccttggattgccctaagaaaaagctaggaaatggacaagtaaggaatatacctcgacacccaaaaaggaaaatgagggcaggaataccaccaaaaccgatgccacattcactctatccaaaacctatgtatcagcaatttcgtagacaaggaactacaccacattggtggaagggaaaacggaaaagaaaagcgtcatcacgaataacatatgctgaacttaacctcagtaaaatgggaatagaaatcggtgatttgcctgaagatgttgaagaactacaactatggcaacgaaagagagatggctgttgtttttcttgtggacaatttggacattatgcgataggttgtactcaagacaccaatgaagaacaagaaacactgccctcacagatcggcccggaaaaggatagagttccagacccatccaaagaagtttcgaagattaaggcatgtagtcgttgcggagagataggacactacggtagtaattgcattactcaatgcccctactgtgacgaagaccatccaaacggagaatgcccaacaacgaagatcacgtgcttcctctgcgaaaagacggatcatgtgccccaagattgtcaactaagtccgttgctgaccaagacggcggaagtacaaagagtgtcgcttcgcttcgcccatcgactcatgacatccagaagccacgaagacccgggatttcctacttttgatttgcatgtttgtttgtcgaacaatatttaagccaaaatagtttaatgtctccgtagtcccactaaatctcggggacgagatttctttaaggggggtagatgtgtaacatcctaaaaattcccaacaataaaaatcactaaaatttcgaactttttaaaacttttgcatcatgctggttgttatgattcctattgcttgccaaaccataaatgatcaccaagaaggtaaagaaaagaactacatttaagcaatagatatgatttacgagaatatatttaatcctacaaataattatgcacaagatagttaagtcaaatattaatttctattacaaattacaaattaggtattaaatattcgaaccatgattgatagcttgatgtcacaattagctaaagaaatagtaagattaaatctaattcatttgaatcgaatctcccatgaaatataagaacacatgaaatgatgatcaccactatagtgatcgtgtttataaataagtaattcaccggaatatatagattgatacttgcaacatgtcgccgagttactcatgacatgaaaatcactcatataaaataatggtcatataaataaattaatccttatatataaacaagaatatgtgagtgtttaaaattagattaatgttgtaccgagtcttaatatactatttatagaataaatagattcaacctatccgtgtaaaatatattgctataagttcattcaatgtgctattgtaataataagggccacactaggatattttagaaccctcaaagcctccaaaattatctaggctaattttagaattagacctcatttaaataatacaatagaaatatatatataagaataaaatatgggtaatattaaaatttggtaaactttcatctaaattaaaacatatattgggcaaaccttatttatgtaaaaattaggatttatagaatgaaatttatacaagggataaactaaaatcgggttaaatagaaaatggcactgttcattgcactctaggtgctcgatgtggtccctggctctatttccccctcctcagcctcct

SEQ ID NO: 66076 - DNA, 1722 bp, Oryza sativa
ttgcaacagtattatatataaaataccactcaacattgaaaatatcaggttggggcgcatgactgtatcaatcaatgcctactaatatgattcgtgttattgtccgtgttagtgttagtgttagtgttggatcccttcacgaggggtgtatttagaaatccggtatttgttcagggctaaactcgcaaaactacccacccctcccccccctctcaacgacacgacgacatccgcttgtatttctttcgtttaacttcgttctctcctctcctcttcctccccccacccgcctcgtcgccgatccgatccgcctccgcctccgcctcgcggcccggcctgcctgcctcgccgccggtggtcccgatccgaggtaaagcttcgtctcgtctccctctctcgcgcttccggtgccccgccgccggccaaaatcccgccgcgccgccgcctctcagcctgtttcccggcggattagggcgagtccgatccgtgtgcctgcgtccctgcgttgatctccgtcctcgcgagagcagcctcgccggcgccctgctgcttcccgccgcatcctcgccgttggtgccacccgtgctttcccccatccctcgcgtcgcgcctctctctctctctctctctctgtgccttatcgtgagcttctcttctagatctgggggcttctctctttgccttaaccgaattggtgaggtctgccccctgattcaggggggcgcagggcggagagattggctgagaggctttttcgttgttgtcggtggattaggatgatagagcgatcgatctcgttaggctaataatttgtttgatccgatcaggttgattgatggtgttttacctgcgtgcaggttgctcttgctgggcatcaaacatgggtctggtgaaggatggcgccgccgatttggaggaggggaccctggagatcggcatgggtgagtaacgagatcggatccattgcgttgtgcttttgcgtgatcagtggcctgtgagttttgtgttttgcttccgggcttctggcggcgtactggtgccattgcagctgaacagtgcctgcattggcactggcatgccagattttttgttatgaaaaaaaggagcctggttaaacttttcagaagttcagcaaattgtttgtgagggtccaatcttaatgtttgatcattggatgctgtgatagcttagttacccgctgaatgaagggtggaaatattggtgtacagatacttaaaattgctggttatcctatttataatgctatgctcacagtcaggttttgttcaagtacttaacctaatgtgccaatcatgatcggccctattcattgtcggcgttacattgcagttttaaccgtgcaacactatgtcatgtccttatgtcttaagtttaccatattcttttgtttgcttactatgttgatttgctgtgatttatagcacatctaaaagtgcaaatttcacaaaagcaccattcattgtggtatagacactgttccagctttccagtcttagtcataatgttgtgataacagcaacctttgtcaaacggcctaataaagatgttgcatactttcttttttcaatttgcagagtacaggactgtttctggtgtggcaggacctctggttatcttggataaagtaaaggtacgtgctactgttcctctacaaattttcaacagactaatctggtagcaagttatactgagcatttcttt

SEQ ID NO: 66077 - DNA, 23688 bp, Oryza sativa
gccaccccagggaggagggcgccagcatggctggcgccgccgcctccattcctgtttctctgtatggagttgcaacggtgtcatttttattttattttttcggatgttttttcacactcaggatcacgatacaaccaaccacaaaaaaaatttaaactcgaactaccacttagctaagtctgaaaatatctagcataccacttagtctactttgcaccttcactaaaattagaccataactcctttagtaaaaccctttgatcagcatgttaaacataatgcactctaccactatatgaaattacttaatctaattcaaaatataaccacatgaaatgacatatatataagttaaacagtacatagagatgcaattttttatttttatttcatttttttatatttttttcacactaaggagaacataggaaccaagtgtataaaaaataaactcaaacggataaaatatgtgacatgtagaattttccaaaactctaccgaaacggacaaaatatgtcatctattaaaataggcgtaactttctcatacggactcggaatcaggcaaatagtatatgcacggacatctacagaaaatgatacatccgattctcccccgctacgccgggttcggcgatattaaaacctccaaattccgcttgcaagattgtgttttcgaggagagaagtttttcggtggagctttggaaaattccacatgccacatatttcgttcgtttgagtttattttttacatggttggttcctgtgagttcctaagtgtgaaaaaaatatcaaaaaaataaaataaaaataaaaaagttgcacatctctctcctctgcactagttcggagagagaggagaggagaggaaaaattctacatgtcacatattacgtccatttgagttcaatttttctatggttggttcttgtgtgtccctaagcgtgaaaaaaatatcaaacaaataaaacaaaaataaaaaatttcgggagggggggcgccagccactctggcgcactccccctagccacctcagcatcgccccgccacgtcggcagggggacggcgccaaagaggctggcgccgtcctgttgaacgacggcgccagccactctggcgccccaaaaaggactatttttgggataagtttttttaggagtctatttacgaaataagtttttcaaaaggaccaaaatgtgaaaaatccagtaataaacatggtacgtactatcagggaaagcagatcgatggcgtacactggagccaggaattgaaggcaatgttgttacgacgttgattatcctagcgactctctggactttggcgccggtgggtcatcgtccgtgtacgtacagatctcgccggttttggtccaccgatcaatgccgctctacctaggaagtcaaggtaactaattaagtgtttgtttcatggggccgtatatacgacgttggagatcaacttactagctcctttcttttttggaaaaaaacatatacatactcctttcacccaaaaaaaaaaataagtacaccctactcgtataatcatctccagaaaactgaaccggcataatatttttagattgacgaagtcaacacgtacagacacctcgctaatgaagggtacgtcatctaccactgaaagaataaatagtcgtaaatgtgaatacctatgtcaaatctaggatttgaatccagctgggctggttccaccacaagaaacctaactagttgagttacgctcccttcacacaaaataaataaatttagtatggaacgaagtgtcatatatcgtactatgtactccctctgtccttaaatataagagctagcttttggttggatgaaatatatactagccaatattatgaatctggacaaacttcgattcctgtttaaattcgtagtattatgatatatcactttcaaccgaaatcctgtatatttggagatggaggtagtatacgtctatttattttagaaagaaaggagcacagtacagtagatgccaccgctagaaaaagggtttgtactcccgatttgtaaccccatatactacgaattcgggattaaagatgcccatctttagtcccggctgaaataaccggattatcaaccgggattaaagatggagccaagcctggtccggttggtaggctttttttctttttattgccattgttcttaactttgaatattgatttcactacatccccaaatcatccctaaatcgtgaaatccccgaatcgatcatcacagaacaatccccaaatcgatcatctccaaatacatcacaaattctaaaaaaattacatcacaaattttaaaacatacatcacatattcacatcacacatagatcaaatacatcacaaattctcaaaaacaaattcatcacaaatccttaaaaaaacaaatcctctctgctcacggtcacgccaccgccgccgaccccgccctcgcccggccgcctgccctcccggctccgcgcgagcaggccgccacggctctccgctggcctcgctcgctcgctggctgctcctcattcgctcctctatcaataactcatcgatctaccgataggaagaaggaggggataagatcggcgcatataagagagagaagagagaaattaaagaaaaggataagagagggagcaggaatagaaagatgaggagtttgggaggataagtcatatggattatatacggtatatggatttaaccgggactaaagatcgatttttagttcgaacctaaaaatcaccggcccactgatagcctctgacagtaaatgaaccaggactgaagatcattcagggccgatagagttttaaaccgggaaaaaaaccatctttagtcctaatttctattcaaactatattattgtggttttttggtaaacccagcaaaaatggtctctcaagtagtgtgcacacatctggtggcaattgtgactcgtgagttaacttgtacaaggtccaaccacgcacggttgcacggaagggcttaattaaaaatggaaataggagtaggtcataatttggccatatctaggtggaggctactacgtaccctacctgcacattgatccagctatggacggttcgtagtaaatcgtgatcatcctaggatgcccatgtacggatgttcggtgaacttgcatgtcttattataaaagtgtgactgatatcaatacaacttactctatataccatttttcacaagtcatcttaattatgtactcctttgtattaccttagcatcttaaattccatactcttcggttgtaaattttttttatttaaattagagtcgtatatagtacagtagttgtacaggtggatgcttttaattgatttatgactcacatccatatacagctgggtgcacccatccataatcacaactcagccagccgctctcctgtgggttttcaggcggcgcatctgtttttgtttcttgatgactagccaacatgggttttgctcttcttccctttcttcttcttcttcttcttcttcttcttcttcttcttctaaatttagtgtggtggtacaaccagtaggagcaccatgatggtggtagaattatgtttatctgaattattcaaataattagggctataggaccttgccaacaccgatgaggagctagggaagggcagctaccataaaattagatctaagagagaagatacaaaggacaggaagtgttaaagattgtgtatagattttgaagcaatccgtaccactcaaaagttactacttcatatgttcccacaaaaactttatttttgtgttttttttcaacatttgaccgtccatcttatttgaaaattttataaattttttttaaaaaagttgtcatgtataaagtaatattcatgttgtgtcatctaataataaaaatactaatcatagaaaatttttaaataagacaaagagtcaaacgttgtatcaaaaactaaaaaatggagtctttgtgggacggagggagtaatatactcgtgtccattccaaaatataagaaccgctagcatttgatctttttatatataaagaaaaggatttatggagtgtttgtcttatcaatcatctctcattcaaatttctccatgcgtcaccctcaaccaccctttcaccttttttttactaattgaaatggtttatgtctccagcttctatcaacaggtatatggccaacgagtcaagagaagataaaaaaaaaaagaacacgtagattctatgacaatatactatagaaactacattattcaaaatggaattaaagactgctggctaccgatttcaagagtatagcttcagaacacataatatcctactcctcccatgaaagcatcaaggaccaagaatatatagaaccagctagaagacacgaagataacatgtattgttttagatatttatttgttattgaaaactatataattgcgacaatgccaaaatggccaacataagacactagtagttactaattttgccacagtgtatattgatgaaagaggtaaggtggagccacattataatagaaaaatgagatagctattagagaaaagatgaatagttggcggaggaaatggagaatgggggaagaggagaaggtaaaaactttgtctcacatatattgaaggaacatgtgtttattatggtagcagtgctattgctagatgatattaccagtattttattttcaacattcacgatgatgaaccaggtaataggactttttactacttttttattctcacattgtggttgcccctatgttatttatagagcaagtgttatagttcttgaagagatatcatgaggtatgaggtatcaaatattacactaaatttttgttacctcatggtacctaagaaccataaaattgcttttattgttattttactatgcggccggtgtacgtactgcagactacggcagtgtgcagtgggatgtgggcaccttcttcttgaagtctgaaacagtcgtgacagaaggtgcatgggcattggccggaccgtgatcgacgaaattaatcagcgctgatcgtaggtgcaggcgactgtagattggtaagtcgcatcgtacgcctttgctagtgatcttgccaacaaacctgcagaccgaacggctgcacgtacaggccaccaacgatcgatcggtgccacttgcaacctgcattccccttcttttggcattgcagttcacgtcccccctttgacacactcctgcattcatcgatctccggcattcttccctgctatgtacacccgtttaattctctgccagtgcacactttatatcaggtttaattttcaaacacgcagatcgatcctccataaatttatcatgcgacaatagcttaattgattagatcgatcccgcttgctttatttctgctgctcacgtaatcatgtcccccacgaccgatcgatgtagtagtattccgatcgatctatcgcgagatagatcaccaggtttggttttttttaatgaacgcataaaagaattacacgtcaacgatgatggatcgccggatcgccaccacaaacgccggccgcttgcgatatgccatgcgatgcagctaattagcgcgatggcacgcagcgcagatccgccgcgaaagctcgcgctgcgtgcggtgtcttgttccgcttgtcgcgacgcactttgcacagttattctctattccaaaagcgcggcacgttttcccggtagtgcagtgcaggtgtgcagggggtgcagcaatggcggcttgcgcacgaagcaaaacacgtactccagtaggggagtacatggcttttgcattgctctcgcgcgctactatgctacgtactaccatgttggaattaacgggtggcgatcgatcgaacgagagaggacacggcgccctgcagctcgatcgatcgatcccatgaacggatcatatatcatccgatcgatccggccatcgatcgatcgatcgatcgacagagcaacatgcctgcatggtccatgtaccaaaattaactaccatagatattgcaacggcatccggtcattatttcagcagcagcagcagcagcgagagccattctgctttgcatgcatatgggtccgaccggccggccggccggcagcgagggagggaaatgcagagaggagagacagagagagccactttgcagtgcattttgccacaagctactgtaccatttatgtaaaacaagaacatcaaacagggacaaaggctggccgttgcaaggtggctttgcaaggtcccccattaacttcacatgctcagcacacaccaagatccactagctaattaagatagccaacacgtacgtacatctaggcctggtttagtttcccaaaaatttttccaaaaaacatcacattaaatttttggacacatgtatagagtattaaatataggttaaaaaactaattgcatagttagggaggaaatcgcgagatgaatcttttaagcctaattaatccatgattagccataagtgctacaataacccgcatgtgctaataacggattaattaggttcaaaagattcgtctcgcaattctcgcggtttacaggcgagttatgaaattagttttttcatttcgggccgtttcggcgagtacacagtagaagcactgtaggagtaaaaaggtcacatgcctgcacacgccgagcaaacgtcacacgactatatatcacagtatcacagcgattgtgccaacgtaccatttggcttaggcagacttattccaagtctctgtcacattggatgtttggacactaatttagagtattaaacatacactaattacaaaacccattccataaccttggactaattcgcgagacgaatcttttgagtctaattacgccatgattttgacaatgtgatgctacagtaaacttttgataattatggattaattaggcttaaaaaattcgtctcgcggattagctctcatttatgaaattagtttttttggtttaatactctaaattagcgtccaaacatccgatgtgacataggctaaaaagttttagccccatctaaacacccccttaagctcctatatatacatcatatcaatcagggcatcaggccccctacatggccctttttcatcgtacgtctatcggtctacagtatatgttcctggtacaagaatcaaatcacaccatgagttgagtgagtaattaatgagtggtcgaatcagataatgaagctcttgactgtgatggccaccttgacaacttgagttattagtaccaccagaatcaataatgagtgggagtgagttcgtccccgtacgcattgctggctttctccatcatcttccgccgagcggcccacaacccaccagttgacacttgaccgcatccagcccagcacggcctcattgttgattggacctaaacatgatttcaacgggggaatatattcacaattggagtaagttcacatatcatccctcaactttacatcgagtctatataaggtcccttaactgaaataccaggaatgtctaccccttaaatgttcaaactatgcaaaataggttacatgatagtacatatgggttgtttggataacgtggcatcctagtcagaataaaaaaaattgtggggcccatatgtcatcctcactccttttctcctctctctctctctatcctctctccgtcaagagcagggcaagcggggtgcggagcgacgatggcggccagcacgccttcttccgtggtgagctcgaaccggaggcgacgtagctccatgaaggagcggatcacctccgaggataggtgcgcgctcgcgcgaacaccgtagggaaggatggctcggccgacgacgaggacgacaaacgacgcggcgggcggagtaggccgtcgccgtagagaaggatggcttctcctccggctacctccaccgttgcggctccctcctccacccgccacatgataccgcgttcgcccatcgccactacgctaccacgctcgcccaccactgttttatccgccgcccgccgccagcctctcatgcttgttgaagaagagcgccgccagccgccggcctcccaggtccacttccgcgctcgcccaccgctgctctatccgccgccgctccgcctgccgctcgccgccctccgcccgctgaccgctgccgcgctcgcctgctgctggccttgcaggcccgccagcgctcagcccgccacccacatttgcgctcacccgtcgctgctccgcccatcgccggcctccttcattgaagagaagaggagaagagagaaaaagaaaagagagaagaaaaaagatatgtggatcccacttttttcatatcacttacatgtgagccctatatatttttattatttattttgctgactaggatgccacgtcagcgaaaccagagatccatactgctataggacctaaattgcacagttttatatagtttaggggtgaagatttttggtattggagattaggggcctcagacagactcgacgtaaagtggagggacggctggtgaacttattccctcacaatttgtcgttgagtctgaaattcattcaagaatcaaaataccaggtatagctcattccctactaacactatcgtgtcaaccttgttctctcagcaatataatggctggttttgactaacgaggcgagtgggccccacatgttagcgaccaactcgttccctcttgcccctctccctggagcgaggcggccggcaagaagggggctccagcggcgcgcaacagcgaagtaggggccacgacagtccacagctactagaggatgcccgacaagaggggatatgacgtcagctggggccatcggtgaatggaggtgacgacgcgtcgacgatgaccacaagtatattgagcttgagcttgacgacactgtgtgcgtgtggaaaggaacgacaaggcaagagagggaagagggagaggcgttgaactttggttgttccctctgtgatttggcgatgatgttcgtgagcaggagcacgacgaggttttgataggcgatgaggtgtgtggggatcctgtcggtgaggctgttgcgagggacgtcgaggacacggagggtggcgagtatagcgagggagcaagggatggacccctcatggacgttgtgggataggttgatgaggccgagggagcggcattgcacgagccctggagatttcggacggtgacaacattggcggcggagaggcggaggtaggtgagtgactggctccgacatgcagcggggagaggccctaagaggtggctgaagaggttgaggtagcaaattgtcggggaggcaagaaagacggcagggatgagctcgaataagttactggattggtcgaggcggtgaaggtgcgggggcaggaaggcctggagggcgccaaagagggagtccatggggaggtagatggcggcgaccgcggcgtagttggggtgacagggaacaccacgcctaaggtagtagttggtggtggaggaggactaggtggtgagaacagagtcgtggtcgtgggggatgacgcccttgagcacgagaagggcagcgaggtcggtggaggtggaggatgccgacgaggtgatgatgatgagcagggccacgatgtccgaggcacgcttgagagtctgagagatggggaagagagggaagaaggagagggagaggagggagccaaaaccggtcactatactgtcgagggaccaaagctaacacttaggcatggtatagtgagtgggaggatgggatacacctgatatttcggtttaggaacgaatgttagactcgactatcatcaagcggagcgcgtcccattgcagcgacaggccggaacgagttttccggtgtccgagccgcacatcgcgaggcgaggaggagcccatgccatcagcgggcgacgtcgtgggctgcgcggagccatgggccggtcaccgggtctacgcatccagtcgccaccgcgcgcatctggcctggtcccgcaccgcaccgagtcccgaagagatcaccaccacctcgcgaggccaatgtgtcggtctcgccgtgtcggcatgtttcgcgcggcacacgcaccgcgatggaaccccacgtctcccgaaagctcgcgagacaaaatactcctccagatcgaaccagaccactgcacccaacacatctcccagatcggatgctgctcctaccacgtccgtgcaaaccgtccatgtgctcgcctgagccccaggcgtgcgacgcagcgtcgtagcgcggtgcagagcacgtgacggcgcaggggagcagcacgagttcacaacgaggagtcccaacatattagcatggtacgcactgaggagtaacaagctagaaaagcggccaccaccaactactattagtactagtagcagcataaaaaacacgacacacggtgaacagtaacacagatatgtccgaaacacacacaaactgctactaccacgaaagaatatctctagatctctcttcacctacgcatttgcaccggtacaaacaacacaccacatggtatgatgggtagtcaccggcacacgagggagaagagttcgtcagttgaataacagagagagtaggctactactgaaggagtactcccagtaccactactgaatacactgatgatcgatcaaaaccagcaggggtggcggcacaggccggaaagcgcgggcgagacaaagcaccaacgccggcaacgccgctgcattgcaatgcccaccaaactccggccggcgccgtgcgcccccaccaccgacgagacggaatccactgcccccttgtgtggctctagatgagatggaacaggaatggtgcggcggcgaggaggacggaggtggcggcggccagctgggagcgcgccggcgcggcctcgttgtagtcggggttcatggcgccggccgacgggccatatgcgccgccaaacggtgggctcagggcgcctccctgagtgccggtggtcgatcccggggtcgtgatcccggtgccggcaccagcaccggtgcccatgcctgcgccggtgccggttcctgtgccaacgcctgtgccggtgcctgcgccgacgcctgcgccaccagtgccggtgccgccggtgccaactccagtgccagtgccggtgctggttccggttcccattccggtgcctacgccgctgcacacaaaaaatcagacgtagtagtgagcaaagaaagtaagaaacctcctttataaattcttgaagacattgtgcactgaaaattctggacatgcttagactgaagaaaggtagtctgagtggagtgtatatgcagatactgatgagctggtgtgtaggtgcaatgtactttgagatagggtagcgcggcggccggcagaccccggcaagccgctttcatccacaaaagacgttgctttaagctccgattagaagatccgttaagaatgccttttaatttcacatggacaagaaccatatgcaaagcagcaaaccagctatgaactacaagtaacactacttttgcatggaaagatgcaaccttttggtagtaccgaacattgtttcaactttcaactagtatattattccaggttcggcgctgccaacttgcaaatttgcaactcgcagcatgatacacggctctgaatatacgtattggtagacgcagaaacagtatatactcttctagatcagtgagttctcggtaaattaaacaaatctaactgcagtcagtacggccgtgcgtgctcacataaaagaatctagattgatgcaaagcatcaggccaaaactgcagattgcctaagatactctcatttcttttccaggtccaagaactcactaaccacaaacattaaccatagtccattaatctgaacaagaacacaagaaaaaaggatgtgaaagaaggggaggttttttgggggaatgtacctagcggtggccgggtacttgcaggtgccggagctggggtcggtgttggtgagggtggcgacgccgccgaagtcgcaggtggcgccgatggggctgttcttctggaagtaggagttggtggcgtaggagcagtgcgcgacgatggtgctcggctggtagcacgcgccggactgcatgatctgggtgcagtcggcgccgcgccagcacgcgtagtcgatggccttctgcatcgccgccgggctctggtcgggcttgcacacgcagaacgccccatctgctcgccgccgccgccaaacgggaacacaggttagctcaaatcggtagctcaaaagttcagaactgaatgcatgcatgtctcaaatctgattcaaatctagcactagctagcagaggctcggagtgaatctctcctcttcgatgtttctactgtgcacacgaacaaaagggggaaagaggctatgcgcaagaaattgcaagataaacattgagccattgctccaggcaaagattcctacgagcaactacgtgcacggtggtaataacaaaaatgggcaagaaactcaagaacaactgaacagacacgagttcgatttgcttgtccctttctcgcagaggatgcaggttttgggctggggcctcacgtacctgagcctgtggacatggccagcaagagcagcagcagcaacggaatcgccatggcagcagcagcagcagagaagagctcgagctctctctccctgcagcgagaaggagaccggccggtgtggggagtcgggaaggaaggaaggtggtgtgaactgtgaagtgcagtgctgtcaacctcaccgagcctcggtgtcctttttatcggcgagcacagccatcagccagccacaccgaccgaccatgagacgagacccttttttttccctttctttcttttatttttctctcctctctctgaacacctcgtcagcgtggcagcgtttgtgtgtcacagtggtgcgtgcgtgaccgtgcaggagagcccccccccttgggcgaggcgccgccgtgtccgcatgccaacggctttatttttctttcttctccccttcgctgctgtgttgggctactgctagtgctagccaagccaaggcggtgaggtggtgactcatcgtcctctgtctcagggggaaaggggagagagagacggtgtgcgcacaatgcgcgcacggtacagcgcgctgtccagctttggcgtggcatggcatgggagacgatgcggcgcggcccagtgttggggaggagatggccttttggacaggaaaaggagagggggctaacgttcggattctgggggactttatattcaggactatttagcctgtgtttatatccaaacttttaattttttttatctcatcaacctgtcgtatacacataacttttcagtaacatcgtaccaattttaacctaaattttcaactttgaaaggaactaaacacagccttagatccattggtaaaatttttcaccatgtcatatcaaatgtttgacatatgcatggaatattaaatataaaataaaaaataactaattacaaagattgcgtgtaaattgcgagacgaatcttttaagcctaattgctccataatttgataatatggtgctacagtaaacatttgctagtgatagattaattagacttaataaatttgtctcacggtttacatgcgaattttgtaatttgttttgttattagtctacgtttaatacgtcaaatatgtgttcgtatacttaaaaaaaattggccaaagaactaaacatggcttatgtattcaacattcgatcgtctgttttattagaaaatttaaaataatcacatataaaatattatttatattttatcatcaaataattaaaaataataattacaggaagttaaatgaaaaagaaaagttgtataaaaactaaaaaatatttttttaatgagacgaagaagtatattctagaagttgtgtatattcgtgtatcattccgacaaaacttacccagtgtcggattaaataacggataggttcgatccgggaggaaaggcaaaagggatgtgtgttctagagaggtgatgatggagatgatgggccactaggaggtcggctacttagagaaagtttaatagtatagttcactgctagcttttatttacctatagttaacctaataatcaatttatacaatagttgcttactatactattaatatatggtctcatcagtcatacacacactgtgttttagagtccgtactgcagctggctgtagcctgttgctcttctctctcataatttatctcactaaaatatgtttatagctggctaatagtctgctactatacatgctcttatatcttttatatctttttgacagttttgttttacttaactctacttcagtgttccagaaggcagtatgctaatgggttgaaaattacataaacttctttgaaagagtttaagattctgaattagttggctggtagtaaaagcatataagaatagaaaaaactgaactttcatatattctgatttatagttcgttttctaaattttatatctatatagattcccccaacagtctcttagattaaacgttctagtagtaacacagtttttaactatagcaaactgtctcattttttagaatcgtcttacgtgcacaatgaaatattttacttccaaatttgcatttttttttaccacactatattagttaacgtggcaaggcagtactccctccgtcaaaaaaaaaaaaaaagacaaaccctgatttccgtgtccaacgtttgaccgtccgtcttatttgaaaaaaatatgaaaaaatttaaaaagacaagttacgcataaaatattaatcatgttttatcatgtaacaacaatgaaaatacggattataaaaaaatttcgtataagacggacagttaaaattggacacacaaactcggggtttgtcttttttaggacagagggatgcagttgcagcccacaactgtctctttgtacttgagaaactattcacgcacaacccaaccagttgaacaacgtaatgttactatgtcagagggtgtttagatccagggttctaaagttttaacgtgtcacatcagatattatatagggtgttcaagcactaataaaaaaactaattacagaatctatcaataaaccgctcgacgaatttattaagcctaattaatctgtcattaacaaatgtttactgtaacaccacattgttaaatcatggagcaattaggcttaaaagattcatctcgtaaattagtcgcaatccatgcaattagttattttttagcctatatttaatattttaaatagatgtttaaactttcaatataacagggcgtaaaatttggaagtgcgtcgtaagaaaaaatcatgcgaggtggagtggtctcatggtgtgggagtgttctccaaccatgccacctcggatcacatggccagaatgtccactctgcttttaaaatagtaagattttagagtgtgtggatttctttaaaaactgtgtgggtggttttggaaaggtgtaaaagcaggattgtagttaacttgaatttttagaattccacacacataattcctaaacttagttattttgatacttgaggtaaaacaatatacaaatctagagagagaatgaacacaaacgaagatctgcatgagatttgagcccacgctacattcttgcaaaattactatgaattagaccatcccacatgtaatttttaggatttgtagaaacctttggtcaagcccatcccgtagtaaaatctcaagtctaatgagcaggagctgtttagattgatgtcatttctaactatactttttttttggcaaagttgttaaatgtgcatacatttagtttgttgccaaactttggtactatataagaaattctgttaaaattttggtaatgccaaaatttggtaaggtttattttggctattaatcttcatcagaatatttctgagtaatcttgtgaaaacgttagatctgggcctactctgcccaacatgaccctttatattgtgaagtccattcttaaatgggcttccgtttgacaacacccataaggccccaaaattcatccaggccgggagcagtggtgggccggtggtggtgggcctccactcctcctgctcgatttttatcgttggtggccgaatgctgctcgtctcccatagcctgcgtggtccagcttcccctcccctcgggtttccggcgtgctagggctcggccgcggtggcgaaggcgaaagggagctcggggatggaggcggccgccgacgaggagcaggaggggatctccgcccagtcgccggcccaggcgccgccctcctccgcctcgtcccttcccaaggtcccgccccgccctcccccccttttgttttttcttacgaacaagggatgcgcatgactgttatctgaggttgatgctttcttgtccttgtcgtgtgtgcgcttgttggtgtacaggagcaatcgcaggtggagctggagctgcgggtgcttcaggctctcgagttctaccctccgtccaaactgaaaggttaaaaatgcttcgccgtgttatttcctttagcttcccattctggtgatatgttgtttcgcgtgctctgatgtgtatttagtttttgcttgatcttttgtttgctgacatgatgcctttttttcttagagaaagagagaacagctctatgtgactatgtgtgaggttggaggttggatcttccgttttgaaatcgcattaacacatttaccgtggttaagagtgtgcgaggatacgtgattaattagttttggaattataagcctgccactgtcagtttggatagtcttgacaacagttgtaataacacctaaaagagcaaaacaatgaatatggcatccttagtactctatcatttctgttcctgcacataacacaatttgggtttacggctacaagttttgtacatttgtacatatgaaggaatatctagttcgctcccgcccactgcaccgcacttacaaatccccttttttctcaatgttactgttcaatgaattacataggtaggagtttattgttgatattcaactaaggtaggtagagtgggtccccccttcatatagtgagaataatttggacctctacaccgattcatggaagtattaattaagtgggttatgcataatttttgtgggcctcgtcctctttttaggaaaccatgcctcgcttctattttgaaaaccaaaaattcatgaagttgcttgtttcgttggttttgctgataaatgccataatcaggtcatctttgatcaattaagtcgtctttgatcaattagattttgagtttactataaaatccttgtatggctagaaattgctaatcaactactccatccgtcccaaaatatggggacctttgttgctcgaactacaagggtcccaataatttgggatagagggagtataatctaatattaacacatgattatatttgagctctactgcacagctagttataggagtgcttatttaggttctttagtaatgatgaccagtctgggaatgagtaaccttaagtgtaccatcaaatactaagtttaatagaatgcaatgaaggttataagagcaaagcatttctgagttgaataggctagaatgtaatactaagtctgcagcttgagttttctgtttctttcatggggctgagaaattacgctctgcaagtcaggttgctaatgcacacacttgattcaagcaattccatttatggctaattgttttaatgtatccatgttgattatccgtttattgtcacctcaaatctcattagtatctgcaaatctttgtagcattctatgtaacgaaactcgatcagttgaatgataagtaatttaggttacatattacataaattgaatttccagttttccacaatgactttttgttgtggcacgtgcatagcttccacaccattactgtggggtatggtccacattttaggaatttcctaaatttaagagatcttatttcaccagacgatactgtaaattaggaataaatcataaaatgtaaaacaacatgtaggctacataacttaaaaaaaaaactcaaaatgttaattgaattggaggatgaaccatggtgtttagtggtcttgcagttatactggtcgttattatagtgttttctggcggcaagtgcttgcttgtctttgataaccaaatgcaaagtcatctctatgtcatgatgccctgtgatatcatatgcatctcatgtcttgtgttttttgtgaacttagtagttctttgttgtatatttttgggctttagtttgaagtgatggctggcctttattggttttggcattttttactaaaattgttttgtcttttgtgaaccttgctgcatacagcttgatatgtcttgtgaaggatgccttttgctgttatatgctaataaatctgctgtactttattttgtaggcattcatcgtcactttgttatctatggtctaatggaatacttgagaaaaaggtgactatatgttcaatttaatttctgttctatgaaatctctgatctgaactgaccatctttaaattccttcagtcttgatagacaattctctgctgatgaagttttacaactactggaccgattcttcaacctagaaatgctggtaatttgaaataccaataatctctttctcatttctatgtctctactaactatgaatttgtgttttctatttacacggaattaattagatttcgatctatggataagtttacgacttgtttatggagtctggacacacttttgatgcggtctgaaaaaaatgcagaagccagaggacgacgagaaggataacttcactcaaggagaagaattttccttacctgaaagtttctttaacaaggacgaatgatagcccagtaaccctgcagcgcaacatccttcgtaatttaacagagggtaagcactaggcaccatacattgtcgctcacttgtcctgccaaattttgtactcccaaaaatatagcaaccttcgaatctggataggtatcttgtctgttactagattagattgttatatattttgggttggaggtagtagtaggctgttggttttgacttacatactatatgaatttccgcattgcagggactacgaatcttatgatgtttccaatgattctcttgcgtagacatctcttgacggcacacttcgaactgaaagaacacattttgctcggccgtgtctttgtgttagtgcttactgtgacttgtacagcttctgttgacttaggatatgcagtcaatggtacgggatctcagtacccgttaactatcagtgccgtttcttcgctctactaccatttaatccgtttttccgttgcgatgagattttgatgctgcgttgcaatcgtgcctttccgttgctgaaaaatggagcaaccatcgtaccatggctgggcagcttcgggtgggtctagtgatgagatgcgagtccagcacggcacgtaattctgccggaaaaaaaaaaggccaaacccattggaacccacggcagggccagccgccgatgaagtccacggatgccgaccaaccagtcgataaaccccgagcggaaacccaaggcggccccacccgtcagcgagcgaaaccgcggcgccgcgacgtgctgagacaggccggagcacgtggggcgcagcgcactctccctttcccttcccccctctcccctccgctccccgatgtgattttccccgccgccgctgccgccgcgccgatctgatccgcagaaatgcctcgtcaccaccaccacgacccgcctccgcctccgcccgcctgctgctcctgctgctgcggctgcgacggcggctgctaccccgcgccgaccagctactactaccccgtgccgcccccgcccccgcccgcgccaacctccgcctccgaccacctcctccacgccatcgcggcccatctcctcctcggctccgcgcccccgcccccggccccgactcccccgcagccgcagacccagcctccgccgccgccgccgccgccgcccacctccgcggcgcaccacgcgtaccactaccagtaccagtaccagtacgagcagcccaaaccccatcagtatccgcagccgcagcaggccaacccgtcggaccacagccacgccgtgctccactcgctcctgcgccgcgtggccgcgctcgagtccaccctcccgcgctgcttcgcctcgccgcccgtgccgcccccgctccaccggaaccctcgccaccgcccccgcgcggccgcgcaccgggaggaggaggacgacgaggaggaggaggacgacgacgaggatgcaccggcctcgctgccgccgccgccacgccgtgcgcgggctccgccttcaccagcgagggagcgggcggcgcggacgatccaggcgcacttccgccgcttcctggcgcggcggtcccgcacgctgcgccacctcaaggagctcgccgtcctccggtccaaggccgccgcgctccggggctccctctccgggcgaggcagggtgggcgaccccgccgccatttctgaggccgccatggccctcctcttccatctcgactcgatccaggtgatgagaacccgtaccatgggcatattcaattaggtaggcattccattggaacggtgttctgatcttgggttttctgattagggcggtgacccgatgatccgtgagggaaagcgcgcggtgagccgggagcttacccggatcttggagtttgttgataaggtgctagtcaaagagcatggggagatggcaatgaatggcgaattggattgtaaagactaccatgaaggttgcaatgccgcatttgcggctaatccgtcagcgatgaacaagaagaaggtaggtttctgtggtaatggtaaagtccaagagctgcatgatgaggctgagcaagagcatggcagtgatgctgatgagagctctgagacctcgagctctgctgaagctgaggcgaggaagcgctcaaacagtaagaggggtgctcatgccaagcccgggcttgcggcgccaatgcctgtgtacatggagccgagaaggattgacgaggagaggagataacctgtggttcgcatcctgcgatgcaatttgaggtttagaattatgtggattgtcatggtgttgttacattcctaccgttgttttttcactgatatttcctgagaagagtttagaacttttcagatggtagagtttgtgctgcagctatgatctttggaactaggagccttagcctgctgtatgctcaaattccctgtgtgttcattgcctttgttgctgggttatacaattgcactgttagctttagcatcgataattctagcttggatcattttgtgcactaaagataccctgcttgatgtcatcatgtgggatcttggattaatctgtcaatcatgtccattttgattaatcgaaattccctgtgctgcagtttgaacttcagatgttatttctagctgaagaagaccactcttcagtactactttgactgagtttgtatctttgtttggcagctaactcatgaagaaaatcacacattaatactaccttgactgagtttctatctttgttcgttggataactcatgttgattaccattcggctgtcttggttgttttaagtttattacaacgtggcttctttaattgtttccccagaatttgagccatccaccaatttatttcttcagtcaatgttgttttccctgtcttttggtatctgtttgatgaatgaagccatacttcacatttcagatcttcaagtgaatttcatttggggcttgctattgccttctgttgttttggttacaccacaaatttcagcatacattacttgtaaattagtggttatggaggacctgaaagaaaatcaataatggttgctgtgggcacaaagtttacaatgtcctggagctgtcatattaattcagtactaacccaactgattgctcctcgcttttgactgtcctgtggctgtgatgccacgggtgattggtgactgttccatccaggccatgcctattttagcttgatttacaggtcctggattgcttatttgctgtacagggttggatcactttggctggaccggcaaaaggaacatgcgtgttgccgggctaaagtgtcagacaccacatattgtatcagttctaggcctttccaacaggcaactccaatggccgtactctgtacaggtttgatagaacagtgaattgaaaagtgcctgttacagttaggacgtgtgaattttaccttgtagtaaaggtggtgaactttttatgcgatctttaaatacagaaaagaaaaaaatggtgggaattaggtatggtttgatattgttttttgcggtggcaattgcggaggataggtggctctttgaagtttgaaccgccggtgaatcaataaaaatggtactatattcaataacaacgctaattttgcttgcttggctgttttagctctgattcgttaagattaataacatgttgtcctggagacacttgaacgaacgttttacatgttttcgtacatatttacactcatctctcgtcagttagagcaagtataatagtaggctataaaccggctaaatgctgagatgaaagagagaagagaggagagagaggagaagcgagctgtaaacttacagctggcttggacactagaaccaaaaaactctatgagagagacaagtaggccctatattaattgtaaagagttcactattatatgggtaggctaagagaatgctacaaaagaatcttatagttaacaggtcggctgtattattagctttgctcttacacagggcaagaacctaatttactcttttcttgatgttggttagcctttcgtaattagctcagcatagggaaggagcaagcaaaatgaccgaaaacctaaccaaactgatcccggtctgtgattcttactaagataaatagatacgatcagttcggtcattacactcggttaactacttaattgaactgatcgaaataatagctagaagcctatgaagtatcatgtacgattgtgatttatctgtttttttttctcataaaactaccagatgtttcagtcatgactgaagactaaaccgagctaaccaaaaatcaaattccccggtcttaaactgaattatttgcaatgtatttcagtcctcagtttcagctcaccaaaagttagagtttaagagataattaaagaaatgttattgacaagcgtccaaatataagaaatgccatcaacaagcgtgagttctaagaaatgttaccgtacaaacgactttgtctaaaaatgtcatcgtcgttagggttctatccattccacgtcgataaatacattgttcatcctgtagcacttaatggtgcggtatggatggaatcctaacaacaatggtatttttggataaaatcgcttgtacaatggtattttttggaactcaaacttgtcgatattatttcttggatttggacgcctgtcagtgacattttttggattatctcaaagtttaaagcaagtggtggtgtgttttgttttccctttttctaacaataaccttttcgagttgtagtctttgtaattttttcccggcatatcgatatgaaacatactatctcgtgctattcgttatttttttaaaaaaagtttaaaagaacaa

SEQ ID NO: 66078 - DNA, 9735 bp, Oryza sativa
attcctgcagcccggatggtccaatatctcagtgcttttgagatttactgcctgcaggtagcacaagaaaatgtaagatataactagattagaaaaaacttatgctacagatggttaatacagctgctagttaacgatataatgtccacatatccaaccagacaaccagtatccaagcaaaaatgtatacagcaggcagacaaaagactaacctcaagagctttgcagactttatcaacctcaccagcatagttgatcttctttgatgtcattataagttcaacaaccgcaatacaattttgaacagaaggatcaaaaacaggcaaggctacagtaccatgaacattgtaactgattgcatggttaaggcgtgggtactcagtactgctataatactgcacattcggtgtccactcaggaaccttttgtttgtacacacgcccaggtagccccagctctccagcattttctccatccaccgagaacatgtacatcatggatacagccctgtactgaagaagcccaatactctgctggtcaagtacaaagggctgtcctgaagtagtaagcacataccggtctccactcttaaccggtgcccaaacttgaaccagcagatgctgatctgtggactccttgaagtatctaagagcctgtgtaagcctctccttaaacaagcatgagctgtccgtgttatcatcaatagataggtgaaactgccatttgctattaatctgatcaaccctcttactagtcgtgtcagaattccctaaataacagaaaagcatgcaatactatcaggaaaagaaggcaaaaagtatataaaagaagaagggataataacattgctaattgaatggataataagcttcactacgcctgaccattcgttccaaacctagagctattgcgacaaacaaatccatgtttcagtaatgatacactatgtttcttatcaagtttgataactgtaattgcttcatgttatttttcaatgaagtgaagcgaatcaacaatgctgcaaatcccatcaccgatccaaaaccatttcttgagtcaccaattaatgaaatggagtagtcctaaattgtcctggtattaaatactagtataatataatgagacaagcaaagcgttatccaactgcttcaactatacaatctagctagtactgtccatggcgtcataatccaccacttaatccacgctttagaggcaccacaccattagagacacacaggaaagcagtgctatgcattgctataaagtaaaatgagtcaggcaacaatagcacttcaaaagggtcatcttttttttgtatgcacagttaatttagtacagcaaatactccccctacctcctatagtggaatccaattaaccatcaaccgatcttggcaatcatttgcattaaaaaaacgcgcactaccaccacgaagtcagacagaaagaaacataaaaattaacacataaaaactagtagatagaaagaaagcacacaaattaaacaaaacgagcatatcattgaaacaaaacacataccaactaactttacaacattttatccattctgttgcaagagcgagtgcaaagattctgtcttgttccataaatcaacagggcaaatctttatacagccaagaaatatgccaaaaagaaggcaaggaagtcaaacataaagctcggaaacttcatggatcatgcactggaggtaaaaggttagcgtcccaacgacaggaataacagcaagattccagctgcccctctgcttcaactttggagcagccagaaagattcccaaggaacgaacaaatctacaaacccgagccaaagatgagaacaaaatcccagtgaaggtcaatttcgatctttcttttttctcccttattcgttccaaattgtatgatccagcaacaagaaaagaaacgcacgaccaatacgaagcaaggaggctcaccggagcgggtccgatggacttcctcgaccacggcggcggcctcggcgggcggagcggtggcgggggcagcgggggcgcccatgtcgagcgggagcagctggcgctcgtcgaacagccacagcggcgagggcggcgtgagccacgacgacgacgaggccggcagcggctgcggtgaggccgacaccgacgagaacagcagcgacgtggtgagcgagtcgaacggccacaaatccccacccccgccgccgattcctcctcctcctccttcccccgcgcccggcaaagacgacgatgggtcaacctccatccttaatcctctctctctctctctctctctctctatctatctatcttctccttcgcttccacccaagaacctcacttcactcagaccgcgctgcggcggcggcggcggcggtggaggaggaggcgacgcggcggctgaggaggaggaggaggaggagaggcgggagcaggagtggggagcgggaggggagcttggccattatggtgggagaggaggaggagagaatggagtggagggggatcaaatgtggctggtggtggtgtggcgggtagtggaccggaataacaataagataatggcgacgattgcgtggacatgtgggggcagatccgatccgctcatgtcgctgccatgtggggcccaccaccctcacctggtgtgtttgggtctgattggaggaggttaaagatcgtgagaagcaattgatttgcagccatctttcggaaatcttctcatttcacgtaatctagacgagaagttggattgtatgaagtagtttcgaattatgagagaaaatgtgtagctgccagaaactcccgcccttttttgcctctttccctttttcctgccaaataattggaggagccttggagttggagctggtgttgcattattgtttgcttggcggttttctgaatctacacgaattatgagggtacccgtggttatcgtcttaccgaaatgaaatctctcggcaaatcggtaactgaattttaaaaaataagtttatttgaatttcactagttttcgtcgtaattgaataataaccacggtttatcaataaaaatgctcatctaggtattaagtgatatataaagtcttatcaagcgtgtatgaataaagaacggataagtcatttcacaattcgcacaagttcaaaaagaaagtcaaactaaacctcaaattttaagaaaatttgtctaagtttcactcattttcatcaataaatgaatggcactcacggttattgataaaatcgcttagtagtggcgttcaatgactaagcatttttataaacctgagaggtggacactatataccactattttgcccttttatctatactttctataaatttataatacactaaatacctaaaactacacatacaagcatagtatttgttaatacttctaagttattaaaccattcaacgaccaacaacaaagttgaatctgtgcattcatccatagcaagactattaaatatattcatgttgaaaggcactttatatacttttttttaacccactgatgatgtcaaggttccattttcgtaggagagggactcaaatagtatgtaaatgcaactgccataatcgaacaaccccagttaatcacacataacacatacacacaacttttattacaaaagtcgcaagtggccgatgccatcatttgtttacaaagttacaaaacaattttataaaaaaccatgttagattcatttgtacatgtgtacatgtacgtagtgagaaaatctttaacaagcacaagtgtgtaatgtaatataatcgtaccggatagaatcacggcaccctcatgaaaaccgcgagcactaggttggctcacagcacgggagagttaggtcttgtttagtttctaactttttctttaaacttctaattttttccatcacatcaaaattttcctacacacatgaacttttaactttttttctttgaactttcaattttagcgtgcaactaaacctacccttagtattataataagagcaaagttgtcgccactgcacgaaactcgaccgcgcaccacgccgccccctcctccaccagatgcaaccccaacacaggcacataataaatttataaataaacaagggtggcagccaactccccgggtggtgcactccagcgtggcaataatcgatcgcgctgcgctgcgcacccccgagaccgagaccaccaccaccaccaacaacgacgacaacgtgcgcgtccacactccacgggcaacgcagccacaccacgtgtagcgccatcagtgggtgggcgtgcccgcgcgcggggagttgcaaactgcaagcaaacgcgggcgttttctcgcggcaaccgcgtccggaggccggcggccgcgtcgcccaccaggtgagctctcgcgagtcgcgatcggtgcagcgcatgcacgcacgcagcggtagcgcggcgtttttgcggtattctagcgggcaatcagcgggggggaaataaaccgggggtgcagcgcagcgcgtgcgatcccgcggcgcgcgggcgggcgggcggagacggggatgcatcgaagagggtttgattttagagcatcacttgcgacttgcgaggggtcgcggcgtgagcacatgcgggatgcgtggacgctgcctgccctgcccaggcgcgctcgggtggcacggggaccacctgggctggatggatggccgattggttggcggccaggacggccgggatccgagactgccaggtcggctggagatcgcatctgcctgcctggagtagtggtgggaagtggctactggttagctcccctccagtccctgctgcacggaattgcacggagcctctcttaccaacataccgagatcatcgcgtgctccctctgtcctaacatatagcaacatatttaagacatatcgtttgagctactgtgcaaaagtaaacgaataaaataaataaaaatatttatatgtaaaacttttatattctgccgttagtggcaccaaaaccattattactaaataatgaaatatgattaagttcaaactttacttttgcccttttgcaatctgggtgttactacatttcacggtgttagagtgtcgaacacgtattagagtttgtgtataaagtcggttataatttagaacttggatttgtactgagcaagagtcggactctatcatagattctctcttaaatagagagacgtacatgttttaaccgcatgacgatttagcataggcgagtggtagactgacaaaggcatccgatcgagagtcgttgtaactctgatatattgcaatatgttaatctaggggcggatccacccattagacagggtgggtcgaccgactcagctatgactcgtgtcgcctcacatccttaagacccatttacccccttataatagtcatgggtcatcaaaattatatataataaggtgtgaacatctaacatattatggcagctatgcgaatggactattaatataatatgtgatgtgtttgattgctcttattgagtaaaaatctccgttctccgtctgtcggatatatgggcccgggggtatgcgaagtgaggggaatctaccttcccatcctgccacgtgtccctacaacctggtcctgcccccgcattccgcaaaccgcaggagcggccggggggtcggggcctcggggtaccacgtcatacccctcgggcccttgcactgctttgccccgaggccctcgcccagccgctgtttggcgggaggagcaagcgaggagggggcccaggctgaacttcctttaatgcgcgcagcgccccaactgccccctgtcgcatttaatgcagtggggcggacgtgcggcgtgctgaactgacgcgcaatggtcaagaatgaccggtctgcgaccggcctgacgccggtcacgtccgactggacggacaaccgtgctcccacgttgcatctgcttccggcggagtggaggtaggtatgacccgtctcatcggggagtcattcggacggtggccaccacaagtcttcacctattaatgagggaatgacagggttgtcccccgtgtcaggcaagggacggcgctgggccccgcttaaggacaagctgtggtttagcttccaggtgaaggcacgggtcgagttccagtcaagatagggtgggtccccacccgaaagaagagtaggtagaggcggtgcatgtggtatccccttgaggtataaaaggaggaccttgcccaccgagaagaggaggactctgagaaaacatgaactcgtggaggagggaacaaagagtgttctcccgagtttaggaacccttgtaactctcagtctaaatcccacaggagtaggatattacgcttcatagcggcccgaacctgtataatttggtggtttgcgagctagctgggagccttgggaacggatacgtaatttctagaggcgagctttttcccccggccgaactcacgaaaggggggtctcacgatctcccgctagagaggatcactcctcgacaccatcccatctatattttaaagctgcgttcgtcagttaatcaataacctagagatgtagtcttcgactgaaatccgtgatcaaatattatctcgggtctcagagtcgtcatcagttttatatctcccatagtgtttcttccatgattggatcttgatgtactatcggggcctttttttaccacactcagccattgtttgcccggtgttttaggtagtacgtgtacgtactaataccctaccaatctaccatacatccaatacccttactgtggccgcgctgcgtccatccaccgatgactgatccacggcgtctctggtttggccacatggcgacgatcccgcaaacactgcttgccctgattgatactcctcttgctacagtaatatactccctccgttttaaaatatttgacgccgttgactttttaagtacgtgtttgaccattcgtcttattaaaaaaattaagtaattatttattttttttcatataatttgattcattgttaaatatactttcatgtatatatatagttttacatatttcataaatttttttaataagacgaacagtcaaacatgtgctaaaaaatcaatggtgtcaaacatttggaaacggagggagtactcagcaattcaccatataaacaaatcacaacatgggccatcaaccttgcctaacaaaggtgcgtacggaatcgggacgcctcttgccgcctcccatccgatacgcaccagggggtactctgcttctactactcttacgcgaggctgcgacgtggtgactcgaacagttctggggccttgttgtcgcctgcccgcgacttgacactttgcctcaccatttttgattaattattaatggctacgagaaaaaaaataaggcaaagggagaaaacgaacgaacaaacaaacaatatatatccagacactgcttgtatgtttgcgtatataattgcgtgtgccacattatatcaggattgatggatgagatcttcgcgacaggtactttgacagggaaatcatgctgatcaacgggaataggtgattttttctgtgctcatgtttagcttcttctcgatttttctgcagtcaaatccaattgtatatatatgcagctactattacacaagtccatgtcgacctcgatcggtcgacctgcaactgcaacttagctaaaaaagaaaaaaaaaagaagaggaccacgagattgaatgaccgattattggttgcatgccgaccacggaattatgagaaaacgacggtgaaattatatggtacgttctcatctcatctccttccttaccttcgatagggagcggaatttaaagtggcggagcttactggttgtctagtggcggagcttcaacaagagccaggagaggcttcagcttatgctgaatccgaatggctttggatacgatttgcggaaggcggtgtgtatatgctctgtagatactcaattagatccctttgtttcaaagaaaaattatagaaattttagaggattccattcatataggattttttccctatagccctttaaattaaagtaatgaacctcatgacctatgaaaaattaacataaggtggaatctcatgtctcaaattattgtgttttttttgtattttgtaattttctgttatacacttgtatttctgtcaaaatcttgtgtttttttctattcatctatttttccactctattttagaaattagggatcaattggtcgtcaacaagtattgcacaatctattgttaatggtattactagcaatgaaaatagtcacggaaattcctgatggccgaggtattatttctgtgtaagtcatatcggttttttcaaaatgtaaaatttgattactttttttagtttcttacagcatcatattgatgccaacattaagtagttaaattgataaatatgattaattactgaccaaccaatcatcatttttgaagagatgctactgattttgactatttctgatcgtttcatcgctaggtaatactacctctattttaaactataaggaattttctttctattttgagacggaggtagcataatattacaattttaaccatatgttaattttgttggtttttcaattcaatttttgttgaaatgtgcaagtgaaattgttttaaagttctaaagataaaacaattttgttccattcatacttcaaaaataatatcaataattacaatccaatctatactccgtatttcttatattactttctattttcttatgtttaataacttcaaatttcaaaattgatatgtatctatctgtatgttaatgtctcaattcggtaatgttgctataatttagtctagaggtttaaaactaataagtatagtttttatatacagttatgtatactatttatctgccaacgtatttatacgcgcttgaggtatctcatatttagcataccaacataatatcaattatagattttcataataattaattttagatttacatgaatttagttagttcttgtgaaaaaattgtaatattcatgtgttccaacggagagggaacaaaaaaaatgcatactcaaagattccgaagcataaatctgaaacactttttttttcacaatttccctttcgaattcactagtggatttacagtgccaaacgtgacctgatatatgctgttgcatatccgatatttgttccatttttttgggtggaatcatgagcatcttccatcgctttcccaaccaacgcccaacttgcccacagaaaaacactaaccaatggtcgatgggaatttgaaacgactacagcacctctcggacaaaagaatcgcatccacaagccagagcactatggacatggacatctactgcttctttattttatttatttgttttgactaacaggtctactactactaatcaacaggactaataaagcattaccaactcgtagtaagtatacttaatggtgatgataaccatcattgattggcgtatagctcatgaatgatggatccatgcatgtcgatggtcagagagttgcaagtgctgaattttgtgtcgaccatcttcttgtcaagcaatatcagcaactagcaagtggtttgcttccagggagatggacagcaaaggtttgttttatctaaaataacctatgttcaagggagagggacatcaaggttaattagtctacgattctatgaacatgtgttatgtaatcatgtttgtgaagctaatccattggttc

SEQ ID NO: 66079 - DNA, 46172 bp, Oryza sativa
gtgtggcattgagatacatcctgctggcatgccgcgcggtcgactctagaggatccccctcctcctccggcctcacctactcatcaagaactcctcaaccttaataagccagccggcccccgcggcagcagcagagcgcacaagaacagctcaccacgtcggtcttagtagtacgggagagctcagcttccttctccctccttttatttattttcgtcgtctcctcgctactcccccaataaaaaagccttcttttggctctcctctcggacgcacacacaacacaaccaacacagccagagtgaccagcggttaatgcctttgttatcccgccttaaaatttttcatcaggctacatcgagcgtttaacacctatataaaatattaaatataagttaaaaaataattaattgtacaaattgtgactaatttacgagatgaatcttttaagtctaattgtttcatggtttgacgatgtgtcgatatggtgctacagtataattttctaatgatagattaattaaatttaataaattcaccttgcagtttactaggattccgtaattagtttttttataagtacctaaacattttatacaatacctgatgtaacacgctaaaattttacatcctcgtctaaacacccccctagaagctggcaaaacggtgaaacactcgcgagctggactcacgcacggacgcttcgccgctgcttctttccatccctgacgacgatgaaaccgcgtgtgttttcccttgacaacgagattaacgttagccgagccgcggtttgccggtttgggttttggttggttgggctcgtgcgcgcgcgtgccgccggatgggctcgcacgtcgtctcgtctcgtctcgtcgcgtccaattcgttgcgtgcggttgtggcggctgctgcagcatggcgcgctgtcggtggcagccacggccacagctacaattatcccccctccggctgccgccgccgccgcagaaaaacggccgaacagcaggagttcctctcatttcttctcgatatcttcatcagaaaaacggccattgatgagtatgaaggattaatttcttgctgattaaatgatgattttttttaaaaaaaaaaggtgttcgtgtcagacgtgcatgagcggatcatggaagggaagaggcgaggagaggtgagaaggaatcaaatcaggattacagatctacacgatgcttcaactgggctcaaatggagacaaaaacatggtttggttctaccaacaacattgtccatgagaaactaaacaagaggatcaacttactaactactacttgtatctccatacttcagatcgaaagaatctgagcatcccgggacaaaattagcatccactaacacacgcaacttcagatcatcagatgagctagctagcctgtcatctgtgggactaataactacgatttctggacatcatcatcatcatcatcatcaattgcatgccccaaacatcgactcctttcttttcacttccttttgcatcaaaccacctcaattcaaacctaacccatccatgattttcacacgaacactagcacaagattacattttctttttccaagtcacaagacagcatcatatcttgcacacataagtggagctcattttgagagggattattattggagagacaaagccatgggcagccacatctcgcagccagccaagatcctaaacgtgcatgagcccatcagcacagtggcatcggccaactatgcccccgtggatatgctcacgtttaattgtgggtgccttgcttgcttgcttgcttcccatggccagctagaccatggctagtagctgcagtagaagtattaactaggcatagggacacacactgcttcgtgaactgtacagctttgtgggtttggttgccctgcggcttccatcgtttttattcttgcttgctccatgggagtgagggaatcattccatctgcaggttcttggctcccattttttcttttttttcgcggggatggctcccattttttcgactgacacagacatactccatccgtcccaaaaaagacaaaccctggttttcgtgtccaacgtttaaccgtccgtcttatttgaaaaaattaaaaagataagtcacgcataaagtattaatcatgttttatcatctaacaacaatgaaagtactaactataaaaaaatttcacataagacggacagtcaaacgttggcacgggaacccacggtttgtattttttttttggacggagggagtataagtattcagtgcagcttccatggatggaagttgtttaattaagctagctactctcgatctgtatgacttgcattgactttgccatggtaaaaaacctgatcttttgttgtgcttagctcaattgctcaaaccagtagaaagagtagtagaaaataatctgggagaagcagtggtggtactgtttttgtcggcagaacattttggctggtgaaatgcctatatcctgttggaattatgattaaagtttgtagctttggatcgtagtagctcctgatcaagttgtgttttatttgcacatctctttcctaggaagagagagcttagcaatatggagtttatgagctgatactacaagtgaaccgtcggtgggaaaagaccaagaaaatttccctgttgtcaccttgaactctgaagagtttcgggatctcgatgattatagtagcctcatcagcatgagaaatttctcgaaattggaaattagtatacagcactgtcaaacgagagattctcagcagaagcgtgcattagaaacttccgtcggttctaacttctgaattattgtcccaagaacaggaaaaaatgtagccctgtcatcaaacccaataaaattctcgtgttagtacagtatgctataactatctagaaaatatgaagcatcatgttggttgggtagaccatgttactttgtttacgtatcagtactatctacgtataaaaaaccgtatctacacagttaaactattactacaaactttaacaaagtattttttttcttcaccgatcataccaaacttactgagtactgggtaattcgccatagaaaaactcttatggcacatcagtagtaaaatgtagcaattgtcaaacgacagtgttcgctggagtagttagcaaaacgaaaaataaattggcaactacaacagttgaaaactgtcgtacttggttgatgccatgtttacctctgaacatgggagaagctaatcacaaccacctaatctgactattttagtcgcacgtctttgagacagattccccggatcatgcttgcctggtgcccaattagctgcacaccgatgcgattaatttccgcgacgggattagcaaaattaggccctaaaaattcgcactttgtggccgtttcgagacacggctgaaagctgaagcttagttggcagtttgactatacctgaatgaaaattgaaaaaaagccttgtcaaacatcacattaatctaagtaactatcattagctgtggtctacatctctaataatctcatagtagactgcattaccatgtccaaacaatgaaaaaatggaggaggtcagaagtgaaaaaggaaaaccagaaagcatatataggaggctcacacttggcgttgtcggtgcttagtcaattggtcaccacctgcactgcaggaaaaggtcgtctacctaggcccgttcttcaaaacgaaaaaaaaaagattaacgtgggcatatgcttcatgaatcatgagcttgtaaacgatgtgattttcataaaaactttttgtaaatatttttctaaaaaaggctttaaatatactttttaactttataatagttaattcatctatttgcacactcaaataacgaccacaaaattattgagctattcaaccgtttagcaattcagaaaaaaaaattgcaggtaccactactactagtaatggtagtactaagatcatgccttgcacacagctggaagcctggaaggaagacaatgacgacttcgaccacgaactctactttgttttgattaatccatcagaaagtacgaattaaatttgaaaatatactgtttatccaaatttttttcagaaatattcgagatgaattttttttacaaatataacatcgatctcgcgcaaccgttatgcgaaaatgacgtagacatgacgtcaccagcggtatcgcacgataaaagcgcgagaccgtgcagtatcgcgcggtattgacacgagatcgcgcggtctcacggaagcaaagagcgagtccgctcggtatcgctggttgaagcagcgataccggcatggcagtcccggccgtcaatggttaattacctaattaactattaactaataataattatcttaattaacaattaattaatcacaaatcaagataattaattactaattaactggcatgtcaatgcggtatcgctctttcaatcagtgagaccgtttggtctcgctctttggttccgcgagaccgtgcggtcggcgcgagagaccgtgcgctctcgcgctttcaccgcgcgataccgttcgtgacattacgtccatgtcattttcgcgcaacgattacgcgaaatcgacggtatatttctataaaataatttgcatcccgactattcttaaaaaaattagataaacaatatatttttaaaatttaattccagaaagtactcgtaggaggaagttgttcttggagaaaggtgaaaaaagagagagaggaagagatggtgtgtaaaaagggaaacgattgaggggagaacgagaaggttgttgagactgtcagggtttcagaaaccttccgtgatcgcaaagtaaatgcaggcagccacgcacgaggggctctgactttacaaccttggcaaccctatctcaagaacgatccatggcgaattggcgatggcgcaatcgagaagcagcacatcgagatcgagtataacgagagggagagagaggtccccatcgtttgatttatttcctaataagtcaaaacggcttattagaaaataaaaatgaatttgtaggtaaaacttttataaatgtgttcttggtaacttaaaaaccaatattgaaaaaaaatatgttacaaatatctcaaaatcaatcttaaaattaagcttgaaaatttaatatttggctttttctttgactgattaggctatccgatgggagcagagagacgatttcagaggtgaccgaatcggctacttccgcggaatccttgggccaaatctgctgcgcccaaacttgcgatgggcccatcttgaatagcttgtgtttggtatgggccgtgtagcattaggccactatcagcctatatgggcttccaattcaacaggtagaaattagtagggccagttttaccaaatagaatttttttttgagggaatttcatcaaatatccagctcaccgaattgcgctatgttagcaaaccaatattgtataagaggtatctctagctttccaaagatttggtagtttatactcataatattcatctcatctcataaaagctctttcgaaacgatgggattgtgaaaacaaaagaatatgaaaaaacacatgatgttaacatgaatgcatgcataaaacggatgattgtaaacacataaaaaaacaggaataaataatcgttacgattagaccgccgaaaaaatacaaaaatcttaggagagataaagaccatcgttgaataaacttctgacagcaccatcgttgaataaacttccaacaacagcatttgtgtataaaaaaatgtatttttctatacaggtaaggtggatatgatgatgcaaatgaaattggagcgatgaaaagggaaatatggatttggttcaggttctcgagataggcaatgaccttacatcctgtttggctggggtgaaaatagtaatctagcctacacgactatgtcggcataaagtcatggtgaggtagttgggattagctgttggctcatgtggcttgtattgtctctcattctccccttttgagaggattgtatttatatccaactagaaaataggcgtgctagttggcgcgccgattaataaagcctgtggtggtattgttggtcatgttcgagatacataaattgatcatttttttttcttgagagatttgaagactatacaaatggaagcaaagagaccataaaaaaagaaaatattagaatgaaattcacctccagaacacatagttatatagttatagtacccactggaaaacatttagttagacatattccacaaagtcaagttggagtgagtagtgtaagataagtcaattggtcacatggatagacgaatatatttgaagttcatatacttaagagctagggagattgaatgtatggggttatctacataaatagttaattctaaaatatatatgaaatggaatatttgtgatattcctatttaaaaaaatattatggaaatgtataattctcaacaatatatgttataaagtggcaacaaatcctaagtgattactacagttggatcgctctttcaaataaaaaaagcttagggtctttaagtaaatacctctatacgcaagttttaagtggatcaacatattagaggggggggggaggaggggtacatccttttataaagtggcaacacatcctaagtgatttctactggatcgatcttccaaataaagaaaagcttagggtctttaagtatatacctctatatgcaagttttaagtgaatcggcatatgagggatgggggggggggtacatccttttaatcccatctaatcgaaatgttctagatgttgtgttgttaaggtattaccttttcttttaaaagctgttaaggtactacttgcttttagaattatcacataacattgtagttttctatttttcttgttcttatgtattttttctttagacaaaatccaagatttatttgataagacatgggcgtcacgtggcccaatcaaaagacgacgtaaccgccggctttagattagtagatatgggccttttgtctaagtataactcaaaagttaagttaggatacaaatccaaatagccctagtcattctgtcatagaactatgtttttcttttgcagttggggactcatttcttcttactaggttaagactatctttattttgaggttttgtttcataggaatcaatattcggtattcacatgtctgcagggcatctcaaatttagtaattcctttcgtctcaaatatagctacttcactgtacaaatttaaactatttagtaatccctctgtctcaaatattgctaactttatagtaaaaaattaaactaaaaaggtagccatactttaggatagaaagaccaaaaggaaattatccatgatattggatctcatgctaaaatttctccaaaactgacatggattgaggcattccaaatgaatttaataggattcactaacgttcaaaactttgttataaggggccatacaggggaaaaattctatgagattggaatcctaaaaaaaatcttatttcctttaaaggagccatataatgtatgcatcatgtggtttagtgagaaagaaaggagccatatagtttgactgtaaatcggaataagatctggaataatgatctacatatatgtttaaactaatttgacattttgagtgagcacccactccactttaaccagaagaatctggtcattgatctggtctctgattagatgggttataaagcatgacactgataatttgtattaaataaatagtaaaatatacgattggaaacatcacggactctttactgtcagttttttgttttcaaaatttaaatatcaaaattcggaacgaataagtatgaagctgtaagttgcaaccttcttgaactctcactttaatatactattattattaccaatttaatttaagaaattgtaactgccgaccggggcggactcatttttaatcttacgccaccacatttaaaaaataaccaacacatttaatacataccatcaataacacgggttaccgacatgcgtacaacgagccgtattttttttcccttgcatcatatactccgtatcaaattatttcgtttactatctgatgcgtgacgatcataaagttctaagcactatattaaactaaataaatcgagctattaatagtgccttggcctagggtgcaagctaagtttttctttattttttccttttctagttacgccaatcggttatattccgttacctttcccttcccttctttccagtagtttccacctttcccgcatcttccgccgtggggaagggagcaatcggcaagccaatccaatccggttgcttctcctccaatccaacctcgtcggcggcggcggcgacccgcgccgcgcaggtgaggcctcctcgcgctccccctcccgcttccgccgccgccgccgcttgggttgcccgtcgatcatgcgtcccgcggattgggggctcggtttttttgtatttgatctggtttgcgtggagattaggggcgatgtacggggtggatttttggttatgggttggattggatgggagagatcgtatttcgtatcgatgctccgtttggccttaggttttgtatttagtggatggctcgagtccaagcgtagaaaagagagaaagaagtgattcggaagttctatgttgttgtttcgatgtagatggaaaagtgtattgcgcatttattgttttgggattactagcaaaagtttcatgctcatttgtctcttgcttgtaaattttgatggaacaatagagagaagacacagggaccagctaagctgtgcatccttgttggtgatggttttttacaaatgatgaatagccgcctatcagcaaaattctttcattttacagttgctgcatttggaatttgattgaacaattatctccttttgttttggtcaagtcatggaactggtagtgccttgcattctgaaaaggggctctagattactgtacctcatttaagataatttggcagcagtacaatattatcctatatatattgtgatatgttcaattaatactgtaacacttatatgtacaatattatcctatatatattgtgactgttcatgcttgtacattgttcaattaatactgtcacacttatatgcatctctgtttgtgttcctcattaggctgttgagttatcacgtatttgattatggatctgccattgatggctgctaaagcctataagtacaaagcagaactacttgttaaggactacctgctagcagattcgtatgttccatacgcttctgtgcttggcggaattctgatgtgcaagttggtaatgtcacttctgactctcacttttctgttaattatcatcattctactgtgtacctgtgcaataacatgttcatagttgtgcgtatgtgtatactcaaagagaatgccaacatctatgccattgctcttttgcattggaatgtaagacctttttttttcattcactggttttatttgttccattaaaatcatggtcaatgatgatggcacataattaatatagcatattatttccaacatccatttcatagtccttgtaatggttttgttatcttgactattgtgttcttttgctagctcagtcatatgatttcacacgctttatcagttcattctacttcaaaggctatggttctctcacaaagatgcaaaaggttgaatggaataacaggtcagcagcattaaccaacttaattgccaagttcctacatcccactctattattataagcttctgatgatacatcttctgaccctttgttactataggggcatgtccaccgtccatgcaatattcattacacttatgtcagcatacttagtcttcttctcgggtttattctctgaccagcaggatggaccagtaacatttagaagttcgagcctctccaatttcacgctaggggtatacatatgcaattactttattgtcctgtgacttgtgatatttcattatacttagttacttgaatctcatgttttgctaggtctcagttgggtatttcattgcggaccttgccatgatactatggttttacccttcactcggtggaatggagtatgtaagtaaacatttttcatcttatttttaccctctcttcagtttccctcctaactgactaacctaggtccgttgccctccatttgactcctgcaaactgcattatttgtcattagccattaccaacttactcttggctgtcttttgtcagcttgtccaccatgtattgtcacttactgctgtaacgtatactatgctttctggggaaggacagttatacacatacatgagtctcatctcagagactactacacctggaatcaacctaagatggtaactgagtatacaaatatgttgcatagaattttgttttggtatcatcttcaatccatcagtccatctaaactgctattctctcccctttgtgttatcaaggttccttgatgttgctggaatgaaaagatccaaaagatacgttgttaatggagttgcaatgtttcttacttggctggtaagaataaagttctaaactagttgtgttgtggcagaatgtattgttctgcactgactataattaaatgggaattatgtgatctatgcatacattttcgtgaaagcattagtctttaattacatctgaacttttcaactgtaatattgttttatttaaatttttgtgatttcgaatttctgctagccttggaagcagttgtcttgctagttcggatttgtacatatgttcaaacaaatgcttgttttccagtgaggataatattggcacataggtttattggctaccaagtgagatatattgaattattctaagggaaaatgatccttcctaactatgggagttttaagactaaactaccaaagttgtatttgaacactcaggtttacttaaatctgtcgctaaatcgataatatggttttttactatattttggagcttcaagtaccttggtctgctaacaatgaaagaaactcctttgtgcaggttgcaaggataattttgttcatgtacttgttttatcagatctttttacattatgatcaggtacatggtaattcttctggattcaatgtacatgatggctatcaaacacatatttctgacttgatacttgttcgcatacagattaagcagatggagacctttggttatcttctggtttgtgttgtgcctgccatactgttcgtgatgaatatgatatggttttccaagatcttaaggggcctcaagaagacactggccaagaggcattgagtggggcaaggggtatgcatgtacagccacgacaaaccacctatctgtaaattcactcagcaggccagcagcctatagcttctcattagtcacgatggctaatcctggtaatatcagcttggccattaagatccagatttatgattgaatgcccagctttttatgcatggatgatatattaatttgtatatatgttccgctatggctgtatgttcttaatacccatcttctttttctcggtataaatgattatatcttagttttaacttaaacaactatttgccccaatttcagtcacattgtcaacacattgctgtaatttgccatcagctttggccatcattcccaagaatagtttgatcatcaacttttagtctccctggactaaactgcctttctttagatctggcttcacaatgatgcccgagtttttaaaacatgtataggctgaagaattttggaatttggaatttggaatcaagaaagttttcaaaaggttatcttttgtagacatgttccatataactctttatattctactgatcctatgtgggttccaacaaggaaagcaaaaagtaagagatggagcctgaaatataacacaatttctagtacaatcaacaaaaccaagtgcctgtaggattaacattccttcaattaactaactcaaacagatgaacaaaaagggtgcaggtgtcacaagtaaatcaaatgatcccatgagataccagctaatgagatgctggggaagtgctccttgcaattcaacttccatcatgtgggatatgtaggacatacaaactgccagaaacattgaagcagttaaatagctccattttaattagtatcacaatatgagtacattagcttatgcacctcccatagtcccttccccttttatttggcaccttcaccatgataataatatttcattatctgcaccattaagtgccttccatcagatagcatatagctcaagcaagtttccaactaagaatgcctttaaatttattttcttgagtacagctttctaaagcttatataagtagtcctaattctcctcttcctgatctatcacacacaatatgcattctttcattcacttgtccattcttctttgcctcctatccacaaccctcatttcctatgcaaaagatagcaaagcccatagcagtgtggtccttggccttagccatgttaggtctctatctgctccatccatggtgataataaactccacaagatttgacttcttggacatcatagaaccagtaacaacatatacagatggctaccttctttccctaaacctgggcatgcccccacaggtttttcaggtgtacttggacacagggagtgacctcacttgggttccttgtggcaccaactccagctaccagtgtttggagtgtggcaatgagcatagcacctccaagccaattccatccttctccccatctcagtcctcttcaaacatgaaggaactatgcggcagccgcttctgtgtcgacatccatagctccgataactcccatgacccctgcgctgcagtgggttgcgccattccttccttcatgagtgatctatgcactagaccctgccctcctttctcctacacctatggtggtggagcactggtccttggctcccttgcaaaggacattgtaacactccatggaagcatatttggcattgccatcctcttggatgtccctggcttctgctttggctgtgttggtagctccataagggagcctattggcattgcagggtttggcaagggcatactctccctgccatcccagctagggtttcttgacaaaggattctctcattgcttcctaggattccggttcgcgaggaacccgaacttcaccagctcgttgatcatgggtgacctcgcgctgtctgcgaaggacgacttcctcttcaccccaatgctgaagagcatcactaacccaaacttctactacattgggctagagggtgtcagcattggagatggtgccgccattgctgctcctcccagcttgagcagcatcgattccgaaggcaatggcgggatgatcgtcgacactgggacgacatacactcacctccctgatccattctacaccgcaatcctatcatcccttgcctctgtcatactctatgaaagatcttacgacctcgagatgaggacggggtttgatctctgcttcaagatcccttgcacacacaccccatgcacacaggatgagctgcctctgataaactttcacttcctcggcgatgtgaagctcacgctgcctaaggacagctgctactacgcggtcaccgcgcccaagaactcggtggtggtgaagtgcttgctgttccagaggatggacaacgatgacgacgacgacgatgttggtggcgcgaataatgggccaggagcagttcttggaagcttccagatgcagaatgttgaggtcgtctacgatatggaggcagggaggattgggtttcagcccaaggattgtgcccttcactcctagtgacgacgtcgttggagaaatctattcgtgatacttttcattctatccctttagcgcacgatcgaacggggtttcaggtgttcttggccatttttatttcagtcgagctgctttgtgtgtgttaatggtacgagtggccgtacgaagtcactagcaaagagaaattgttagtggggagttgatgacgagaaagcaaagggatcacactcatgtaatgcgaaactgccacttctgttttaagttcaaaataaaggcgtgctttatgtgttggaataacggtcgagctagtgtgtacatcacagttgtttcagaagtgtatatgctttcgacgtttgatgatagacggctcaatgtgcaactgataatcaatattttctcccttagcttccggtacgtgatgattcgtgtgcatctgaatatcatcacaccttgtgtttgtgatcatctggttgtatcagacggcttacggaagatatgttctgctgttggattgggttggggtcttggggaatggatgctgagtgccactctgtgtttgtttcactatcctaatgtgttccgtttagttctctgtcttccacgtgacgatcaatgtttttctcccttagcttttgttcggtgattcgtgtgtatgtcaagtatacgcctatcccggtgtgaactttgggattcaaaaccctgtgtctcaacctgaacaccagcaagtcgttgtagtatagtggtgagtattcccgcctgtcacgcgggtgacccgggttcgatccccggcaacggcgaactgttttttttttagcctccgtgcagaacgaacggcagaaacgtgtctctaccagtctaccttcgccgcgggtaaagactgccagtagtagagttgtcttgcccgtggcgtgtgggtgagtccgcgttccgtaatccgtgggtgcccctcgtcgtcgtcggcacgtcgggaactagcgaatcgctgtgcgcgagggccacgcgaaccgtgtgcgtgcgtgttgcgtggtgctgtgcatgcgcgcggcgcggaggtatgtgggggtgggtgggagaagggcgggggcgggcatgggcatttggcagacagcgcgtgcgtgccgcgcaacagaggggtcgttggcggcgggcccgcgctttcttcccacgacccacaacctgagtgcgctgccgctgctgggagcctggcctaacatacatatgctttgtgcaagggtgcccggtggcactgtggcggcgccagtacagtcgttagtcgacacccttggctactgatgacgcgcgaggtggggtcgttgcgggatgacaccggaccggacatcccccatagcaacgataaccctggtggtatacgtactctctccgtttaaaaaaaaacaacgggatttgatccctcctaatataacgaaaatgtttttttataaagggagtatactggtatgtatctttccgaacttatcatagcgctttttttttctcttctttagcttctttagagtgcgtttggttccaagctatactttaccatcatttgtttttttaataatggaatataatatctcggcttttactcaaaagagctacaaccaattattacatagtagctttcaagaacatagtgtaactctaaatgaatagaacataccgaagagaaaaacaaagaaaccagcctaacgtaaggagatcacaattattaaagtctatttgtaaatctccaaccataattggtaaaaagttgcataaccttagtctccaactttcggcatgcaacattcagaaactcttcatcttcatcacacctttgtagttgtgcccaaaatcgaagccaatgagttgccctgaaaatgacctgcatataaaaaaatgatggtgatttgtcaaaaaccatatcgtttctactcagccatattaacatcatttgttaataaatattatcacactcacttaaggtgattaaatttttttatcacacttcaacaagtttaagggaatcttgtcacagagtcatagatgtgtgggacttagcttattggaagagtctcttgtcacagttgtagctacaactaacaactggcaagataatcaaacttgtctaactttaagtgtagcaaactgtaataaaatatggcttgtaaccgaacactccccaatagtgtcttgccttcaagcaccaagcttcacttcactgcagtgattggcttaattgctcagtccggtcagccagctctcgtgcgtggatcggaggaagctcgtgatgcgggaagaagcaccgccggagatgagccagcggctcctccttgccatccatcgcacatttgcgcgcgttgctcgatatttgggtgattttcacgattagctaccttgttaattacactatgcttttgttgtccgtgaaccctttgttctagtgccatgctaagagcatgccaatacttccccaccttagtgttggactacacaaactttttccccctgcttggtcaataatttgttacatattataccaaaataaaaatgatatgttagatatgccaagtctgtgcttgtttggatattggagataatgatgccttgcagtcttgcacgtatactgctactccctcttgatattccacgatcggactgacaggacaacgttatggtttagtagaggttttgccaattgccgtacatggggaaaataagaatgtattgccttattcaagaaatgaagcacctaagtcgttgtagtatagtggtgagtattcccgcctgtcacgcgggtgacccgggttcgatccccggcaacggcgaactctttttttttttttttggctcttgtagagctcagggcctcaggctctccgttcaacggagggagtatgatctaacctctttttagtagcagaaaaactataaatcgaaaattatcgtataacaaagaaattagtgatatctagtagagcctctcgtaggcaaaattgctatcgcaaattcgcagctacaccagtgaaggcaataacaaagaaattaacagtatacaatacagtccaaaaaagttgagctctttgatttgccgtttactaattcagtgtcattgtacagttcgaacacgtaccatcgaacttattaatataccttagtgctcccattggccaattgatatacatcgaactggaacagtttttccctgtgccattcaaatgttttggcagacggagattggttttatcgcagtaatggaacgcatgcactatcaatctatccatatagtttcatatcatggtgaaaaatggtggcgtgaattggatcatccgtattgtccgtctccaaatctgataggcatcaccatagaatgactgaaatttgatctatagccagtaagcctgtgccaaccgttccaaacagagtatctccacctcactggtgtttttgagcttttgatcgagatgcattcttcctcatcgtccaaaatgctgcgcggtaccgattctgcaactcaacaacagtataaataagaccattattaccaaatatcaagaagattggcaaaatgcacaaacaattcatgggtattgaactagtgatgttagacgtccaacagaattcagtacagctgaaatctcaagtattggaagctggcagctttgaaatattgcatactagcattgtgaacatccgctgagagtactgagtcaggcagaggcagagccctcgctgggaccaaagagggcattggtctcccctttcttagcaaaaaagagcatttaactgctcgaatagtcagatgcaggttgaactggtcctgtgtcgtagtaattctgtaaattgtatcctttagattggcctttcatgtattttggctcacgctccaccactaactgatacattcaacaactgaatttggacaactagtctcctagcactcctaatacacctgttgaatttactatgcaacagttgaacactatatgagcctacaagggattgaggaacaagtggacatctagaagtccaaatgaccaagtttccaactgcagcaaacaggactatcacctttaagctttcactgtgccattctaaatatttgccataaattcaatcacttcctagatatttgaagattaaaccacagtgaagactgttgagattaaaagattacctgcatcattgatttcatatttgcagtgtatgtggtatctatcattttctccacctgaaaaccacaaatcaaagtaatccattcacatatttttgcagtgaggtgatgcactttctgtctaatcataacccttcactcttttttttttacaacaatgcatatatataataaacatgtattgcacttttttttgcaagatacaagtgtacaaatccaacgtattggtgcactatgcatatgcatatgcatagtttggagtttcctcaattatagcccaaaacttttttttttttgcaaaacactcacctccatcacaaatccataatggtaagcaactcttttcacatcttccaaactcagttcaatagacatatcctgtgtttaaggagataaattaagttcctcaagacatagtagcaccttcaaggattcaattagcatagcattcattcatttaactagtataataaggggagagaactaattacatcatctggtccataggagtcagcgaagtgatacagaagcggacccaaatttatccagacctgttggttgaaattgcataattatcaatgacagataagaaacagtaaataaacaacatataccgaattataaatttccccgtaaactgactcaaaaaaacattagcactgattcatcaagaatagtttatcagagtttaatcctataaaaagagactcaccccaccatccttgagaacttttgatatgatctctatatattcaacgatattgtgtgccgtatccaagaagaagcatgttacaacagcatcccatgaagctggagcaaaatatgagtattgtgagaatgtcaagaaggcaaaaaacccgtagttaccaatcatacatatctgaactaaaagcagaacaaattaacacatcaaggtcagaattaaagtattagacttcaaaatgacttcaaccaataatcatcagtttcagagttattgcattgcatgcctcaatagcctacaatattaatttgaggagctcattccttctccataatacataaaatcaaggacctggcttgcaactgcctcctacttcatttctaagaaaatgcctatcgtttgcaatttagtttttgacgaacgttaaagcaatactctcaccttgatttatttaatgagcattacaaaataaatccaagcaagctaacaaatgaacaataacagtaattaatatccccccttaaaaaatgtacttcgtatgtatgacaagaaacaagaccaccacaaaagaacaactcttttcccttgttggccatgatttaaaatcgaaacaatctgacagaaacaaaaccagcacaaaattgtcctctttttctggggttccatcagaacacatccattctcattgtgaattggttctgtacaattgtcactctatttatatatgctttagactaaccccaatgcaaaaaatctgttcgaaacgtatctgtgtttttgaattgttatttaatcccaccgcttccagtttctggcatgctttcattgggccacacaagattcaaagggcaaatggtactacaatattacaatttaacaaaaagagctaagttgagtgatgcatatccctttataaggaagccaggttaaaattaattaactcattttgattagtttataaggaaaccaggtcatcttacattcttggctttcttcattgtagacctctacaaaatcaccagcacacatagaaaatccttctgtgatccctgagctgtcaaaagaaaagaaggcaaacataagataaatatgtagcataacaagagataacggacagtttctctccttttgcaaggaacataagtaaacatttctacctacagcacaaatagtactgaatgactgaaacaagctgaagcatcaaacttgaattctagaattgaatgaagtttagattcaggattcaaacgaaactgcacaattaactaatcattcaaatattacaacatccaaacatagaatatttgtaggttctgcaaatagtccagatttaaatagggtgtttcaatttctctaatcaaatgctcttacatagccatttttgttgatttcatatgaagctcttgtaaatatagaatcataaatggtaaattacctataaatgtaatcaatatatttatgttttcatcaaccgtgacgtcctatatgcacattatattatacaaaactaaggtcatacgctatcaagtgtacagagcgatgaattttaacacagcatttgcaagcatactggtgcttatgagaaaaaacaaggtgctttattaccttgaggggtgaatatcaggaaatgaaacagggcgaagttgatcattgtctgaaagagaattgcagttgctgtgtatccaaggatatatagtccactcattggtttcttgcgtgctgataaaacatgaccaaatattattgtgtgatgaacaacttgataatgtaaggtgctagttttttttttaaaaaaaatatgtatagcttagattgacctactggtttagaatgaaacttgaacaaatcatcatgtaatacgagaactcgtttccctggctcacaaaacctgttcaagagttaaaacaagggtaattttcaagaatatatgatatcagctcattcacaatttatttgagctttttttcttttacccagagtggatatctccagagccaatctcccaagcccagcaccaggaactaagcatgaaggaggcctatgaagttcaacaaatacacaagtcaatgattgatcaagaatgaagcttcaagcaacttccatttgtatatgaggttaaaggaaatgcttgcataaactatccacagtaaatgtgtggtgtgagaggggacgagatgtcctaatatttatccaattcagaatcacagggcatgggcatggcaggcggccatagccgcagcggtttttctttcatcacagcccctcgcatcgtgtatagccatggaatggaaggcaagtcgttcgaaaacagcaggtaggaagcatcaggtgggcccactggtcggacggcaggggcgagtggtgaacagcggaggaaagtcgctgcagctgaggaaagcgtgtggtaaacagctgcgccggcccacaccacagtgagacgtggtaaaaatgaggatgacgtggataacagcgggatcaaacacgccatgctgaagtcacgtgaatcgctctcgtgcgagaagaatgcccttgtctttaattaccccgattttgaaaacaagatcactacccagaacaaggtaaaaaagtatggtagttctaaattattgtcataacacagggataagtcaagtttacctctccttgcttcggttaggaaatagacgattaagctcctccaggatgggcttatagcactcatcacgttccttttgaccctacaacaatttaagtaacaaaaggtaatatttcctttcggattatatcattactttcagacagaagttccacttcaagccaacccaaaattgcacagaaaatacctcctgagcccaatccctgacaatatttcttatgatgcatctaacctgaataaaccagaataaaatggattatagaagctataaaccagacagcatccaaaaacatgcaagctgaaaaacatgtaaaatgtaggcaaaggtgcaagaaactacatcagcaaaatatagcatgattgagcacttcccattatgaggccaaggggaaaaaaatgacaggaaaaattaacatatgatagaaatcagtaacaccacatatcaggaaagatgccagctttggtaacaaggccaaggtgcaagaaactacacacatgcatacaacatcagcaaaatatggcatgattgagcacttgctattaagaagttaaagggaaaaaagaaaaatcagcatataatgaaaatcagtaacatccccatatcagaaaagatgtcagctttggtaacaactgtggcggtcaaccaacatgaacctttggctatcttcttgacgcattgcagtatgctttctgttcgaaatgtgtcaaatgagaagttgatagaaacacttaccttgtcaacatcaattggaggaacattcaactgcaaggatggagccatgaattgctgcggtatcacctaaaataagataacaagaattaaatagttcacatttatttatacatatcgttatctccttaaaagtatgagaagaacagataaacagagaaaaatcaatgcttgttagactgaaaattatgtgtaaatattgtgtgatgtactttttttctcaaaaacacaggagggttgcatttcatttcattaagaaggaagaaaacacttattgcattctgccctttattgcaaccagaagataaccgaacgaacagctagagatagcgaagaacaaatgcattctgccatttattgcaaccagaagataacaagaatgccacatccatgtattactcctttagattcatagtgataaaattcaagcatgaaagctaaactatgttctgcatcatgcaattataaattataaggaatacacaacagcttacatcttgcaggtggagcttacattctcatcagcagaacatgcaacacaatctgtatcttgacagttagctgctgcatccatggctttatcaccattacatgatttatcttcaacctgagatgcccccaatttgtcaccaaccggccgggagcaactttccatgtcaactacctcgtcctgtttgatacttacatcagtcaaaacgtgtgatatcaccaattttgtactccctccaggctgataatacttgtcgttttagataagggtgaggtcaaactttagaatctttgattatgaatcatttttaaaatatttgtctttcaaatatggtgactacatgtatagattagtcttgaaaagtactttaataaaatcatatatttattaacacttttatacatattataatagaaaataatggtcaaagttgttttttggagaccgtgtccttgtccaaaacgacaagtattatcaacccggagggagtagtgtatatggcttcaacatggaagcagccattatttttaaaattgaacaaaaaggatcaagacaagacataaggcctaccttgttgtcagtttctcttgagagttcatgagtcttgtcgtctttcctggggcaaccgtctggttcatgcaactcggaattgcttacagagatagaacttctaaagcaatcacccctatcgacagaatgagcacaatctgcatgacaatgtccatgcatgttctctgcgcaatcatgaccatccatatctacatgctgactcatgtcgaaaggaggctcaaatgcctgcagtaatataccttttaaggatagcatcatgtacattaaagttttcacctaacgtacaatcttcccaccccgacaacccaaaccacatatacacaataacacaaacatacctcaagcatgtccatgatgaatgatgcattcatggatatacacctgtgaagtaataaacaattacaaaacaataataaagtccatcacagtaagcaaaaggagtggccataactagtttaagcagcatgcattgatttttcagaaaaatccggcggagaatttaagatagaacatcattggtagaactaaaaaatgttgactaaataaataaagtacagtgcatcagatatacaaaatgctttagatgatttcaaacatgacaaatagatctactgcaaaactgtatttcacaatatttaagcacaagcagtggaactaataagtattggccactactacaagcattaagcccataacattacttaccatctcagcctttggtacttcagaccaaggttaaaaagaagttcctacacaagaaaagacataagatatgtgaatgaacatacagagtaagataacctattacaagtcaaaatgaaatccaaaagtgattagccaagaggaagtggtggttgaatataaaaaggtaaaacgggtatggtgactcaaatacaaaccttgtgggcaggaggaagccttttgaatgatcgctcatatctcttgacatccctttctgcagcatcgtggtagctatcacaatagccatacaaaatattattatttaattagaaaaacactaatataagttaaatggttcccatgtagctatgttccacatacaccatttcacatttagattttccataccaataaatgttcaaattcagaagccattgtattgcctgcattcttttcttatactccctccgtttcaaaatgtttgacaccgttgactttttagtacgtgtttgaccattcgtcttattcaaaaaatttaagtaattatttattcttttcgtatcatttgattcattgttaaatatactttcatgtacacatatagttttacatatttcacaaatttttttaataagacgaacggtcaaacacgtactaataagtcaacagtgccaaacattttgaaacggagggagtaagtcatttcaacactggcacagtcttcgctacacttgttttgtccccatggcccccaccttttccaattgtgttcatatgttggacgaaaatttcaaaatacaattttatgttagaagttttgaaggtaaatctacccataccattgccatgtaccaagtcctaactattttagagtgtactagggcaatagcactgcgtcccggctcatcaaggagcccaagcatccacatagggaaaaagtaaatgaggctccatctctcccagtacgcatagctttagatggggtccaccattaattttttttcaggcaggccccaccacaaaaaatcgtcatttcctccttcggagaaaaatcgcttgcacctcccattttccgccgctccttccccatctctctctctctcctctccctcaatcggctcccatggcgccaaacccccaccctcctcttcgtcctctcccacggcggcgcacggcgacgactcctccgcccccctcctctcccacgggggcgcacagcggcgactcccccaccccctcctctcccaccggcggcacagatctggctccccctccccattccccaaacaccgccggcgccgcttgggagaaggcggtggtggaagcagctcgacagcatcgggcacctctcccctccctctccggcctcctccctcggctaccccaagcccaagcagcggcggcggcatccccgagcccacgcagtggcagcgagctccctgagcgcccctactccggcgaacttctctcttcactcttcagtcatccaccgttcttctcctttctcactctcgctcttactttcttgttacgcgtggaggagcattttttctgacaaagttgctgcgaggttcttgtgaccaactctgatcacgcgaagctggtgagggaacagtctccactcccctctctcctccacacaagcgatttgcctacgtggaccaacattgccatacgccacgtgtgtgcactgtgaatggccttagtggtaaatgttttcaaatgttaactgcaagcgttctaaagaagataggtaaaacatagggagtacttctgcaatatcaatgctaaaacttgaaaagaaaacaagatttgacaaaagtacaagtgttgatgcaataatactttgattatggaatttctaaataaaaaatagcaattccaggagatatcacttgctcacatcacatatagtaacttttaagggtcacgcctatgagttggtttatcaagattttcgtaaagacttcaacggggaaaaaagaaatgttctctcactccaatcaacaacgttcatagcatggttgtagtgtagaactccccaagtcccaacgaagcctaccgcccttcgcggatgggtaatccccgtaaccacagatcaactctatccagaacctcacaccaccctcgaatcggcgactactcctaaaccctacaactgagaaacaacaccaactcgaactaagttgtaacccacacacacccccacaagcctcggaacaaagcggggggagcctgtagaacggagctacgcgcctctacgcgaccaaccaaccgccgccccggcgagcaaggagagtggcgtggcagacgagacgagctgggaggggaggggagggggacgggatgggggttgacgtacttggcgtaggcggcgatgatgcggcggagtgagctgatctcgagcgcctcctcctgctcggtgtaccgccgttcggccatcctccccggcggcggcggcggcgaggcggaggagcgcagctttctccagatgaattggtgggcctccgaatgatgggtcgcgtctcgcgtcgcgtgggggaggtctttgcttcagttatgctcaggggcaaagcccactaggaattttgccgggtgaaccaagccaatatggaaaagaagaaatggaatttcataactcaaatattcgtctcagaaattaactactcctatgatgataagtctcatcggtaagcgatgatattaactactcctatcacatcaaactaagcatggatcatcatattttgatatttatatgctggcctaaactcttgaagatcttcatagaaatagagttcatggatttggatttgaaaggatgagtgcgcatgtgtataaaagagtttgcatttgcaatgtgttttgaaggggaaaaaaaggatagatcatcccattgtttcatatcataagacttgtcttgagttaaaattttttagtttgaccaagttcataacaacatagcaacatgccaacatctaacattaaaaaatccacaattaattataattttgaagtatattttcttgtgttgaaaatgctgaaacattttaaacttgaatttgacttggcacaaaccgatggagtagcttcatccgatttatatactatgaaacatattgacacagcgatttatatatctcgatcttcatttcgccctattttagtataaaatataggttgcaggtttatatctatttgatttttgtagacgcatataaagctaacacgaacacacgatgcaccgagaacgatatgtatggcttttccgatgagatgaaacactatatacgctgctaaccatcgaacgatgttacttgatacggtctgtgacgaccatttcagttagtactccttccgttttaagtttttgtttgtattgtttgaccactcgtcttattcaaaaaatttgtgcaaatataaaaaaaaaaagttatgcttaaagtactttgaataataaagtaagtaaaaaaataaataataattctaaaattttttgaataagacaagtggttaaacagtgtaggtaaaaactcaaaatccctttatattatgggacggagggagtatgttacaagctaattaagagccctgggaaggcagaacaaaagaggggtgaatttaattgcaatacacatgcccgtcagaaatggtagcaagtatacactagctgtaacctgagacccatcatcaccgaagctgtaacccaaacacacggcgaaccaaacaaacatcgccgcgtacagcaaacaccactctttggacagaggagggatttttgtatgaagaatttgagaagagaaagcatcggttagaatttacaaagcttggacgggaaacaagatcaaaaggaaccaatttttttcttgttttaattatctgtgttttacttttgaaaacctccttatcctatttatgtcgaggttggtattgttctggtggaatggtggagtgagatgaaggttgcccctccttatggggcaacatatttaagaaacttccttgaacaggctcatcttcatccatgctctctgttttaaggataaaagcaagttaaacatatcatgaaaaacggtacatggtgtataaggaaccaataggtaataatagtgctcaataccaaataatgtcttgatagttggccgctttgacttggaactcttcttcttcaactcagctgttccataagcacaacattttttttcaaacaaaagacactaaaaatgcataatctaaagaaaggcatcatcatttacaatttcattagagagagagagagagtgctaaccaattcctgcaacctcatcatcatttacaatttcaaaattcttatatgtatagccaacaaagtttgcatccttggacggaagcatctgcaaaaatagcagtgctcttcgttttagttcattggctaagaggcaatacgaaaatgaaacatctctaattaagcatgttaatttctgcctcctaaaagcaatagttggaaattttggaaatgttcctaatacatactagttttttatatatttttatggctacagactagctagcagtgaatcacaagcttcatgcccatggtccatcactagtcaagctatgtatgttccctatctacattctacagatagcagaaaatagagtcgcacaggcgacacacgtgctgccgtaaagtatatatgatataacagttgtttgaccaacacatatgcagcttcattattaggaatgtgtttccaactactcagtaattagcatttcatggtgaagtcacacatacctttctccatggacctgacttagatgaactttgaatttgtgctccggtctgcaaaatagtaagaaaggtaagtacaggtgtcataacttcagctttctatacagtttaccaaaatagcatactcgtagttttaggtttcactctcaaaagaccagaaataaacatgttaccatggagacgatgtaaaacgtggctaagttgtcatgcatattagaaaatcataatgctaaatgcagcaaggtttaagatcacaacctaataaaacaaggtgaaacgaaatccctcctcaaattatcacatgaatcagaccaatgggaaaacgactgaaatttacctcctcaaatttctcaaaattctgagtatccaactcgctgttaacttctggtatgaaagcagctttcatctgatacaatctttcccatgggagacctctaaaccatggatgtgcctaaagtagagcatatgacgataataattaagcacacagttgagagcaataaagatattgtacatatagaagagagcgcacttttatctcatgggctccttttgttccaagtctctgctcaacattacatagaagtttgctgatgagatccttagcttcaggagaaagctttgcctcttcagggaatttcaagtgacttctccagtttacaatctgcaaatgaagaatagaaaataaaattggatgaaacacatgctcatgaagctacatgagtatttcctgtactggagtaaacaagcttagctgaaagcattgggaaatacagccttccacaaaattttcccactatagggcacttcataaggaaaaaccaaggtcatgcgtgattattggagtccacaaactgtataggctgagctccgaggaccagttgctaccatcatcatctagccactgacccacataataatttgattacatgcaggtcactagtacattactatggcaaatactgcattctgctgtgttgattgtgcgataaaatttggcataaggttgtcttcttgcaagttgggtgaggtttgcttagactgaatatagaaaattccaaacaattaccctctagataacaaattaaaaaaaactgtgggcaaagtacatgcctttctgcaggttgacattggatcctccgaatagaatggaggataaccaacaagcatttcatacataattgcaccaagggaccacctaagatcaaaataaaatgtgagaacaagaacgaagcacatggatgaggaaaaataacatgacttaacaattatggacaattacaagataagagactaaccagtcacattccattccatatcctttcttcagcagaacctctggagcaatgtaatcaggagtaccaaccgttgaatatgcctgcatgccaaaaaaaaaagagtataactaagcatactaccatatattgatgagagcctagaaaactagactcatgtacatattcacttgccaacgtggcaaaacgtagtcagagagcaaaatgtgaaaaattcaagataaacgttaaatgatttttcatataataaataccaagtttcatcaacagctaaataatgcatgatttacacaatccactaaaactttgaagcttagagcatgaaattttttatttccttggaatcgtgcactgtaacactgcacattgtacacaaatgcctgaattaagtctgtccaggaatagcatcatttatgcttctgcacgcaaatattctttattcagaaatattcaatgttcaccgactctaaaaaccttgtcttgaggaagcacaaatgaatcttgaaaatccatcgtagcaaaataattttcatgtggttttatgccaggtaaaagaccaaagtattattagcccagatgttcaaacaaaagctcacaactagtgtgaatttactataaaaactattaaatgcatcaacttgatgtgggcatgtggcatcaggcatcacaacattggcaaggttctatcaaatatcaattagttgattcagtttcagatatgctacttaccagcattcgtcggttcttttgccaatgcgacaattgctcctgctgtgtgcgctttagagcagaagagcttaaccggctgctactatcaggtaaaggcttggtgccctttgtagatgtataatctggctcattcaaatttggaaaattactgctatccaaaggtttacacaatccaaagtcagaaagcttcaagtgaccactgcgatctaacaatagattgtctggtttgatatccctgaaaaaaaaacaccaaggttatctttggaatcatcaaatttcttaccaaaacttgggaacacttatttgataccggtgaatgtagctgtgcttgtgaatagattctattgctaatacggtttctgcaatgtaaaatctggcctcatcttctgtcagtgtgtccttgcgcataagcaaagtcatcatgtcaccaccaggaaggtactccatgatgagatacaagtattcttcatcttgaaaagaatagtagagcttgactataaaagcactatcaacttctgcaagaaggtttctttcagctttgacatgctcaacctgaaatttgtacaaccatgtcaaagcatacgtgtaaatcagaaatagaaactacaaaataatgcagccagaccatacatggtacctggcccctacgaagcatctcagatttcttaagctttttcattgcatatacattcttagacgccttctctctacaaagacgcacctgcataattacaatttacagtgacatcaagagcgatgcacatttaaatggcctcaaaagtaagtacatataattgatgacgattagatatagtagtttcagaactgcatagatctaccacactaagcaaatagacatatttatactattctcttgttgaaaaggaagaaacataagaatcttctatttaaaaagggttaaatctggaataaaaataataaatacaaagtcttgttggacactaagcacatgccttttttatttgtcttaagtttaatggtagattataggcataaaaagacatgaccctatttctcactcaaataaatttatgtggaagacactgaagattgacgaggcagggcataaaagtctagaccaggtttcatctagacttgaggagggattacatgtttcttttctctcgaatacacaagaaaggagggattacatgtagacttgagcctatgataaagtggtatactatattaggtccttaagcagaacataagctgggaaaatcagagttccttgacttccttccttttattttccttttacaatatgtatcgggagaatgattagaattcagaagacaaatgaatggcctaggaccacttgacgaattgaatgccatcattacaggggaccaaagtgtgacccatcaggaaaccagatataacaaataaactaaaaaaactcacattttccctttttcatgaaagcagccctttttcaaacaattaaaaaaactcccattttccccattttttttcagtcagaacacttccatgttaaatggcatcatgcaaaaaggagcagcaaggcagcacatttttctaagcataaaagagatccaaatttatactacagacattgcataagcaaaaaatggcaagtcgaccatgattctaactgaacctactgttaacaggatgtaaatagaaggccacaaagaaatcttagcacatctagtgttcttgtgctccaaaagaaatttgctaaggtcctgtgtatggaattgagatcagaagtacctcgccaaatgcacctcttccaataattgtcaaaagttcaaaatcttcaacccccatcttatgtctctgcaaccgcatatattcggtctcctttttctccaaatgctttagaatattattttgctcttctacaggaacctctgcatcctgtagtttcctctccaacatccagcgcctaaaagcaaatgaacacatcagagaggactggcaacaaaatgtcatccattgaatgggcataaaaggaagtgaattacccataataggaacaaagcaggttgatatgattttctagtgatgcaaaaagaagtaatagtgcgcaaagacaataagaaattcaaattgagtatgagcagaaaaagctcatcatggattattaaaataaactgttagagcataaaaatcaaaagcggtggcgtcaaaatcaaaaaccctgaaaaggggaaagcaaccaaaatgggtatacccacacaaattgcgtgagttcaatgaaccatttaaaagtcatgtgcgagttacagcttttacaacgtgtgcgagatacaatcttcagaattgagtttttcaagttgggtggtgcaaggctattaaagggattcataaagattcatggaaggggctgaattctttgatcattttagtagcttgggaggtttggaagcatcgcaatgattgtgtgttcaatgaggcctctcccaatgtcacagtggttttgcaagcggtgtcaaatgagagtagcctatggtgcttaactggggctcgtgcgcttcaggagtttctttctaagatatttgcgccgaacgcctaggtagtctaggaggggtttttttttctgggttcagcatcacctcggtgtgatgtgttttgggcttgttgcgacttgcggggctttttggcccctcctttgtatatatgtttctctcttaatgaaatgaaatgcaactgtccagcgtttttgagaaaaagaagccgcttgtgtaaccctacaagataaccaatatactcctttcagtcgcatcaagcatcactttggataaggcaaataaactcatatcactttcaaataactaatttaaatattgatgaatatattttcttttctaaattaaatttgtttggctgaacaaatctactaggacaacatttatttgttactaacacgagcgctagtcaggaaagctacccaatcaatcaagcttcctttttttggcagtgtcaagggcacacatgcacacacacgcgcaatcttgttcaattacccagaaatgtatttaccattgaaatcacaacctacaaagtgtgatatgtgttgtcaggtgccctaccaaacaacaacaaaaggtggcctttgctggtctaatttctcttctttgtatggtacagtacaacggtaataacaaattccgttacatatacgcaaaatgccaaaaatatatttttgcgagaaatacaaccaggcaaaagtagcaagaaatataattatgtcgcctacctttctttcctatcttgcagggacttcatctgggtcttgtaatgattctcaatgtactgttttgccgcggcaaccctctgttttgttgcactagatggcgcgtcatcaattggtggctttcctggatcctttccatgactggcagccaccgctggactcttcgatttgtccctcggctggaacttctggaaccaacttctcgcggaatccatttccactcacaatggcatcatctccgaaaccaacggttttcttatattgaccaatccagcagccaactgcaggcactctgaaacggtcaatccaactaacaattggatcagatatccaaattggcaattctccgtggaacccaatgctgggaacgatgcctctatctgaaatttgaggagataaatattctcaatcagaatcgttacacccagttgccatctgtcacacgactgaatgaaaattcaaataaaatattcacaagttacaagttcctgccatgttttgccccgccatatatgaacctactccatacttgaaatcaaaccacgcctactccatgtttgaaattaaaccatggtgagagctcgaactatatcccatcgaaaggggtagctagaacactgcttacgattgagggagaacacctcaagatctcaatttccaagcgaaacaaaatctcgagagaaaaaaaaaactctccggcaccggaagtagcagaattcgatccagaaatcacattgcctccacccgggagacccccagaaaccacccacgaaaagcagcaccagaaaccccccatcgcctcacaaacgcccccaaccccccaactcccaaagctcacaaccacgcgccacagcgacgagtcaccaattcgccaccggaatcccaccaagccgcaatccacacacacacacacacacacccctccctcccctgagcacacagccgcagctcatcccaaagtcccctccactgcacccccgctccaaacaaacaaaaaaaaccttacacaccgcagacagcgaaaccaccggccggagccgcgtcgtccggggaagcgcgcgctcacctcggcggcggcgggaggcaacgcggagcggatctcgggcgggcgacgaggcggcggggcggggggcggcgattggagcaggcaaaagtggggaacgaacgaactgccttaattttattttttttcctcctcctcctctttctctctctactctgctacgactcgccgggttgggttgtcttttcgtgggcaaagcaggcagcgggcagcaaaaggcaaagcgtgtgagagaaaagaaaagagagaagggaagggaagaggagtggagagaggcgtagtagagagaggctttggggctttggcttggctttgactcgccggaacgaaacttcgtgctgccttccctctctcctcctcctccgcctcgcgtctcccggcccccacctgccgcgcacaacgcgacctcccagctataaaatcacgcccgtccatttcgccccccgcccccgcgctttgtaaactttgttttattcagtgttgtggaagatagaatacggacgtgggacgaagaaggtaccgccaaatgattagttgttatgcggacgattaattagaatttgacgaaaatttgacgttttgtaaaaggacaaagttgataatagcttgccaattttttaggtaaatgtatgaaactacaaatattgaacatattactatattagaatagagcaagcgtgacatggcattaactcaacatatattaaagttcataatccattccatagttgtgcatgaaacagtgagatttaggctgggatagatttggatgggcaaacaacgtacggccaactatgggtcaggatagttgtgtgatcatgcccgattatacggatgatgattagttaaaaacggacgatttatcggtaattacgttgattacgcgttcaggacaaccaagaagaccgtttcgtgaaaacgtgacgggcagcttgccgcatacgttttaacgggcgtataaacggccgtatcaaccgttttccacaacactggttttattgttaatgtattttttaaacacgatgttcatataaatgcatgcatactcatcattacaaacgtacacattgtataacttgttcatataaacatctccgaagactatgtcgataaatatatactggtacttccgaatttaaatatacgatacaatccaattttgcttctataactttgattattatttttattctgaatataatagaggggtaattgcaaaagtacctatgaagaaaattctgtgcatataattttatgtagaagtacctctaaacagaaaaccaccatggttttaagtgtcattggtggtttaaattttaaaagtttgatgggataaaattatcagtgccccatatatttaaatacgaaaggagtacatctttagtccctagacatccatatcactatcacatgtatacatccgtcgttacctcttggagtatttgggcgtttgattagtgacaaatccacagcctacctagtaccctatattactggtaaaagaatatgtgaaagtgtgtatatttgtatgtaatatttgtagatattagagcttattatacatattggcgctcacggatgctcccatttttgctttgagaggacatgagaaaataaatacccttgcccctgcagtttgcaggctggagttgttgagaagaaatcaagtaatgctccagggttttgacaattgctgcgtttgacatgagagcaattgttaatgcgacgtgaggtacaaaagataatggctttgttaatcgaactcccgtttaataatggttcggaccgtgttaataattgttgatcaagttcaggtagataagactgcggtttaggacagaaagtatattgatgatgtgtcaggtttgcttctagctggccaaatgcaatttctttctgatactaaaagccacgtaattacaacttttattgaactacacttatctggttaagttaacctaaccccagcattataggaccaaactactactcccaactgaagtatcaccagggacatgtccttatgccttgttcctatgtccccaagagaatatatccttcctgcggttttggtagcaaccacaacacttgccaaagagcagagctaagctagcatatcccaaaaggcgcttttattctcaccaccattggtgcctgaaccacatgagcttgacagtgacacacatgttctgaatcttaacaacctgaatgtgtgatgtggaagctctaaaccgtgcagactcacagtcccaccatttcacctatgccgatgcttattcatacggcttattagcaaccaaaataatatattcacgttctccgtgattcaaatgcaaatgatgtcacaaattcagcttaaaaattaggtttcaaaattcaaattttggcatataagcacaaacgaaataataggggccaaagtgcaatgaaaaaggatcacagcttgagatagattattcatcggattattttgatatacaaaattaataaacatctagcaatgtagagcaaataattcgcgacagttattctgtgaagtagctgaaaagatatggaattggagtaattaaccacctgtacttatgtaccatgatggttaccattgagctttctttcaccgaccattggggagcaggtacacccaccgcagcgtgtacccgatgatggtatggctgaaggctgaagctgcacatttcttcaagccaaattctcaaatagaggcgtatagcatattggaatacccaaaagtcaagccatgatccggtcatcgtccggactccttcattttggacaaagaaaaatggctccgtttctaccatcattggcgtgtgtattgattcttggttaacagattaaaccgtgattagttggacattgtcaaaggggaaaatgattgtgttgctctagattcagatatggatgtcatttagataagaacaataccaagaagatatagatggacattgtaagagatggaagccatttggcttgtccagtagtctagattgggggcatgaagaaagttattcaggagagggttttaccttgtctgatcacatatgaggtaccgctgattccaagataaaaagctcaacttcgtggcaatagtttttaagataaggagaatgattacatcccaacatatgtatggcgaaagtttgaatagcttacatcccaacatatgtatcccaacatatggctcgtttaatttgttaaaaaaacatctactaaattttggtagggcaatgaactaaataagactttacaatcacaagcttaccaatctctatcaatatttagtaattatagtcacgaacatattgacaaaaaaaaaaggcaccgaataagccttaagtgatcttggactgtatgtttattgccaaagtactaggctcctcttcagataaaaaataatgtcctcaaaaaactttttttctattgtattacttataagatttgttttaagctatttgttaagtttattttttaaaacctttaatctatccctatgatcacatggataatctgtcgtaataatatgcttaataatctaatcaaatggtacattagtctcccaattcaaagtttaaactcaaaagacgtttagttttgcataattatgaccatagttcatttatttcaatgataaacctgaatgatcgagaaaatgacatagaaacacacgagaaatatcaatacgtatatatggctgtcccgacgagttatcaatatataagaacactcatattgatatttatttatttatttgcgaggaaaaacagccatatttatgtgaaaacattgataaaatcaatactgtaaaatgccttggtgaaaataacaagactaagctaaaatttcacaaatatcatcagccagaagcccacaactcataggtttcatttgcctgtgctcccatctcaactcaaaatgctaaacgttgtattttttaaaatattcctttcttaaaaaatcatattaatcaatttttaaagttagttttagctaacacttaattaatattaatgtgctaatgagctgttccgttatttgtgccggagagggttcccaaccaacgcaaataaacgcagccgtagcagtacacatttcgtttcaataggaacaaaatttaaatacaacaaaactgcacattgaaacagttccccactaataaatactgtaggatttaaacaagtgaccccgactgtgcacttgttccgctgccccaccagtcgccgtcgtcacggcgtcacctgtgcaccataactggcgggggctttgggtgccatccccgtctcccgtaaattcaccatcctacccacgcagtccacgtttcccagcccccaaatcccaggggcaaaatcgtaaaaccacactccgtcttcctccactgggaaccccgtctcctccgcggcctacactgcgcagcgcagcaatggcggcctactgctctagggtttaccaccaccacccggtctcgccttccacaatgcagggatcgctcgcgaggccttcgatccacgcgggatccgcaagcctgaccttccgtgctcggcccaattccgtgtccatcgtgcgatgcgacgcggactcgccgccggagggaagtgctgtggcgggatgggcgcctccggggccgtacacggggagggacccggcggcgaggaagccggcgtggctgagacagcgtgcggcgcagggggagaagtacgcgaggctgagggagtcgctcggggagctcaagctcaacaccgtctgcgtcgaggcccaatgccccaacatcggtgaggtaaaatagaatcaaacatgtaaaaatcttaaatccaaatgcattatttttttttgcggggaaaatccaaatgcattgtggtgtgacaaagttgtaactctctttttttgggtttgattttgcgatattgtggtatatttcagtgttgggatggcggcggcggtgcaggtggggacggggacggcattgcgacggcgacgatcatgctcctcggcgacacttgtacccgtggttgtcgattctgtgccgtgaaaaccagtaacaagcctccgccgcccgatgccctggagcctctcaggacagcagtggcagttgcaagttgggggtacgatccaccgacgattattgcattattggcatgttgagatgataatgcaaaagactttagaaccgatgcttctttttttttttttgcagcgtagactatgttgtgctgacaagtgttgatagagatgaccttcctgatggtggaagtggccattttgcgcaaacagtgaaggctctaaaggtttgtcggtcgccattcagttgtgccactaaattggtggttgtactgtactgaagaaacttttagcttatcttcaggaattgaaacctggtatactggtggagtgtctaacttcagactttcgaggtgacctggaggcagtttcatccttggcaagctctggtttggatgtgtttgcacacaacattgaaactgtgaggagtctgcagagaatagtcagagatccccgagcagcgtaattctctctgtgtttttcattacagccacaaaacactgtatggttgcctagatgttaaatctgaagtacttcgtcattaatacgccctccagagctcatgacacccatacagaggtcctgaggtccaggattgtcttaggcagttaggctatccaataataatgactgttaacctaccacatctaattttgaaaactgaggttgagggataatccttgaagaaactatgtaaaatctctaatgtcatcatattgactcttggcaatgtagttattatcttatttccagtttattatctcgtttccacagatacgatcagagtttagctgttctgaaacatgcgaaaaattgcaaagatggtatggtaacgaagtcctctatcatgcttggtctaggtgagacagatgaagaggtgaagcaaaccatgtgtgatttgagggccattgacgttgatattctgaccttgggacaatatttacaggtttgatctttgagcaactttgccagcgctttttatatcctcctggacttcctttgttcttgttgttgtatcatccaatgctccttgcttatacagccaacagaaagacacttgcgggtcagagaatatgtgactcctgagaagtttgatttctggaaggagtatggggaatctctgggttttctttatgttgctagtggacctctggtaagcttcacataaagtctgctattcttatagataaaatctaataatatgagcaacagtatttaaagaaaatgataactctactaatggcccttgttttgaaaggaatattgctaccgtcgtatttgaaccatctagatcatgtatttcctggttatccagacaatcttcaaaagagaaaaggcccttctcttttgttggttgttaacttggtagtagaattttatgcatatttatccttgctactgttgatgacttctcaggttcggtcttcgtatcgtgcgggagagctctttgtgcaaaatttggtcagacgtaaaaaagccgagcttgcacctactttgcagtaaccaaataggagtattactactatacatctgatggcctggtgcagttctttgatgaaagttttgcattgaagttgtgtgctgatgacaggagtaaggaggtggcacaatcgggaccaaaggcctagagtgacatgcctataggcgctcgttgttctagccatgctgtgatatctgctgtagcctgtaaaaaaaattgtttttcactttcttactcgggctgtcaaaaaagtgtatggaaaccagataaaataataccgaatgctaaaattcatgttactgcccatgacgcttcgttataacgctaatgtattcgcgtccattttttggtgtatgcgaaaacaactcaagttaaaaactgaaaaagaaaaaaaaaagggcgcggtcttttggctgatgatgactgaattaaagtctgtaatttcttcagatctagccgttactctcctgaaaggagctgattggttcgcgatcctgaattatacaatcatcgtagtgtttcctggtgagttgctatcaagatgtagtagcaactagcaactggctggcttgcacgatggacaatttgtaatgagatttctatcattccgccagatgtatagcttcggttttcttactcagcacaacggggtggtggcgcagttggctagcgcgtaggtctcatagctaaaacgtgagtaatcctgaggtcgagagttcgagcctctctcaccccacaaaatttggccgagtgatgatgaaatgctccgtgaccgattgggtcgtcacgaaaccatctatttcccagatgtcaagagctatactgagctccggcctcttatttttattccattttaatttacgcgccgcaacgcaacttccatggacgcatctggaccaccgatttccaatccaacgaacactctcgctgccgcggccgccgcctcctcgccccatccagcactccacgcccctagaatccatccgccgccgccgcgatgccgcctccgccgcacgccgctttcctcctccggtcccggggtctactgcctcctctcctccgacgaagccccagctccggcccgccgcctccgctcctccgcccgaccaggcagcgccgcggcctctccgtccgcgcctccgctgcggagctcgccgccggaggtttgtctgcgcgttctcctttctaagccgtgtgtttgtcgtgagtagactcggtgtttgcgtgtgagctttgatgttacaacacagtggaatggctggggttcgttgcagttgcaggggtggaggatgcggtggtgggcttcgtcaccggcaagcggaaggccaccgagttagcccacgcgtaggtactaaacccccattgttgcgtagcgtgtaaattatctcttgtttttacctttgagcctaaaaagtaattgctactcctatactgcgttagttacaatttacagtgtgtactgggcaagtatgaaatgggaattttcttttcttttgacagaatatggaatgaaagttctgttaacgggaaatgctctctaggattcagcgggagatgtgtaaaagaatacgtgtacacattagctattcacattttgtcttttggttttctcattagggtgtggagaagtattgttcggaaaggggatactgtggttgatgccacatgcgggaacggcaatgatacattcgctatgcttaaaatggtagctgatgaaagagtacaagggcgtgtatatgggttggacattcaggagtccgcgatagccagcacttcctcttttctgaaaatggccgtcaatagccatgaggtatgcatttgaaataacttcaagggaagtggaaacaaagattttgctgctacattgtgttagaaattaactctcctagataggggatacatttaattttctttctcgtttccaaagattagcttatttataaatgagaataaaaatggacagataatgttgttgatagatagcagagaaagatctaacaatactcatatatgctgagtctttttggttttttttatctctttgtggtgttatggtcagatcttagtatatagaaacaaagcatcattgccatattcccaggaaatatctgcagttttggggttgttgcaataacttatcttggctgcagctcgaacttgtcaagttgtttacaatctgtcacagtagaatggaggaggtcgtcccaaaagatttccctgtcaggtgagttctgattcacatttattcctagttaccaactcatctgttgacaggattcagtaacagtttattgttgaaattattggatcaagtaattaagatctttgaagtgttgattgaattattaatggttcttttattttctaggcttgtagcattcaacttgggctatcttccaggaggagataaaacaataatcactgtacctaagacgactgagctggctttgcaagctgccagtagcattgtcagttctgggggactcataagtgtccttgtctacattggacatccaggtggaaggtacatgcgaatgctaacaatgtgtccatgtacaatacataggggctatcaactgcttgctcgttgtaatttcatacatattctagatgtgcagttatatatgctagattgaactgtagtatatgatgaattaagttaacaaaaagaatgtctttgatgataattttcgcatgtttttaacacatcagaaaatctttttttacagtattgtattcaaataattttaagacttgattaatttatcttcttttgttatgatccttaggaatgaacttgatgttgttgaatcatttgcatcaagcttgcctattgatacctggatgagctgcaagtttgaaatgctcaatagaccagcggctccagtactcattctcctgtacaagaaatgatcacaccttctatgacctacttgtggggaatgacggagttagtgagcgaccacatgcttacttgcatgccaagtgccacaatgaccaaggattcaagatttgaagttacaaggcatttccataggattttactgggtggacagctgtgggtattgataacaacttttgagagcttctttttcgccaggccaacttttgagagcttcacaactatatatatgtttcaagcactgcagtttaaacgaagggcaattgctttgagccacactcgtgactttactcctttttagggttgtgttgatgttttgtattggcaacaataaaggggtagcacacgagacattaaagtggatggatgcaaggagacaagggtttagacatgtttaggcataccctactcttgtttcgtggattggatctgccggattgtattgatcatggtgttattggttgtgttgatctcgtggatctcttgcctcatgcctgtggattggatctgtcgaattgtattgatcatggtgttcttggttgtgtctatcttgtggatctcttgcctcatgcctttgaagggactccctgttcaccttacatatgaaggttaacaaggaggaaaaacacaactttaattttgtaatctatacaacgtaatattcagccgaagctctataccctgccttgagacataaggtaacatggcaacaaagtcctactctatctaatattacatggatgcattccacctatctgtagtcggatatgtaggctgtgtgggaacatgataccaataacctccacaatagtccccgagatcttcacagttgagttgcggtcttctttgtgattcttgacgaatactgagtgcttcaatcttttctatgaaggcttcccaagtgtcaaagaggttgtagagagctttccaaagaattgacaaaataggtgcatcaaatagatgcatctattaggtgtagcccatgactatgtgcttagttgagtaaagaataataatcattgttagcaaagtggcttacacctggacgcaatatatatggtgtgaatccccgattgatatgacccgagtgatataccgattacataaaatgtgatgtgggcagctctggaccaaccgcgtcttgagaatatgatgcgcgtaactctgaaccaaccgcgacttaaatcatgtgtttttcaatcaacatctgacttacataaaaagctagtcgcgatgcttcatgagcatgctaatacccttagaaaataatattaccacacggtaatgcttaacgaaagaggcattgggtaaaatagcacgtgggccgtcggaacaacaccacccaagacccaatagggcatgcttaattcaccactcctggttgtaattgggttatgaacgcaataggctcttggcagtgacacgataccgagtcagtcggtcctgcatgaccaatccactagaccacccctcttgtcagtttcacgcctttgagctatgatgacggtgtggtgcggatctaacccgcgagaaatgtatatttctacaaatattttaaaacatgtatatgtatgcaaaattatgaaaaataatgtatactttaaatttcaattccaaaaaacactaccaggaataacaaagattaacatgattaatcttaacttattgaaaccatcatcatcgtcatcgttataggagtactgttaagcattaaaccaaccacaacaacacgatcgagagatttttgttccagttccttcagcactgacgcgcaccatcaatgaagaagcatatcaatggagcaatgggttgacgacttgaccg

SEQ ID NO: 66080 - DNA, 38813 bp, Oryza sativa
taggaaaagaattaataattgcttaaattttttgaataagacgaacggtcaaacatatttaaaaaagtcaacggcgtcaaacatttaagaatagagcgagtagtaaattttcttgaatacccaaggaaaacctgatccagctttagggagattgatgcatgtttaccaagtctctaaacggtatgatttttgttaaaaataacttctactttgtgttatatactacaagtttctatcttgtgctcgttttctgaacggctaaacaatgtgatttttttccaaaaacaagttctattgaaaagttgtttttttaaattatttcaatttactagtacttaattgatgtcgttccgtttagcatgcgggaagaagatcccaattcatttttccttcaaaattccttgaaacgacctcgaggttggtgacggttcaaccatccataattctctcattttcctccacgagctccaaaattcctgtgtgttccaacatatttcaaccatccacaattctctcattttgcaatgatcaaaactctagtacttgactataagcggcacttcgtccagacggccactacaaccgtactacttgattaaactctaaaacaacatttgcaattgcaattagtattccactacttgactcacctacactatcgtagtcagataagagtagttctactcatcaattcaatagctgaaatttatttttccccgaacacgaagcgaacgagagctaattgaagagagaacaagatgaatcgatttggggattgctgaacatatttttttttccctttccgattgcacgaagcgaacgagagctatttgaattgaagagagagcaaaacggaatcgatttggggagagggaggggctatagacgtacggagatgtaggagcaggtggggaggacgcgcatgccgcgctcccgcgcgtgggcgaaggcggcgtcgcagagccgcgccgcgagcccacgcccgcgcttgctccccggcacgtacgtgtgcgccatctccatcaccgctgccggcgtcgtcgcgccgccgccgccgccgccgtcgccggaggaggaggagcgcggctgggcggcggcgaggaggcggtactggaggtaggcctcgccgtcgggcgtctcgaacctcctcgcgtcctccctccacaacacgacctcctcctccgccgccgcctcccgaccgccggccttcgccagcgtcgcagaccctggtgtgttcggccccaaattagattgcaaagccactggaatgttgcgctgcctccgttttttcctttccttttgtttttaattttactgatcaaactgcccgtgtgttgccatggtaaaactaaaattatgctaaaaatatttagtgaatatagttaaaactagttgggtggctagcatcaatttaaaattatctattttttaatacatgattttatttaaaattatcattcacataattctaataattttatagtttttaaaaggtacgccagtcgctaccccttcctcgggagcgcctacggatcgggcgatcgattcggggctgagaaatcgggcgcgtccgatttacgtgcaaaactattttaaaccgatttttctcttaaattaattatccaaatcataatccgattacaccattaaattcgttgcaattaaatcttcaaaaaaagaccacacatggatatattccgacgaaaaaaattagcttattattgattttttttaaatgttgcacgatgttccaccaggtatatcggaattgtctcactaagtagatcaaaaatgtttcactcgtttaaatcaggtgttgtttcaccttatataaaaacaatgtttcagcaaatagtgaaagaatgtttcagttcactacaacattagatttatacatagtgaaacattatgattgcactaggtgaaactgtttgatggtattttggtgattatacatgtacacaagacttactcatgatggacaaagcaaacaagcaatttgtaagttggctagcttatcatttctatgcaatgcttggccatgtatatacacgcaaatacatgcatgcacaggcagctggggatatatatacttagattagtataggtgcatgtataattaaccaataactagccgtgtgaagattggctggtgaggcaatcacgcgcatgcatgcatgtactacagtagacggtcgtatgtgtgtgcatgcctgggtgattaagcaacctatgcatatccgagtgattaatcatgggctcggcccatatggccgaagacgatagctgcctacgcgcgggtggctggacctctatctcgctaagatttcagaagttaatatgcggaagagataaaaccagatgaattaagagataaccaacaaaccaattgattttatctctataacaaacttgatcgagttagttacttcgcgcgagcgctagcgagacgcttatcactggactgtggcccagcagcagagaaacaaagcgaattacaaatcaagtttatctctattgattatttcttatctatagaaataatgatgaaggaatcaccacccagctgcgcatgcgcgggcggctgggcctccatctccccgatgctcagatatttgacgccgggagaagctaagagataaaatcaaagaagaatatgaacagataacaaactggtcgatcaagccttatctacagcgaacttgatgcggaggaaacggcgtgcagatgcggtgagcaccgacctcagatgcctatataagacgtcaacccctcggcagccaggggcattgacgaacttctccacacattcatagaccaacgcatctagcatccacaagcgatcgacacacaacgcagccatccatcctcgacgcggccatccatcctcaacacaatcttccctcgtcatcaacacatccatcatccagcaccggagcaacagcgcgtgcgcggccggagcacaccgacggtggcgagcggcttcggacgaaccggcgtccggcaggggagcacgaggagggagatggaatcgatggtcttccaaggtaaaattaattaagatctgtttccttcttatttcatatgtagcacgtacatacgcatgcatggagaggcatcaactagagtatggagtagtacactcgtgcggccaagtcgatgtgcgctggcgtcatggcgccggatgacggcagcggctatggagaacacctcttttggttggttctcgtcgtcagggcgcacggatcgctgccggcgctctcacacacacatctacatcatcatcacaaccatgcatggagaacgtgaagcgaagacgacgagacgaccacaagcagcttaatggaggttctcttacaggcctaaacctgcggaggtaattaactgggagcttatcgaggccccaggaaccaggagaccacatcgcacaagttagatctgtccaatgacaaattatggagcgcacatacatatatattacattgggaatttatatttatgatcttttaagattaataaagagaatgttccctatgttttgtttacattgtgtatcttggtacactggcacgctcgcacttattttctctctaaacatagagggatatattttcgtatttttccatcctaaacagaaacatttttcggtggaacaaaaaaataaaccaaattcccttaataggtttccaaaatatgtgggttttttttgttacaatggaatatttcgttaactgcaacattagatctatacatagcgacacattgtgagtacactaggtgaaacattttttatagaacaaacaataaaccaattttccttaatagagagtttccaaaatatgtgggttttttattgcaaaagagtattttaattcactgcaacattagatctataaatagtgaaacattatatggatactaggtgaaacatcttttgtgaaaaaggggaggaagaagtgggtgggccaacaggtagcacatgggggaggggcgcgcaccgggggagcgcccgatccggctccccccacgccggtcgcccggcgacaagcattatcgcccttcctcctatgttatttgcttactcaatttaacactacttctattcatacttttttgaactttaaaaattaggccttatagtttttagaattcattgtcttgttggctttcattttcaaaatttttagaagtatcgtcaaacatcgccaatttactattctacgactcgtccactgccacctctctttattgttattgggattttagaaatcaaacataattattgtttgtgttctcttttactttctgtaagtctcgtcaaatcgttagtggctttgccactatactcctctgaagtccgcccactgcctcccctccttattgtcattgagattttaaaaatcgaacatgattatcattggggtttattttttactctccataagtcccgccaaccatcgtgaccatgctgcttaacgacatgcctatcgtcactcctcttaatcgtcattgggattctatttggggttttgtttatagtgtttagatatcccatcaacggccagcaatctactcctttacaggtctattacttctcctctctttattgtcatttgtcatcgttgtgttctagatgtatttttttaaaaaaatgtatatttttaattccgataatttttattcataaattatattcctacttgaactcttctaattatttttaatcttttgaaatttattttatttataatttcgaattttaattagtctcgtcgtttgttttagattgtctcttatttcaataatatttatattttattacaaattttatttattttataatttgtatttaagttgagatcttatttttctttttctattttttgaatttattttattttttatttcgaattttaattaatctcgtattgtgttctatatagactatcttttaatatttcttattttttatttccaatttcaattgttccaaaattgtattcctacttgaactctctctctctctttttttttctaattttggattttatttgattttttatttcaaattttaattaggaaaaaatacgaattacccctcaaactatcgcggtcgtccgaattacccccctgaaccacaaaaccggacatttttcacccccaactatgcaaaccagacgatttacccaccttgacccaatccatagtgattttgtccaacgtggcgcacacgtggcaatccagtcaatgtttttttaataaaaaattgtgggacccgcatgtcatctcttcttcctctctctactctctctcgctcttttctctctcacgcagtgcacacggcgaggacgggcagtgggcgtggtcagttggcgaggacggcgcagggacgggcagtcggcatggacggtaagcaaggacagcgcagatggcggcgcggacggtgcggacattagtgcggagacggaggcggcggtggagctagctaggtggaggactccgactccggcaactcgttgatgcgattggcgaggtaaggacggcggcgcgcggggggcggtgggggcccgaggacgacggcggccggcgatggaggcggaggccgaccgggtgcgaggggacacgcggtgggcggcgggctcctcatcctcgtcgtgggcacacgggaacgcgcggtgggcggcgggctcctcctcggcagtggcgcgcggggatgcgtggagggacaccgccgccatcgcgggctcctcctcctcatcgtgggcgcgcggggactgcggtgggcggcgggctcctcctcgtcgttgtgggcgcgcggggacgcacggtgggcggcgggctccttctcgacggtggcgcgtggggacgcgcggtgggacaccgccaccagcgcgactcctcctccgagccggcacgccgcaccccgtcccagctccccgcgcctcgctccctgtccgtcgcatgctctcctcgtccgctggtgatgcgccgccgctggcatagcgaaccgggcccaagggtgggaggaagagcgcgccgccgccgtctcgcttgcctcaccttgccgctgcagcctcgcttggcatcacctcgctccgccgccacgctcctcccctgccgccgccatcgccgctccgtgtctcccgtcgccgccgacccgtgagagagagagagaggaagagtgagacagagtgagagagagagaagagagagaggaagagggagagagaggggaagtggaagagtatgacaggcgggtcccataattttttattaacaaatgctgactagattgccatgtgtgcgccacgttggacaaaaccgctctggattgggtcgaggggggtaattcgtccggtttgcatagttggggatgaagaatgttcggttttgtggttcagggggtaatttggacaaccgcgatagttcggccggggaggggtaattcatactttttccttttaattaatatcgcgtttcttatatagactcttctttcaatattgcttttaatttcgaattttagttattttcaaattgtattcctacttgaactcttctttttttctaatttcggattttattttattttattccaaattttaattaatctcgtattgggttcttatatggactcttctttcaatattccttatttttaattccgaatttaagttatttttaaattatattactaattggactcttctttttttttctaattttggattttattttatttttattctgaattttgattaatctcgtattgggttcttatatggactcttcttttaatatgacttattcttttaatatgacttattttcaattccgaattcagctctttttaaattgtatttatatttggactcttcttttctttttctccgattaatgtggaaatttttagccccacagcgaacgtagtgacttctttcaaagctgttataatataatagatttgtgataagagccgacacatggtgcctagatcaattttgtcagcaatgagaccatccatatatttttgtacatcaaatttctgcataagcccgattgatcaaatgtatcccgattaattgttgaatagtacattctccgttcaacaaccgtattccgtctttcatgaaccaaaggcgaaaaatcggagctagaagaatgaactaaaggtgaaaacagttattgatgtccatggatcatttttggtgatggccagtgatgtatgcagtggcaggtgaggtccaatcttggtgtattatgtggtaaagcttgaaaaacagtgaacttgaggtgaaccagtcgaaagccaaatgacctgggttgaaccaacagggccatggcaatcctctccctttcctccagcatggcggcaccctctctccattccctctagcacacagcgctgctctcccttcccttcagcaggacattgttgagaagggccatgtgtgaggggcatggtaggcggcatcctaggacatggcacattcccggtcgctcatcgtggtgtccgggctggatagaagcgatgccgttactggcttattgcctgcatggcgtcgagaggccctatggatctgaggatgctagcgtggttagcgctggatttttcatattttggtccttttgaaaaacttatttcgcaaataggcccctggaaaaacttatcccagaaatggtcctttttgaagcgccggagtggctggcgccgtcgtccaacgggaggcgccgtcaccctgccaccgtggcacacgcgaaccgatgtggctggaggagggcacctgccatgttggcgtcgccccccctacccacccctcgtctccattcctgtttctctgtatgtagttgtaacggtgtcatttttgttttattttttcagatgttttttcacatttagaatcacgatacagccaaccacaaaaaaatttaaactcgaacgaaatataccacttagctaagtctgaaaataactagaataccacttagaccataactcttttagtaaaaccctttgatcagcatgttaaacataatgcactctagcaccatatgaaattacttaatctaattcaaaatataaccacatgaaatgatagccataagttaaacagtacagagagatgcaattttttattttattttatttttttgatattttttttcacacttagaagaacatatgaactaaaccatagaaaaaataaactcaaacggacaaaatatatgactcgtagaattttccaaagctctaccaaaacggacaaaatatgtcatttattaaaatatgcgtaactttctcatacggactcggaatcaagcaaataatatatccatgaatatctacagaaaaagttacatccgaattccgtttgcaagattgtgttttcgaggagagaagtttttcggtagagctttggaaaattccacaggccacatatttcgtccgtttgagtttatttttttatggttggttcttttgagttcctaagtgtgaaaaaatatcaaaaaaattaaaataaaaaaaaagttgcacatctctctcctctgcactagttcggagagagaggagaggagaggaaaaattctacatgtcacatattacgtccatttgagtttatttttttatggttggttcttgtgtgtccctaaacgtgaaaaaatatcaaacaaataaaagaaaaaaagaaaaaattttgggggggcgggggcgccagccaatctggcgcattccccccagccacctcagcatcgccccgccacgtcggcgtggggacggcgccagccactctggcgcccaaaaaaggaccatttctgggataagtttttctaaggtctatttgcgaaataagtttttcaaaaaggactaaaatgtgaaaaatccaggtggttagcgaggctagatctaggctaatgaaagagtagggatgggagtggaatccgttggaagtctccagataaacttttgtggtgcctttttgtcttttcatgttttcggtaaagaaaatattttctcaaattgctggctagccaaattgacacgtgactaaaccgccacacgtacactatataggactactgtcgctataaaatgggggttatgagggtaatttgtctggtttgaagagttcttttttttctttgggggagggggggggggggttaaatcgaactactacaaaagtagtttaggagtgtaactcgaactttttccttcttgtcaaacatgacaggttgcagatgcagtgcccccacgagtaccacctctaccgtggactttactttgtaaaaacatattcatcacctaaacaaatgtgaaagaagtaaataataaagaatctctcccccaagtagctagcaacacatttttgtatgcacctgtagcacagtactagtagttattactattgtttatcgtctttaattagcgcaaaaaaacaaagaaagatgtgcagttgtattgctgaagaaaacatgcatgcatcgatcttgagagaaagcaaagcacatagataggctaatttctcctttaccttattatctttcatgttttcggtaaagaaattattttctcaaattgctgactagccaaattggcacgtgaccaaactgccacgcgtacaccaagtagaactattgtcgctgtagaagaggttaggagggtaatttgtctagtttgaagagttctatttttgtttttggaggggggcggggtgggggtgaaatgtttagtatttgaattgaggggggtaaatcgaactaccataaaagtctaggagtgtaactcaaactttttcattcttgtaaaacatggcaggttacagatgcagtgccccatgagtaccacctctactgtgggctttactttgcaaaaacatcatcatcacctaaacaaattggaaagaagtaaagaataaagaatctctccccaggtagctagcagcacatttttgcatgcacctgtagcatattactactccatccgtccaaaaatataatcatttttggatttcaacacagtcttcgagatactactttgactaacaacatctataaaactaagatgttttaaataaaaagagttgcatattataatagtttatttaatgataaatccagtaacatcaattttacataattgatcttttttattttttttattaatagtcaaaattaaaaatgtttgacttaacactgtgctaaaaatgcttatattttgaggagtagctatgctatggtttatcgtctttaattagcataaaatcaaataaagatgtgcagttgtattgctgaagaaaacatacatcgatctttagagaaagcaaagcacatacataggctaattctcctttacctttttcttttcatgttttcagtaaaggaaaagagggaataaatcaatggaggcgagaagcaaaccaaggtgcaaagcacaaagcaaggaacccctgcgtatgctagcattagtggaagggaagcgatcgagaagataccaaaccaaacgaccaattaagctatctattcatctagctgatcgagccttctcctaacatccgtctcgtgctcgcgctcgcgcagaagcccatctatccaagcattccaattgctgctgcttccatcggtcggccagaattgctgcatgctgttgtcttaagttatttggagcattcttcagttcgtccatctagcctgacttcatacttgcttcacctggctcagggcctctggcgctctgctctatatatatactcaggtacgtattagtaataactaattatatttcttgtaacaatgcatcaacttaattaatttgcggctcgctcgatcagtgttacttagtttatttgttcatcgatctttgaaaaaaagaagaagcagttctactgattatatatcaaaacatcaattgattatatatggttgatgtaattgttgtgtatatgtgtgtaggtggcgagtggaattgatcggttgatacaatctgatacgatgggttagattaattgattttctgacgattctcctcttcctgatcaccatgattaaagctgtacaccttctaattgcactttcacattctcgaattatatagcatgtctatttctgtgtttatttccttttatttgatcaattgatttgagacgttgatggcttaacgtgcgcacataacatcaatattagtcgtccatatatatatatattcgcgattataattaagtatataagtgccggaatatatcttggcttggggagggggcttattaattagcgccaaggtgtgaaatggtttagctagcatattaaaacaaaataatatgcatgcatgatgttgtttcaatggcctaaaggaactggcatgcatcgatgtttgccaatttttatctctagtaaagaaaagcaaagtagatccccacatgctcagaacttgtttattatttttatttgaacagaacaaaattcactagcagctggtgataaaaaccagttgattacatatgcactatacctatagcatatgtatgtatgtgcaagttaaccatgtatcatcgacctatcgagcacgctgacgttaaccaagcaagatggtccgtgaatagaaaagcacagacactttattctctttttccttcaaaaataaaattcttcaaaaatgacacatagtttgttaaattcggactccactaagaccccgaatgccagaaatatttttcctacatccgaaggcatcatgattctccggtaaatgatttacaaaaaaactagatgagtgcatatctctcattagctttgttttgtaccgtgttagctagtacgcctgcttcagcaactcctgttgagtgcaggggacattgtagagcaagatagttgttggtgtcctctgtaatataaagtcaatcttacacagtctaatttctattattatggcagaatgtaaattgggatacttttgattgggctgtgcaagggatacttgaacattttgttaaaaatcagagggacacaagagttatatattttgatggctggcgtggttttggagcatcagcagtccttagagctgtagcagatgagcttacatctcgaggagcttggccagaactacacattgataaagtaatccagattgactgctctacatggaaaagtagaagggcaatgcagagggcaattgcagtggaactcaagcttgatgattcggtaattgaaattattgataagacagatgaggaggatgattttaagggagtggatgaaggctctagaagcgagataatgagtgttgcagaagtgattgatcaagtcctcagggatcacaaatttatggttgcttttcataatggaagtggtgattacattgatttaggtagctttgggttcccgcaaattacactatttcgttccaatctaatattatggacctttcggaagaggttccaaggaagggagcgttactctgagataaaagacaaagtgaagaacacccatttattcgcatttgaaacagagtattatataacaagaaacaacattctcttcccagtactgcaaaaagaggctgctgccatagctgcccattatccttgcatgcgggagatcgacccggaaaggatcgtgcattgctgtctatatggactatttctctatctttgtttgcccaaacatttggagaatgagtgggcagcccgagcatcagtgtactggatgtgtgatggcatcatacaaggtgatcaggcatgggagataagcgctgcactttcaaaagaaataaagtgggatctacaaccttctttacaagatgaggtgcgtcaagaattcatagaatcatcctcaaaaaactctgtaagtatccagagattcaaaaacagatactttgatgggcaaaagttttacccttggatcacaatcactgcatcaaataatattaatccagaaacactacaggacatccgatccaaaaatgcagaggcatcgtcttatttcttggctcctgaaagatccagtgatatcacactagtgttatctgatgggttgtttgaccaatggaacaacctccaagttctgcagttgtcatattgtgacttcagctttgcatcaccaccttttattggttgccagaatctaagatttattgggcttgaccactgtaaagataaaaaagaaggatgcaaacaaagtgacctaaggaagtggcagtttctccatagcttattagttttggatctcattgacactatctggtaccaagtattttccgaagacatggcagatctttttgttaaccttagggagctaaatatagtaggagtttattgctctcacatatggggccagctacaaaataagattgaatatgttgatttgtctaggaaaaggaatataaaacttccttccactctaagattcttcaggcttgatgaccgtcaacctacaccgcagtccacaccgggcattgaattatcgctaaaaggttgcatgggattggaaagtttattcctgagtcgaatatccaacctcacggagctggacctctccggaactgcaatcaggatacttgacttcacagctatggtggtggaagtctcaggtttgaaacgactatttctgctaggatgcaagcaactccaagcaataaaatgggacaatagtggttcaacgataaagccggacctagagttgttgtgcgttgacacaaggtctagaagtaaatatcctcagttatttgttgacaagaataaatcccccggtttcttgtcagtccatgctgttattgtggacgcgagaattgctcggtccttatgcgctctaatagagaactcatatcatgttgatatgcatatccatgtcacctcttcgaccatatatggtgaagttcaatccgaaggaacctacaaagatagcattagccaattaagtgatcatgtgaacatgcagcaacaagaccttatttcagcaggccagtaccatgatgtccaacttagcatggttggcgatgtcccaatgcagtcattcccccttcctccgacaacaatgttgagccgccatatcgagattgcacaggggagccacaacctggagagcgagctggatgatgattcaccgattcttactttagctcatctagtgcaggggaaggctgagtcactgcatgtgcatgatctctcaaccatcactcctttgcccggaggacaatggtgctgtctcaagtggtgtcgtatagagaggtgcccgaagatagaaattgtcttccctaaacacgcatggaatttctacggtctggaaaccgcctgggtgtcggatctcttgatggcccgttgcatctggagtaaaggttctctccagtacagtggttccttccaaaatctgcagcacctgcacctgcgcagctgcccaaggctccagttcgtgctcccggtgtgggcctcctccttcccggacctgaaaaccctccacgtcatccactgcagcaacctccacaacatcttcgtgctggacggagattacccagagcaaataaccgtcgaaggtgtagcattcccgaagctaaccaccatccacctgcacgacctcccgatgctgcggcagatttgcgacgtcgagttcaagatggtggctcccgcgctcgagaccatcaagatcaggggatgctggggcctgcgccggctgccggccgtcgctgcggatggaccgaagccggccgtggagatcgagaaggacgtgtgggacgcgctggagtgggacggggtggaagccgaccaccacccttccctcttccaggcgccggtgcactcgcgctactacaggaagaagctgcccaggggctccgtcctcaggtatatatacggtgcatgcatcggaccatgtacctagctagctgctccatcttgatttatttgcataatacttgttctcagttatttcatttgtttgatctgtgcttaatcaatttgctttctctgtctactgttatatttgttgcctaggtgaattgaatccctgggcttgggcggccatgatttggggattgattggcgacgaatgatggtgaatcagtgagatgcttcttgcttgcttctgttgggtgatttgtctccggtgatgttgcagcaagctttgtggtgtgagctgtgtgacgggcacggactgaccgtggctcgatcttgtcctcgtatatggccgagttggccagagagcgagattgccatggctctgaaataataagcggctttgtttgtgcgtggatgcacagaccagctgattgagtgagtgtgtgtttcttgaatttaattagcattctgggtgtggatgctcagatgcatgtgtgtgtgtggcttgatatgatgatctgctttgcgtttgaaacaataataagcagtagccatttgtgcctgcgagcatatgtatgtggctgctgcagtgtgactgtgtgagagtgcattgcttgtgtgtaactgaattctgaagattctgaacagatgagcagctggttgtgtgtgcttgcttgcatgcatgcatccaccttgctccaatgcgtgtatgtgtggtattgtaattatcagaagctatagtttgatctactttctcttctgtttcccagggaaaagagttaaccatctcttactccttgtgttaacattttctttctttttttttgacagtggagatttcattacgcaaatgaaagcatcctgcttctgcactaaagtgcactaagccaaaaacagaaccccttaccttttcccaattgcatggtatgtttgttcttttttaaaaaccttcttttttaacgaacatggcatgttttttcaaacattcagaaagctctcagagggaccagatttaagtcattagcagtgaaccgaaggtcgctctgatgattatagaggtttagaacgcaaaaggtcccgccaggattggaaacgcaaggtctgattctctttttcatcacaattttttttcctaagatgtatcttcttgttccataacaaaacacacgattacgtcgaagtagcaacatacaaactacacaagtaccaaaaccgatatatccaggattccaggtcaaatctcatacgcgtcaaatccatgttcttcacataaatcccctgtaaatccaaaattaagctaatacaacacccccgaagaatatacaaacagtaacttctttttttttaatcccaaaaatcacatagaacaaatgttccatgatttcacaatcttgaatagtaaaccacactagtcagctctgccagagaaaatgatagcctcttgttagtgacaaaaaatggcaactgtcttcccatgcatccatccatacttattattgcctagcccagcaaagcctatgtaaagaatccactggcatataatacttgtttacaaaaaaaaaagactaacaatgaccagtacttatttcatggtttcttcttttggagggccttcagcaatcttgtcacttgtttgcgtttgggcgtctttagactctatggcggtggcctgagctctcttacttgcgatttctctttgcattgctatttgatcttgcattactttcgtcatctcctttatttgcttctcttctttctccagttgcatgtccattatgatcttagcattcttatcgattggtttgaaatattcatctatggcggtttcctgtgaaataggatggaggataagttagcatgtaaggtccagaaacattaaaaaaaaaagcatatcatagaagtaaataacatgtctgattctgttacacctaaatttccatcctataaaatcatggcaaatacgtaaaccaaacaatcaattaaaccatagaagatacggtgtccttcataatacaacagcatgatggctaatccacctcttactgtcaggtacacaggggtaacttgaagcattattcatgattcaagttgtgagatggttcataaactaacatgttctttctcaaaacaacagtacacatttcctatgcaggcattgagacatcgatttggtaattttattttgtggcaggatgtcttacagcttcttcaagctgctgattgagggcttgcatctgctgaaccatttgacgaacttctgatagaataatttgttctggctgcttccgaagctcttccttcttagcttgggcctggaaaatgttcccaatatttaagtattcgtataaatgaacacagtatggcattgatcaactaatgaatgcatgaagaaaaatgatagatgttatcaccatggtccatggataaccaaccatgctaccttgaaagaattgctttcgcaacatttaaagacattggaaggctgagtacttagaacttaataatttctatgctggaattaggttaagtgagcttagcccttaccaacgccaaaactataaaaaaaacagaaaagcgtaatattttgtttctttaaaaaaaattgtttgctcccttttatttacatatcccacaaggacccacattgtcttgtactccctctgtcccaagataactcatttctagtctctaacatttgtcccaaaataagttcatatctatccctcttcataccctcggtctgcaaatcgagttttatctcctccataccctcttacttgcccacccactaatgctactttcctattaatgaggggcactttgttcttttttcctccatactaactttttttttctcgaacacacagaaaagcctccatactaatttgaatcccacttgctagaagtgaagttattttgggcggaggtacttcaaggcagtgcatcatggatcagcaggggtgtgcataataaaagctaacacaacaaccacaccgactgaacagccattacttagcatatttgctaattttatctattggctattcttcttacgaaataactattcaaaagcaggcaattattcaaagtaattgagcatgtaaaaatgctacaacaatccgtggtattttacataattgtatgcagaagtaacaatgccaagtaagcacagttaccctgtacaaaagatatggaagtaaataatcattcccaatacaacgtaaaaaaaacagttctttgtggcagtagaaattgaataaggctacaattagtgggatggcttatctgaataaaaagcagttggtaaccactactctgtaccacttgcaggacatagctgatattttcacaatcaatgaaaccagcaactgatatgcattgtgaggcacccgaaaagagcacagttgtcaattaggcacagaaccaatttaccataacaataatcccttatctgtgccatgccaaattgccaatcagctaaaggagaagattccagcctcaattaaacaaaactctactgaaaacaagataaccggtagtacattcttagcgggcaaacccatttctatttcaagcagctcatcccaaagaagacaattactagaagattaagtctcacactcaaacatggtaaagatgctttacttttgctatcacataacacaattcatagattagatatatcttcgaagaaaatggccgtggcatggttaaaaaaaaacaaaagcaaaaagcacagccttaccctcgcgatccgctgctgcatctgcagcctgtgagcacggatcctcctctcctcgtacccggacagcacccgcaccacgaaccacgccttcctcccgaactgcaccagcttatccatccccggccgcctcgcccccccacttcaccaaccccacctgctccaatccatccaagaaccaaccgatagcgtcatcaacaacatcccctttttttcccctggaaaaagcgaggtgcgttgctattcgattcgaaccgagatggatgcaggtggaaccgagctccacggccgccgcgtcgttccgtccccgcctcgaaaccttctcgccggccgcgcgcgcggcgcgaggaaggatgctgccgcgcggggaggtacggtgggtggcgactccggattgcgcggcagatcggcggcggcggcggcggcggcgagagggagtggagaggtccagagccgcagaggtgtggggaggaaggagagagagatagaaatacaagaaaagggaagggggcatttggttattcgccattttctcttctctccttttcatttcctggcaccgccaaacagccacggttccatgcaaattggtgatagaaaaatctgaaaagaaaatatatattttaaaaaaatataattgttgataatataattacattgtagcttgtatataaatataatcttgtggacccatggtcgtagcgtcaaatccccttgcgtacacatatatgttgtattcttttacttatccacctgcataaatcttggagtacatctaaccgtgtaaaattcgatatattatttccacaatttctattgataaaaatctagccattttaataaataatgggacgatcagtcattcccgcttgttgatcgagaattttctcaatagcacattctgcaagaatagggaaatataagggatgttgagaagaaacttagtatgaatatattgactaaaaaataacatatataaaaaggtacaggagaataaattagagtaaaagttaaagagccgaaaagttgctctaatcggttgagttacgggctttcgacaaataagttgttaaaaaatgaacggggcaactatttcatggtaaaactttttatatttatattattactggccacaatagccaagggggtgtcggtggtggcataaagccgatggagactgagatgggatcgccttgcttccccgcacgtggttgtgatgttgtcaagacaaaaggggaggcgtagcatgggtcgacatgtctatgcgcaagggcacgatcaaattaggagcacggagggcatgggaaatggtgcatcggctctccgaggtcgtctgttcatggctccatagcacggtggggaaaagggcagggtgcgagctgtgaggtcgtggcatagttgagctcgattcgccagcacgagttcattgtcactgaagcataattgactggcatgatgatcctcagagattcactaaggtgaggcgtaggtttcccctaaattgcctcattcggagcatggcggaagcggcacactcgttgtggtcatcatggaggagcggcggcgtaatcattgatctagagaaccgagatactatcgttggtgcagcatggaataatgcttgagaatgtgagagctggggaagagaaggaagaaggagatggagaggagggagatgagttgcccactaacatgtgagacccacgtggatcccacttatcatgtcagtcaagaccagccactatattggcatactgccgagggaataaagttgatacggtgttgttagttggtgaataggctatacttggttcaggggtaaatttcagactcagcgacgatgagggacctaaagtgaacctattcctaggtcttaagattgtttgtgcagtcttaaatgggcctttccttattggggaaaatttttcagtttgctgtagtagcttactcagctgagcgcatgagacaaaggccgagtttagttctaaattttgaaccaaaaaaacgtcacatcgaacttttctacacataaacttctaacttttctatcacatcatctcaatttcaattaaacttctaattttagcatggaataaacacatccaaagttattgttttttttttaaaaaaaattgtactatgaataggcagggagtgattgaagtatgttcagttcactggcatcctccgctgactaattatccaacggattatataaagtggattatctatttgacttgactataatataaatttaagtgatataataaatacagtagaaaaaagttcccatagaaaatgtattttaaaatatgttgagcatataattcaccgtaataatctaattaagcagggtataaaagggacagggcaatcgacccatgccgaccgacggttcatgttgttccgctcctgtaagtagtaaccaaggttgacagtatcccgatctgtattctagtatcttacgtatcttacgatactataaacttatcaagccaaaacgataccaatcccacctaccgaaatgataccaatctcacataatatccttattttcatagtatctcgattctactattcattaacacacgatcctataaaattttagttagtatcccgattctacgacccttacgttccaacaaaatattatttataataagatgatttgaaaataatgtaaataaatatgcttaggtttatattataatcagttaaatatatcaaaaccaatgtgatttgatctcttgataaatgtctctatttgcatgacatatattattactatatttttttatatagaatagctatgtgcaattaatacaaatattaattgaacttaaaaagaaaatatcataatatccgatactacaatacaatcctatgatacgatattactttgagcaaaacgatactacctagaatcccaatactgataaccttagtagtaacacggccatgcatcgtgccatcccaagggggttttagtactaagagcaggtacaatagaagactataatctagctataaacatattttaaagagataaaaaaaagagagagaagagcagcgggctacaaatctgtagccagctgtagcacggactccaagacgtaatgtgtgtatgacaggtgggaccaggtattaatagtatagtaagcaactattgtatgaattgactattacattggctatagatgatttggagctagtagttggctatactattaaacttgctctaaggttgtattcttttcccctctttcccaactcacttcccttgttttccacgcgcacgcttttcaaattgctaaacggtgtattttttgtaaaagttttctatataaaagttgctttaaaaatcatattaatccattctttaagttttttaggctaatacttaattaatctcactataatcgcgtgctttgttttccgtgtggggagctcccgaacgcagcctaagaaactaagcaaaccctcggggtccgtgaatcatctccaccaacctccaaactaaattttgggaattctagaaaaagtcgaggtacaacagactggccaaccaaccatctgactggccaaactctttcgctcactgggcagaatttgctagcaaaaatgccttgccaaattgttggccaagtgcatcctcgtggttgtgcgccatcgttatctgcggccttctcgagtcgccaccttcgcatcctcctaccatggtcagctaaagaagctgaggtgaccggcaaggagcggcacggtgagcaggagcatggccgtcgacacccccgagttgtccgttaatgagcaggggctgtcgagaacgttggtccgtgtggcagcttcggcgaggagcagagatagagatggatgaggtcggggagtaagctgaggcagtccacgctacccctgccaccgtccatctctagagctcaggcagcagcatctagatcctaagctccatgccgttgactccccttatccctggcgtcatcgattcctccttcggcacttgcccttccgtcgtcttgactgctgtcccgcctccaacttattcctgtgctgccatccctgcctccgtccctcccgatgttgtctccgcgtcgtctttccccagatgttagtttgttggacagtagaaaagaagggagaagaaggaaagtagaggctgatatatgggtcccgttgtaatattggatatgaaaatagataatatgttagagtgggtaacaagttttgcttgtcaaattagttaaggagttggctatacgagagttttgatttgggtagaccgttgaagatgctcggaaagaagaaacgcggccgcccaagccccagattggtgggtgcctgggtagcatctgcctgcctcacttccaggcgtaaacaaggcggcaccccgtaaccaccagctgcatgcaaaggccccacatcacattcacatggtcgcttgcgcgcagccgccgcaaacgcacgcacgcacgcatgcgatgcgatcaatccattcctccaccgcgcgcggagttggatccaggtcaaagccgcgtacctataggccgtcatgagttggatatgatggatataactctcgggagatcggctcgatcgatcgtcgtacgctttggacggctcgcacgagcgcctgtctccatcggtttcggtatcggcagcaggtcaggtgcagcgtacggtgtgtggacgcggcggcaccggcccgggagggatgccggcctcgacgaggagggcgaggccccatgcagcgcgcgggccgcccatccgcaccgacgcgcgtacgtacgttagctaccggcgaaatcgcggagtggcacgcggtcaccgtacgtctctctctcaccgatcgatcgatggccggcgcgcgaggaaaccgggagaaacggagctgcacgcacgcacgctcgtcgtgccaagccagcgcgcatcgtacgtatacgctccactgacaccgacaccacggcgcggcggcgttggcgcgggcgcgatccaaaccacgtgctcgctcacgtggcgagccttcgacctacggcttttctgtaaccggtgggggggattgtgcatgcggtttcactttcacgcctcgtctcgtctcgtctccctttcctcgcgcgctccacgccatgagatgcgcgcatcaccgacccaaaaatggtcaactatatatctggtggaatgggaaccgaaggaatctatctcagcatagtcctgttacatttataaacgggactaaaatttctttttttaagtctcggtttttttaatgaatcaagattattatggatttttgccgatcaagtaaagatagtttctccggtagtacttatactcccttccatcctaatttaatcatcatctaagagaacgcagagatcgaaaataataaaaccttcattattaataaattaatcatcatcggttaattaagatgttctgtcgctttgtgttttatgcattacatcacattttaagtattgttccctccgttttataatgtaagactttttagtattacccatattcatataaatgttaatgaatctagacacacatatatgtctagattcactaaaatctatatgaatttgagcaatgttagaaagtcttacattatgaaacaaaagaagtacatggcatcgcaacaatagaaattaattatagttggttgcatgcagcgcattcaaagatattcacttactctttacacaattaaatgaaaagatactttgttagatgatgattattttgagaatgtctcaaaaaatttaggggataattaaaattggatgaatggagtatattcctacgtgtgttttgcatcgtcggtgaaaccatctctttctttaagtagaatcaccgtggatccaatattttattctcaattatctttttctagtccatccctaattatataggtgtagcttattataaactacatgcatgttaaagtagagtaaatgtaacggtgatttgtctaaaagcagttatgtgtgtttcttttataaaaaaaaaattgctgacacgttttggtaacagacggaaggtgtcactggcggaactttgaaatgcctctttccaggaagagtttgacttcttgcatgtcttttatttgagcatattatattaaatagaaatgattatggccatgctattataataaagagacatataagtacttaagtactgatgagggcatgactaagatataatcatacttatcttacatataataagctttgctttagcttgttgacatgtaagataaagtataattatatttgagccaacgatggctttgctttagcttgttgacatgtaagataaagtataattatatttgagccaacgatggcctcatcagtacttatatgcctatttattttatgttttctatattatttttttattgtatgttcaaacaaacgttaaatactgcatcataagttttgtatcttctcgtttgcagaaatatttgtgcgggtgaaggaaagaatatcggcctatacagaaggattcttgaggttcataagtacgtgttggaaagcttatgaaatttactttcatatggtttcgatcccacgtcaaaatttctcctaagcagttgggaatctgcaaaacaagtcacataccttattcatttcgagtctaatttaggtcttgggcttttataattatgtcgtgggctaagcgccagagatgggctaaccttaggatgttcttaatcatatttatttagtagctgtcatagtttagagtcagggtttcgcttatattattctatcgttgtagtttcgccgcttagttcggtctgaggaaccttaacttgtgagcttcattgtatatttgcaatatattcagattgattcttctattctcttgcttgtcttctcgattcgcttgcaggagatagccttatcggcgaggtcaaccatgtttcgattcaggtgataaccaacggaggggtggtgtaatgattgtgaggggttagaacgtcctgttcggagcttttgtgttagcaacatcaagtctccacagtcggcttatccggtacctagtcctcattaagagctaaaaacatatacagcaaatattaaaacatcgtaagagatgcaagcacaactacaatattaatcaacttctgacacacaaaagcatatgaacgagcatcgaccattgtctctattcttccggtagatctttaaaccaatattatcaaataaaccattggcatgtactctaaagatgttacagccatctggaacatcaacaatccaataggtaagactctttaggtcttttattagggatggtgttgccatttggaacatcaacaatccaataggtaaactccttaggtcttttattggggatggtgttgtcgattgaaccattgataacccgataggcaagactctctagtgctttatcgtgggcatcgtggagaaagaaaagataaaatattttagacaaattaagtttttaataagcaccatgaaagacaaaacctaaacttttataataaaaaaaataaaaaccctaaaactgacttaagttaaagcaaagacgggatctcatttcccctcattgtcagtgttgatcccaggatggaggagaaggggatcacagttgaaaatttcatagagttcgacttgtcacatgtctcaaaattttgcatggcttattttgattttggtgagaactagccaaatttattgttgacgaataggctagatatatcttattaatatacaaccatgtatcatataaaccttttccatgtttaaattttataaaattttgtttcttatactttcatagttgttctttaatacatgttatattaacttaaacctctatatcgtgcatctaacatggtcaacattgatacgacatgctccattgaaattatgccagcatattacagtaaatgactaaaataaaaataagaattaacacatggattaattacttgcattttgcggactggtagactggtaatagtaccatgcctaccgtggttatgataaaatgagcaacttagggtttgctaatccggaccgggctcactttttgtgaagcctgcctccattgtgctcgagacccgactggcctacgagcgacagtgagaatttttccgtttcctagttattatacttcaatttgtgtgataacgggttagaatgatttattatgttacaccatcaaacaaaattaatagccaaatatataatttaatatcaattgcatcctctatacggtcttagttacaaaattaatagccaaatatataatttaaaaatcaattgcatcctctatacggtcttagtatcatgaaaatacaatctattaacttattaaaataataaaaagaagctccacgttcgctgtctggcctataaattctcatataaatcagagaaaaagaataacagagtccatataaaaatacaattaaaaaaagcttaatttcgaaattaaaaaataaggaatatttggaggaggagattatggcccatacatatatacaatttagagctaagtgaaattcgaaatcaaaaaataagaaaaaaaataaatataaatgttagagtccatataaaatacaatttagaaataaaaaataaaattaaaagaataaggaatattagaaaaagtgcctatagtacatatatgaatataatttaaaaataactgaaattcagaattaaaaaaaatattgaaagatgagtttagagtccatatacaaatacaattacaaataataaaaattcaatattagaaataaggtatattagatgaagagcgagtccatatagaaatctagaactaatcaaagttcagaattaaaaaaagagtagattttagagttcatatagaaatacaatttagaaaaaaaaataaaattcgaaaataaaaaaaaatagaagattgggagaagaatctatagtacatataggaatataataatataatagtaacgaaaattaaaattttttaaaaaataaatattagaagaatattatagagccatataggaatacaacttaaagataaccgaaattcagaattaaaaataaaggaatattaaaagaatggtgtaaagtatatatagaaatacaatttagaaataattaaaattagaacttaaaagataactactatctatcgcgtatatacaatacaataagaatattacacattgctaagtttgaagtttgctcagctaacacagaatttaaaattatattattattttaatatatcttttaatagaataagtaaatatgtatgctatcatacgaggaaaatgaaaattcaacctctgtaaagaagaacgtatctggacatgaaattgggtttttacaattttggacggaagatgcacacgcacaaggaccttaccacgtgaatcgaacggttaaaataacaaaaccgcccaaaacaaacaaacaaacagataaataatcagaagcacgcaaaatcataccacgtcataatctaatcaagcaaaaaaaaaagaaaaagaaaaaagaattccaccccgatcctcactactgtgtcactgactcactgtagcagcaacagcagcagagtgtgagtgctcatcaatccagcccatccccctgctgctgctgctgctgcttcgctgagacgacgagaggaagaagacgagcccccaagccaagcagacgcctcctccttcttaagcttcccaattctttctctttccctcctcctccgcctccgcctacgccttccccgctagtcccacacatccggcgaagattccggaagtttcgtcgatcctccgatcgatcaagcggcgagcggcgggaggcatggagaggtacgagctgctcaaggacatcggcgccgggaacttcggggtggcgcggctgatgcggaacaaggagaccaaggagctggtcgccatgaagtacatccctcggggcctcaaggcgagccttcttcgcttcttcttcttcttcttcttgtcccttttcgtccgctctgttttcctgatcgatcgatgggtgtggggcgttttttttgctcattcgggtggtgatctgatctctgcagattgacgagaatgtggcgagggagatcatcaaccaccggtcgctgcggcaccccaacatcatccgcttcaaggaggtgaggccgtggcggggggcaaattgggtgttcgcccctgttcgtcgcgtcggtggcgaagaatctgtttgtttttttttcttcttgtgtgtgtgtgtgatggaagaatcgtgccttgcgatgcaggtggtggtcacgccgacgcacctggcgatcgtgatggagtacgctgccggcggcgagttgttcgaccggatctgcaacgccgggaggttcagcgaggacgaggttcagcgatgctcgaatcgactctaatcaactccatttcttggtgagttcttgtgctaatccgcgtgagaatggtgggcttttgcaggccaggtatttcttccagcagctcatctgcggcgtgagctactgccacttcatggtaagaacagaaaaacgatcccagtaaacattgcattctttttttaaaaaaaaaaggatgggaaagtgttcaaatgtgaaattattattcgtgatggattcgcagcaaatttgccaccgggatttgaagctggagaacacgctgctggacggcagcccggcgccccgcctcaagatctgcgacttcggttactccaaggtagggagaaggccttctttaaccttttcttgaatacagtaatcttttccctcgaaacctgcctcaacacctcttttccctgcccggatttcttctagaaatggacaagcttttcttttttcccttgtcaaaaagcactctatttttaaatgatctatagtcgatttaattacctataaatatatattacactagtaatatttgatcttacctgttatacatacattttaatacatacattttaatatatgctacagctaactataaataaaatttatagccggttacttttctcttttatcatttatcttcggtttatagttacctagtctcaaaagatcaaaactttttcttcactgtttcaattcactcccccaagaaacgccattgcttgcaaacgttttcttctacaaatgctaaaaaaaaaaaaaactcctatgtgctttcttgcctaattttctcccccttttcttacgcgcaactgcctaaaagaagcaacattttcgctttgatcgcaacatgacgccttttttgtttcttctcctcgtcgcagtcgtcgctgctgcactcgaagcccaagtcgacggtcgggacgccggcgtacatcgcgccggaggtgctatcccgccgggagtacgacggcaaggtcagtcacgcccattcgcccatcacttccccttgtcatctgtggcatggtggtggggcccactggcagtggcggtagcgtggggcccacctgctcctggtcctcagcgctgagcacgtgccgtcccctgggagtccacgtatcgcggttctcaaggcaaacactaccttggaccgtagacccggcctatgggcgagctgggcagcatcggaaagtgggtcccatgtgtctgtgagtgttgggtctatgggctactatgggctagggtccatgggggggggggacaggtgcctctgggtggtggatttgggatttgtcctctaggagagcggtggagatttgcttgcctgcggccggacagacgcccactgggctgtgggcccgggattgtttttagcccgggcccacacactgcctcgtgattcgtgacagtagtagtactagtacatgctagacagtgtgtagtagtacgcgctaaacaggctgtgtgaaggggccctgagaccatatgctgctgactgtcactctcagttcagctgagtgtgttttgctcaaaaaaaatagaagaagaagaagaagaagaagaagcttgagtgtgtgtttcttgctgcagctgagctgagctgctactgtagtgcattagattcccagctaatgatgctccctccagtagtggtagtagaactccagtgttttttgttgaaaaatctcttctgtaaaagcaagggagggattattcaaaaggacaggttccttccttttgtgtgtgtgtgatgtcgatctagacattcacattctctctcggtttttttttcggtaatcaactaatcacacatcacgcttgatggggatgctcgcttcgacgaggcgtggcggctgctttaacagcacgccagacacaaaagaggagggggggagaaaagacgggttgatcgaattcgagacggttttagtggtcaagagtttgcaccctgtagcttgttacgtgcccccacttgttgctttattaaaatgtggtggcctgaggtaaagtgagattagccggtgatggcatgagattctccagggtacagatgcgagatattttgcttctcgcccgatttgggcagggttaaaagttcggattctttgtatgtttggttgtccagtgtgttttggcgagtgaagtaacggagtgtgattttgtctttagttacatgcaacgctaagaaaggaatgatttttcatcgtttgggattgaaatggaacagacgtgtagggattaggtgaattgtgacaggatccatgaggtagacgcacccctcagtctgtatttgcagttatgcatgtcattcggttggacagcttgcaatttttgttgacatctttttgggttcacctcatactttatgtccttttctgagcttttttttccatcatggttctagtgctacatattagctaattgacgttatcacaatgggccctcggacccaatccttttcaggtagacatgttagactgaacttctctttggccttttctgtggttattaattttctctctctccttggtgtcagttactgccgtcatatcttatgaacgattttcttcaggacagtgattgcattttgttccttccctatataatacatctactcaggctgcttagatttttcacgctgcaaaattggttgcttttgattgacaaagtggacactgccatagataatttgtagatggaatatcaagaaacattttatcatttgcatctagatgttctttttttacaaccataatgtgcccttgatttcaacaacctataatgcttatttccgagttatagagttatgtatttttcagctgatttgttcccgtcatctttagactgccctcaaccacctgttttttatttgaattaatgctggaataatctattgcataaagaaaaaaaaccactgttgtaccgctttccaaaagattactggatgcgtatgtcctataacagtcatggttgttagcctacttagccattaggtgagaaagcacaaagtgccccacagcaggtaaatgtctgtggggggaatatgtaattaccgaaggacatggatcctctgagatcatcttttctatgttctcatgataacgccaccaccctaataacgaatgtcaatacttatgcttaccataggtgtgttctgtcattacctgtttttatctttgctttagtacataagcgtagcactgatgcttgtctgccttttgaatttaggttcatggaagtgcacgtcatctttcctatcattcagtttattttgtacagaagttagcatccattgtgaacatagctgaaatttgcgtacttcggagagttttgatatttccacgcttctatttggaactttgagcgtactaaacataagtgacagcatgctgtgcagaaaataaaaggagccaatcaaatagatgtgctaaatggtgtaatagagcctttgatttttgtttcttggaccattttaaattacagagattattctgaaatgttttgatgatcgaaacaagcacgattaatgttctacaggctgttctgccttaatattctactagaaagaagtgtactttcatacatcctgttcttgcttgtatttatcctttcatttgtttctatcttatctcctgaattcatttacttgtctcctaacatttttggattggatggttgatgcttcagacagccgatgtgtggtcttgtggagtgactctttatgtgatgcttgttggtgcttacccctttgaggaccctgatgaccccaagaatttcagaaagaccattggggtaacaatttaagaacttttcagctaagcattatcagatcacaacttctagtctcttatgctttgtgcattttttgttctcagagaataatgtcaattcagtacaaaatacccgagtacgtccatgtatcccaggactgcaggcaactcctttctagaatttttgttgcaaaccctgcaaaggtactactctatttaaactcagatcaacttactagacctattcatgatttttttaaaaaaaaaatcattcccaaacttcatacagagaataacaataagggagatcaggaaccacccatggttcctgaagaacctgccaagagagctcacagaagctgcacaggcaatgtactacaagaaggataacagtgccccgacctactccgtccagtcggtcgaggagatcatgaagattgtcgaggaagcgcggacgccgcctcggtcctccacccccgtggccggctttggctggcaagaggaggatgagcaggaggacaacagcaagaagccagaggaagaacaggaggaagaggaagatgctgaggatgagtacgacaagcaggtgaaacaagtccatgccagtggtgagtttcagctcagctgagtatttctgtccagcagcacaggaagattgcaaactggagatattgtcataatgtggcagctgatggtcacactcccattctgtagtttgcagtcttgtttttcttttttcagtttcattttttcttttcttctctttgatgctgcaacagtgtaaattaccaaagtggttctgtcactgtctttgtaatgactgatttaagttagcatgcagaaacataatgtattgaataaaaccatctcattgagcatcttctttctcagagttgcagtccctctatccttgccatcctgttactgctattgtccatgtattcggttcatcgcttgggttgggacagagaggtgagattgcagctcttcagaaaggaaaattttgtcagtaaccggaatggtgaaattacaccctccttaagacaaacgaacaataatggattgtggaactaacaaaatggaccaatgtacatgatcaggggcataatgttgagtccaaggtgtacataggaaacataagtgacaataatagaaaatggaacaatgctttgctgaagaccaaatttagggggttggagtgtgcattgtagttaactgaacacagtttgccactcccactgatgtggttacattcagaatgtgacagcaagagaaaatcctaaacagaccaaagcaagaaccaacctcatcagggtattccgccatcaaaatctgcaacgcaatcggcaattccaccatcaaaatctctgtttgcacaaccaaatcttacacctgaatgatgattcgttcttctatacatatgctgacaatcagaaagtaaatacaatatgatagtgtaattccattttaatatacaatgtaacttctatataactttcatataatttggaaccgttagatttacttcaaagtttgtatgcatccgcatgggtgagatgatttggttccccccaccccccgacctccacctcgtggaaatagcgtcacaccgggagttttgaaaattacgtacaaattatgctgcagttacatacaagttatactacgattgtactatatttacatctgacaaatttagggaaaaaattatcggcaaatgtatagatagcccatgaaataattgcccagcgtaaccacgcctctaggctctagacgccacagcccacagctgcttgcttttgacggcgcttggttgattcttggtcgctaattagtcagggctgatgagtgatgagtgacgagacaagatacaggccaagcccagacagaggccaaagcacaaaccctccagcaaaatttggccaaaataatttgaaatttgaatagcccgataaattttgctaaccactagtaaaagaaaaacattttggtatcatcgtgtcgaccgcatgccactatcttctgtgagatataatagccactgggaatttacatcgcttattatttaaagaataattaacaataaatacaagcatatgagttaaaccttgtaggttccatagttccattcattaaccagctgagctcagttcaccacctgcgaaggaaaattgattaaaagtggataagaaaatatgtgattttgtttgggaaaaagaagaagaagaaaagaccagtgatttgcagcgacagcctagacctgtaatcatttaccgaatacaaaagcctcacagctagcagcattgttcttcgatcgatcagtgcgatgaattagtatctccgcatataattaactaacaggtatacacacattcacacaggaattgacagatcaagatgctcgaacaaaaaatgtacaaatctgacccacagatacctcattgttcaatctaatttttttttccatcgattcgatctcctttccaaatcaataaacctccacaggagtagtactcctatacccaatccaagagggcaatgtgtccatcgaaagcaacacgcgtttgtttgatgctgccctagaaattatcaggagctccatttcctgtcactgattctcgtcagagcaaaacgcagagagctgattaaccaagtcgctgtcgcgtgcttgattccacactgggatatcccagatcgagctgccgatcgatcgatcgtttctgcaagcgagaagccaatcaagaaaaagcttcacgcgaacgcatgcatcgatcgacagcgacaagaaccgtgggactttggagagaaatcacgggcgaaagcgatggatcgaaaattcgaaatatcgaatcgaatcaaaagccggcgatgccggataattctatttgcatcgtctcgttgatagctgctcatcaattgctaagaagctagcttggcatgtggtgcattttcatgtccacctgccaaaatggaatctcccatttggggggtgtttggactcatgcagtgtctgaaactctgaatgcgacctgcgttttctgaaactctgaatgtgacctgaactttttgtccactccttggagaaagaggatggaaatatacgttccttacattgacctgaaaaactctgaattctgagagattgcagaacaagtaattaagcagagtttggtgagattcgatggaaaacatggagcaaaagaacatctttaattgctcggtcatcggaggtaaaaaaacaattcgcatctggttagcgtcgtctggatctggccggggtgagggaattcagcgttcctgcctgtggaatttggaagagtctttgctcctgaatttaagaattccggccaagatttggagcatcttgaataagtcaaaaaagatagttcttgtgaatcgagtgctagtttcacacgtactggttgatcacaaagagaaatcgtacgtgtcgctattcttcaaaagacatagaacggtggatgaatgggcacgcttctcgagcttctaacaatgctgtttcttataagaaccttgcatttatgaatttattagaaatattgttgaaatccattttcaactttataatattcaatttcattcttatgtacttgctctgttccaaaataactcaaactatagggatgaattatatattttggaaaagagggagtacactcggataattatcccaaaccattggactattcaaccatttagtacaaaaaatatattttagtgtcagttacttatgttgttttttcaccttaattatcagctgagctggcgcctagtccaccatggcttttcttttacatgtttgcatgcaaatatggacttttatcgtagtacttcttttaaagtttcaacatgattttgcgtttcgaaatggctgtatggtttacacctttctacacgcaaaagaacacgattttaatgctagggtgaatcatggtgtcgatctgggggaccgaattcctattgtttttcagtacggatcatcctgtttccttttctttttcagatgctatgaagaagaagcaaattagtatgtctcatccatagaattatatcgattctcattcacacgcatgaacgatcgatgctaattgagaaagtcagatcgaagtgggggccattgtgcagatgattaattctaagtagatcactgtctatgatgatctctatcctctatcctcacactgttcataaaaggagattaaaagtgattaattaactttgctcggaagagatcggcacaaatggcagcatttcaacaatgctatctgcccagcaaatctttattaggtgcagaccaacagtttggtgaaccactcctgcatggtgcctacttgtcctactatatgtgtattatctcctttctaaatgcatgtgttgacgcctttttgtaaattcttgatgattttacctttgcagttaaggtaacttccttgcattgtcagtgttgaaatgtgattggagtactacaaagtaactgctagatcagcttgtttactgtatgtctgaatctaagaatctaaggctgtgtttagttggatccaaagtttagattttggttgaaattggagatgatgtgactgaaaagttgtgtgtgtatgacaggttgatgtgatggaaaaggactgaagtttggatccaaactttggatctaaacacggcctaagatatgaaactcagtttgattttgacttagcatgaggtcaattggacagtaggaactttactgttctgtaggagaaaaaaaagataaaagaaaattttcaggatacaattaagctagctttaactctgaggattacttagttagctgatcatgcatatatctaactatgtattaactgaaaattatcatgccttgcttattattatgtactcatgtgtatataattcttttcaatctagtaaatctagtatacatgtatgaactatcaaagtataagagaataagaacaaaattgaatttgaatcaagcatcgcaaatcaagaataaatgaacaaaaactaattagaggcgatcctaagaaataggagaatgaactcatagacgatctctttttttttgtatgtatgtatgaactattaaatttcctgtactgtatatgtttgagattttctctgctgctgtcaccgacatcgccgccgccgccgtcgccgccgccacaaggtcgccgtagccagagccatgtcacgccacgccagcgacatggccatgccgccgtcgccctccacgacgcggaacccgccgccgccgcagccgctcttcatcttgagcagcagcttcgcctggctcaccgtcctcgagctcagcttcacgccgtcgagcccggcgccctccatggccgccttccagttccagctagctgctgcgtgatcgccgccgccgccgccgccgccatggcggcggcggtgttggtggtctagcgaggccacggcgtcggcgatctccctcccgaggtggtccctctcgatggcgagcctctcggcgctgtccgccgggaggcactcgtggagcgagtcgaacacggcggcgaagtatcggaggttggcggcgaaccgcgggagcaagctcgcgcttcttcctgtagtggtgttgtcgccgccggtgagcccgccgccgccgtcgtgtttctcgatcaagaacaccatggacgggttcagggagttgatgtaagccattcttgtggcggcgcacgcttctcttgagctcgccgggaacaccaggttgacgaccaccgtcgcgtcgtcgtcgatcctggtgcaatcatggcgggtgttcgatccgttgttcaggatgccctcgaactcgaaccgtaggttggggcagccggcggcgaaccgccggagccgcgcctcggtttcccgtagctcgtcggcgctcgcgccgaagccggtgatccgcagggacaccggaccgtcgccgcagccgcctccgttgtcgtcgtcgtcgtgggatgaactgctggtggcggcggcggcggcgtccgacagggactggatcagcgaaggccactggaacccgtacgagacgtcgaagtgacgacgtggaggcgg

SEQ ID NO: 66081 - DNA, 1749 bp, Oryza sativa
gcatacattttgattcggtacttagcattatcaagatatctaaacaggaatattttgcacacaactaattacatagatctggcaacataaatccaattaattcatttcacaataatgtagtcaatgtcactgaacatatgtcattaacctgttcagattgtctagcagatgctaccacggtttatcaaataactgcatgtttgatcagaacttcaataatcatcagtgggaactaattttgtttcttgtacagaaataaacatggaatttagatggtggtaccggtgcttttcatcgaacacatggtgtatatagctctaacagagagcaagccatccagttttatttaaccctagttgatctaactctcagaaataagcatcaggaattttagagagaaggtacacaaactgtagagaggaatcctttggttgaaatgtcgattcctgtgacctgccctcaccaagcgcaggcgaaaaggatggggtggtttggatcttcgagtctgcagattccacaactcaagaaataggggagagagtctagagagatggccagatgagggggagagccatggccggaggccctgcgcggctgagcagttgagaatgcgatcttggaggaggcgatggaggagtgctctggtgagagatagtggggagcagaagactgactaactgattccaggttgaatggggattatatagggagcttattcgttgagagagatgtggagagagattagcaggtttgttactctaatgttgcggtactacttggagggaaaattgagtttggcgggaagtatttggaggcaaactacgcatgaaaaaactcaaggaatttccttattgaaaaaaaaagatacatctcaatttttttacaaaattggttaattactacattagtaattttgtaccttactgataaaaattaaggaaattccttatgtgattaacgtgatcccctaatgactgtgtccctctgctagctctcccttcatttttattcagcagaataatattattttaaaagggtatctatatcatataatatgaaactaatggttcttttttttcctattctttttacccgattgttttttttcatatcatataatacaaaactaaggggagccatgcattgtacggacaaatatgcttttagtttatcacatttcttaataacaccgagcctctaattagtaggtacggtccaacgtttattattggtcaaacttgatttatagggtccgatgctaggagaatttgtagtgttaacgtgtcgagtgcggctttctaaagatagaactaacagcgacgcgtcgctctcgggctctctactgttggtgttgccggcggctggctttctaaagacaaagactaatggtgatgcgttgttctcgggctctcagctgttggtgttgccgtcgcagccgccggggagggcagcagcatagatctccttgtggagcttcacgcacaacatcccttacaaatagacgaattttaatgctcatgtcctaaaatataagtatttttgtactccgacaaagtcttcgagatgcatgctattttcacattatatttataaaaataaaatattttaaataaaaaagttacatattaagatagtttgattaatgataaatctagtaacctcaattttacatgattatattattatttttttctattaatagtcaaagttaaaaatggtgactgtacattaggctaaaaatgtctatat

SEQ ID NO: 66082 - DNA, 1661 bp, Oryza sativa
cctaaggcagtcaagtgcatatgacggcaggttagcaaattgttaagcactaagtttttctatgcacaccaagtgtttgtcatttttcttgtacgcagatggcatcttaaaactttaccctgcatcttattgtttcaatttttaatctagctcacagaaactcttatattaaccatataatttaatctgtacaaccaaaaatattggctcatagtgcagtttaattcctcaattatcatgtaaagtccttaattctttattctgattgcttttgtcaatcccatctgcagcaatgtctgatccactcatgtactgctttgctatttttctgatctagccagtagataagatggtcgttttcgtttggttcaattaaacaagcatcagggctgcatcgacgctgtatctactggatcctaatcctaagcttccaggtacagttaacctcacctacacatgttcggtagacaaatttcttttggcttgaaggcataattatagaatcaaaaatatttagtggttgttgtcaaattaggaacactcatgtattaactatatttcttattttaacacagaaaattgatggatttgaataatattaagaagttattgcttttccctagaccaagtgatgagtaccttgctggaatagatggttttcttctgtttgcatatagggaaaagagtcttgaagataagatccgatgtccatgtaaggagtgtgtcaacaagtggttattaacgcgggatgaagtgtatgatcatttagtatgtcatggaatgttacttgggtatagtccatggggttgtcatggtgagaaccacatcattcatctctgccaacagtaggggaacatgagtcagcaaagtacgaggaatggatggtacacatgcgccaactagtgcaagatgcttttgggaacacaaacaatgaccctccagtgaatgaatatgatgtacaaaattttttaaacagtgggccagaccatgaaacaaaagcattctatgacttgctccgagatgctcatgaccctttgtgggaagggtgtgaacttacaaggctgtcatttctagttctcttgtttcacataaaatcagttaacaagtggagtaataaatcattaaatgatttgctagcaatcttgcaacaagcaattccaaatggtaagaatttacctggaacatttgctgaagctaagaagataataggaaagcttggacttaattatgtcaaaattcatgtttgtccaaataactgccagctttataggaaagctaaggcaaacgatgacttttgttcaaaatgtggtacttcaaggtggaaaaacaaagaagataaaactactttaacaaagaaggaaaggagaagggcaaccccaaggaaagtgttaaggtacttcccaattaagccaaggcttaagaggttatttatgcacaaggaaacagctatagcattaagatggcatgatgagggtcgtacaaaggatggtgtgttgcgtcatccagctgactcagaggcttggaagtccattgactctaggaatccccagtttgcatcggattctcgaaacattaggtttgcaatggctagtgatggatttaatccttttgggacattgagttcaacttatagttgttggccagttgtcttgtattccata

SEQ ID NO: 66083 - DNA, 611 bp, Oryza sativa
ttgtaataggaaggatcacatccttatttagattgagttttttaagacggagggagtaggaaatatgttagctatgtcactcaaaagtaagtcttcacccatagatcatgaaattaaataaggtggatcttgaggagtatatatatggtgctgaagctagcatcgatcgatcaatcttggcaacaccatctatcatatccgatccatgttgattccttcctgatataatatgaatggaagtcatcaggaaccaaggcataacatttcttcagtgaaagagagttcgttcattgcgtaattcatcgagaaaagtttagaccacaacatcgactacaacttttgagtgaccttgttaaatagataatgagcaaaatcgtcaaaatgtgtcaatcgtcagagtgaacaaacaactgcagggtgttgcattgcacaccagcaaaagagtgacatttatctgtcatgcattgctactacactcatgcactgtcagtcttcagtgccagtctgtgatactcaagacttctgcgggcatatgccaatctacagtgtcagtctgtgcagtgtgcactagctaatttcaagttccccttgtaagaatcatctatgaaaat

SEQ ID NO: 66084 - DNA, 1540 bp, Oryza sativa
ctagctagtcaaacaactacatgcatcgtgcatggatattacttcccgacgacaactattgtaaaagtctgatcttaagttcaaaccacgtgagctgaccgcatgatcaacgcattatgcggataccttaattaagttcccaagtcaatcaaattgagggtacaagacgaaattgattcccccacacacttgctccttcttccacttccatcctgccctatataatatatatatatatatatatatatatatatatatatatatatatacttagtactgtacgtactaaaccggggattgatcaggagagtgcagtgcaaactcgcagtgaacctgtgtgatcgatcggccatggagtcgctgctcgcagccggtgcgggagggatcggcgtggctgcggcggccgccgtcgtggcggcgaccctcgccgtggtgccgcccaaggaccgcggcaacaacccgcctccaggtaaccggcccgtttcgtcgatcgttcgatcattcagatcaattgccgtgttttgccatccgcttccctgtggttatctacctactccctccattataaaatatagagatttttagagtttgatacagatattaaaaaagtaagttgaattaaatgggagaaggttgtggttggttgagaagtggaagtagatgagaaaattaaatggtggagagatgtgattggttgaaaagagaatgttagtggagaaattgttatatattgggacaaacttttaagagttaaaagttattatagttaaaagttattatattttgggacggagggagtatatatctatcttcattgaattgttggagatggcatgtagccgatgaccttagttagccatgaaaaatattagctagccatgaaaatggagggatagtttcggtttgctatagagaaaaacgaatactgatatagttcaaaacggataattattgaatagttagaaacatttttttcctcggatgtgaatacgaatattgtatagaattttagacggataagatattcagtgaacagtgatattcgcatattcgctcaagacataaaacatacaccatttctctctaactcaccttcaatatacctctttagattttaattgtagcacatctcatgacacaagtctacacaactaatattatttaaattttaaaatatttttataaaatatgctatattttatatattataatatcagttatatatgtatttttaccaatgttgttattcatgcatgtcgaacttaattagcaatatttaatctatgatcaacctttttataaaaaataactaattatgtgtgatggtgtttgtttctattaaaagtagtttaggtggtttttgtgtttccagaaatatttgttttgtattcgtgtctgtttatatttgatccttatttgcattagagataattttgtttttctttcatatccaacctattcggttttgtatatggtaaaaaaataaaaaaatggtatgagcattttccgttcatatccgctctattttcatcccaaaatt

SEQ ID NO: 66085 - DNA, 599 bp, Oryza sativa
agctcgtagtcccgccagtacaaggtcaggtcaacctccgctaacacggcgtcacgccagctcgacttttgttcccgtcgtgccagccggcctcaagctcaagctcgatagatgtccgctagcgttgtccctggcttgatctcgacttccgcccacactcacacgccattccctagcttaatttcgatctctgccgctgtcgtcccctggctcgacctcgacttccacctgctctcacacgcacgcatttccctgtctcgatttcaatctccgatgtcgtcatgccccgtcttgaccacgaactcccccatgcccgcacgccacccccggccttgacctccgccgtgtctccccccactcaacgtcgacctccaggctccagcaacacccacacgctgtccttgagctcgagctcctctccaccacccggcttcggcttgacctacgcggctctgtcgtgcctacgtgctgtcctcgagctcgagctcttctccacggccgtcgctgctctctagctcgactacgtccatacctacgcccgcacgtcgtctccgagctagagctcctctccctgtcgtcgcaccccgctcgacctcgat

SEQ ID NO: 66086 - DNA, 2549 bp, Oryza sativa
agagctgcgacagacatagccgtggagacataaaacttgaggacctacagtatcaattatcaaatcggcatcgaggacatgagcaggtaacggttttggatacatggctgaggcgagaaattccatgctactccctcgttccctaaatgttgacttttttaaatatgtttgaccgttcgttttattcaaaaacttttatgaaatatgtaaaactatatgtatatataaaaatatatttaacaatgaatcaaatgataggaaaagaattaataattatttaaatttttttaataagacgaacagacaaacatgtttaaaaaagttaatggcgttaaatattttgggatggagggagtagtagcttatatcgtttcagcatccgtttggctttgctatgtacgaaaatgaaaaaaactggggaagcttgaataagcagtgtcagaacattgttatgacagatgaaccagatcaattaatctggaaacatacaatgaatgggatttttacagttaaatctttctattgaactctgatcgtacagaacactggttttagatttcaaaagagatatggaagtttaagatcccaccgagagttaaagtttttatttggttgatattaaaaaaatagcattctaaccgaagacaatcttttaaaaagtggacggataggaaaaacatagtattctgatagaaatataagtgtaaaacagagaattttaaaacacatgaaaaacataagaatgatcatttgattgggccatagaaaagacacaggaatttaaggagagataaagactcaaaaagattttttccatgaggatatacctcatgttaaatttccttcaaaacttgcatgtgaagagacatttcttataaactaggaaggtagcccgcgcatttgcgcgggcatgtttttatttcgtttcgaaaacatgtctaacaaaataagtttaaattaaagtgaggtgtttcccttcttaattgaatgttcattgtattttttctttaaaaatcttgagaaactttaattgctcataaatatatattttttactaacctgctatcacctttttaaattgaccaaatatacatatgtaagatagtgattcttatgcgtaggatcctacagtatttttaagaaaaataccaagttaatatgagtcttaaaataaaaattagtaggaaatttctaatcatatcgttatacgaaatgcttattgattttgtattgacaccttagaggcatttacatgcaggtcgtggaatttagtgtattcgtttaattatcattgaccttcatctcctgatgtgtcaaagtgaaatatgacttgtatgtagagaagaaaaaaagtttaaaagaataaaatatcgttaggatgtaaaatgaacttttttttcctctgtaaccaatggaatagattgattcaatactacttttgcgggttaagtgctccactaaaatagttcactgtgtaaaagcttcgactctaccttctgggttaagtactccactaaagtagttatatgtaaacacattacaaaagttatttctaaaggtagcccatgagtccgaggcaaaaggctcatcacataggaggctgcacatttgaggaacatgagaacaatattctcgcggaaatcatttgtttagaatgtgatgaacataattgtatattcaattaaaaacgttagaaaagtggcttaaagttgtcatttcacattgattggttatgaaaataatggtatatataaatctttgtgccgatatcattgtttgccaacaatcaacgaacttgatagttacttttggtgttccttttggtatgtagcaaattggctacatattttacaacttactgtatcctttgctgagatgcacttgcttttttttctctgtatacttgattgtctcattgtttattaatggatgccttcggtccatgtgacacaatatatatttcaaataaaaagccttctcgagtctaaattgattttgcagcgtaggagatagtttattgtttcgtgtagagtgtgtgagactccatgtagcttagcaggaacataattttcattgcgaaaaataactccgcatgtgtgattattatgtagtgtggtatgattgttgtcatgatttaaatatttttactctaaaatttatgattaaacattaggattttacataatgcaaacaatcactttgtgattttatcttagctaacatgcattaggcctttagtgattatgtttatattgcataatcctaaatatgaagcctacaatgcttatcctattttatctttgttgtttgaaagaattagccatttatacaaccattgtagtttaaatactaaatagtttttaacttttaagtttctaaaataattggtagataaagcttttagctcggtcatgcatgatacatacatgtagtcccaagctaatttgccccctcacgctgacagtgtcctgagtaatgtcgatgggggcaaaattgtgaccgatcaaagtcttaatttttttcagttcaagaaaaaaaaatgaatctca

SEQ ID NO: 66087 - DNA, 1442 bp, Oryza sativa
aaatatatgattttattgaagtactttttaagactaatatatatatatatatatatatatatatatatatatggttttcattttttaagataaatattttagaaattatttatagtcaaagattttaaggtttgattttatccttatttaaagcgactaatatcatcagctcggagggagtatgtaattttcaaaaatccctaggtgatgtgctacttatgtgaaaacggaggtaatggtactgaatcgcctcacatgtgagtgggttgtgattttttcctacatcccttgcgaattttaaagcaaatcgaacggttcaaatttatatcgtagttatatgtaagttacaatgtaattacactacaattatactatatttacatctgccaaaaccactaaccacctcctccatttatattactccctctgtcccaaaatataagcatttttagaacagtgctaagtcaaactttttaaaaaagattaatcatgtaaatttaattttattatatttatcattaaacgaactatcataatatgcaactctttttatttaagacattttacttttgtagatattgttgattaaagtatcatctcggagatcgtgtacatgtaaaaaaaatacttatgttttagaacggcggagtacttgtttgtgcacaataggtgtgctgtcgcagccgtgagtgctgttatagctcaaatcctgttatctacgccaaactgatcattcatgctcatttctaattgttgcgacaccagaaattaccattccatcaaaaaaaaaaagcttacgcactagctgaaacagagaaaattcgacatattttccgacgaacaaactaaccacatacactgccatctccaacagagatcaatcaatggagagagtacgacgaacaccgagacacagcagcagtgaggatcaaaccaattggagaagatcatttgatcgatcgaaacgaacacggcgagctggattaattaattacctggaggcgggttggcgcggttcttgcgcggcggcggcgccgcgacgagcttgtcggcgagcgcggccgccgcgacgaggcccccgacggccgccaccgccgccgcgcccgctccggctacgagcatcgactccatggcacacgatctgatcacacgcactctttaattaatcccggctttcttatttatagaggccgcagcacgtcgaagagcgaggaaataagaaagggcggcgtcgtcgctgtaccaacttgaagtcttttttgttgctttttggctgcgttcgaccgtttgttgctagaagaaagagagaggtttcgctccctttccacgtgagtactcccttaaacaacctctgatagattttttattggacggagggagtagtaatcatcatttttcttttataattttttctataaataaattacactaattttgttttt

SEQ ID NO: 66088 - DNA, 3806 bp, Oryza sativa
gttgagacaatttgcatattgttttccccttgccaatcagtgggtgaaactgcgcaactgtagccatagtattccaatagtgtttagcatgaactttcgacaaaattaaaaagttgagtactttttgagagtaaggaactccatgaatgtatctttaatgcttggtatgtataagttttaaaggattggaagcaatcaggattgagactatgacatgatctaatatgaattccctggaatctcgacgacagtgccatgtgtgtttgtattttagctcctatttgtgggttgcagataaatgcttgggctttcctcaattgtcagttagtcctgaaacataagaactgtacttggagcatctaaaatcgtgttgcttgtagtgcaacatccaatacaaattacttgtaggatctgtaagatcaatgtgtgttttgattcttattccgtgataaacaattagcatctgtgattattggttttgatatttggagattatcgtcaaagtggttttggagatgatcggatttactgttattttatgtgaccggtccgaccgggttgtgtatgccggtcagaccggcggtgatcgagcggtcagaccggccggcccgcagtctgaccggccgacgctgtgtcggcttcggtttcgggttgtttctttggatatccgtgattgtttcatggttatggcttctagatggatattatacgtatgtaatactgttgtttgctactaatgagtcaagttggtgatagcttggtctcggaatatagtttctttgtttgtttcatccataggtgactcgatgcctcgggagagtatttacggtgatggaccggaagtcggcttggtggtaagacgacgtccgtggtagtcagatatcatgtgggatactaaggctagagttgatgcatgtggttgatggagattccatatggcatacgatggaggtattgtgtgcgtatgggatgcggagtcaaatttggaaggagtccaaatttagtatgattggaaggagtctaaggtgtataggactcttagtatgagtttggtttgtggctttaggctgcctacctcatgtataaatagagggggagcgtgagtcttcccggtatcgcttttgtatcgcttttgagagcaattgagttgctagtttagctagggtttcgagtttagtcgagatttttataaggagtgctgtcggtgcactttttaaacacagagagaagcaataaatttgtcatctactttaagagttcttcgatttgtgtttcaccgggttttggcggtctaaccggcatctcaccggcggtcagacctattggtggtcagaccggcggcggcgacaggagctggcgattgatctcggcggttcgaccggtgttacaacctcggttagaccgacgatatccaggcggtcagaccggcgctactacttcggtcagaccgtgatccatcgatttcgagggtaacttttatttccgctaaaagtttttggtttttgggtataccaaccattcacccccctctggttggcttagttcttgtgattcgaccctacaagtggtatgagagccacgtttgctcttttcgatctttatcaatcttgagtttttgccatggctacttctaataagttttcaactaagcctcatgttatcgatggaacggatttttctcattggtgtagtaggatgcaatcttacattatagcttagaattatgatatttttggctcctcctcccatccaagccctactctttttcttggtagctaatctcgctaaaccattattgtgctcctcgtttaggaattaattaccaactactacaaaacatggtactttgtttctacactgcggaaacacgtgatctagctcattgtgtgacaaggcatagaagattgaaatgaaacaagtgaaataataataaaagaagtcatgcatgcataattcgctggaattttcaaaagcaaaggaagtcgaaattaaacgatgtatttttttatcaagtgaacagagcagttgaaaacagggtagtgagtcttggcaattgcattagtatgagaatacgacagcaacaaagaaaacccggtactttctctgtttgctgaccttgctaacaaaataattaattcagaacatactttcattgatatctcatcccttttttgctaaatctttcagacagcagtaattgtaaaataaaataccagatatcatgagctactaatgttagtcagattatgatcaaatattaatttaagagagtctagctatacttgaattattattaatatatattttgcagtacagttcacaattttcagttgtgggatagcattttccagaatttggagacattaaacttttgtatgtttttacctttacaattacaaaattgctctggttccagtagaattcgagcagaactcaatttctgctttaagtattttgttacaatgtgattgcttcttctgattgtgagaaatccaactgatcatttaactcacatagttgaggaagtcacatactgtactgcatgttgttgcaaaagctcaacaagtgtatcaatattccttctgtattcgatctgccccaaatgagagcggtttttacatatttatacaggagtatacaaggggaaatggctttaatgcccctagtcctatgaggaatctgagtggctggccagtgggccaccctcggacctattggtaatcttacaggtgagagggaggaagcgcccataggggaggcagcgctggttcccgagggaacctgttattacacggataaaggcatgccccgggtaatagcgtgctccgcttggtcgtcattaatggtgtcagaggcagttggggcgcgtagtgcgcatttattccagcccactcgcgcctggttcctgactttagccagtggaagcacatcaagtgcttgaatcgctccgggcggcctcttgaactctgggggcctcccaagctccgaagcctctggcagcctccggagctcccttgccgggctccaaaagcccttcacgctctggagctcgagatgccttctggggctctagggcccatgggtgctatggcctcctggagcaatcccggagcccttccgccgatctccgaagcccttccaggctctatcgcactcgccgtccgcgggatccgattctctaggatccctggaggccttcggagcggccacctcggccagggaccgacatggccttgacctgtaaaatcaaaggtgttttgattattattctgtgatgaacaattgggcattggagattattggttttattatttcgaatttactcacgaagtggttttggagaggattggatttacaggtgaatcgcaggatctatcattttatgtgaccagtcagaccgggctctggtagccggtcaaaccggcgtgtattgcgcggtcagaccggcgcagcccgcggtctgaccggccgatgctatgtcagtttcggtttcgggttgtttatttggatatccgtaattattacatgattatgacttctagatggatactatacgtatgtaatactgttgtttgctactaatgagtcaagttggagattgcttggtctcggaatatggtttctttgtttatttcatgtgtaggtgacttgatgcctcgggagagtatttgcggtgatggaccgggagtcggcttggtggtaagacgacgaccgtggtggtcaaagatcatgcaggatacttaggctagagttgatgcacgtggttgatggagattccatatggtatacgatggagttattgtgtg

SEQ ID NO: 66089 - DNA, 1844 bp, Oryza sativa
gtcattgtttggtagggccatgtacacatacgcttgcacattcattaatttgcgtttaatttcttctgtactccttgggagccacatgtagtaggtaggtattcatcgcgcggtcagctcacgtgctttgaaattaagaccagcctttatgccaagtaatacccatatgcaagtacacctgattttcgagtttcgactaattacttttgctgttctcctcgttattaatacccacttggtaattgctaaatatcgacttaaaagatttttcaatgtaactgtggtgtaatattgatatcacgacagtgtaattacactataactatatacctttatatatatataacttactataaagtgacatgcattttaatacttatatatatacaagttacataaaatttttagtgtagttatagtatagttatattggaattacactatagtagttatatttgaaagttttcactcaaagaatttacgtcagttctttatctagtgtcgaccatattagtttgccttaaaaaataaacacagaagttataaattagtccgaccatgatagttttcattaaggcccgatcaatttttaataataaaaacagtatctctgtcaatataaacacggtcaagaattttaaaaagataataaaaagatacgaagttatgtgacaaatccttatctccttcctgacaacaatatgcagactaaaataccgaatagaaaacacatatattttataataatattatataggaactacgccattcaaaataaaactaagatatgaccattggaacgggttaattaaaagttatataactgtaaagtgagcataactcaattgtttagatttcttatggtgaaacttgcctacccaaattcaagttttagacgtggcacatgtgctcgtattaatggctaatagcatagtatcgataaagtttcctggtcctcctcctcctcttgcctagggtcatggcgagggaggaagcggtcattgcgatcaaaatcagaacttcatagttcacacaatatgggggaatttgaaactccgttacttgtcttcgttgcttgtccgtggtggatttgaaaccccgagatccttggccatcggatttggcaccgcttgagcgcttcctcgtcaccgtcccgaagtgggaggaatgacactgatgaccatctccatcctttctttatctccgctctctcaactccgatatgatagtgggatagcagatgatgtcccttttcttttatttattcataatcagtactggcgtcttaaaaagtgaaaaaaaaacttcgcaacataaatttccaatcagagaactaagatttttagtatttgtccgattttttctagaattttctatggcatttgctatttgatatgcatggagtgtgtacgagaagtttatgtacataggatatatatttccttctaatcatccttttcgcgaactaaacacacccttagccaatagccaaatagccaaatagccaaaaggctgagaaagatattccttctaatcatccttagtttatcttaattagcgcaagatcgtacagtggacaatatgcggaggcttctttgcaaaaaaggctgacatgaagcggtgaatttccagcgatctacgcggtgtttaattagagaggttaatattcagttaccggtcatggtaaaaccgcaatgcttaattttttttggggagaataaccactatggtccctgaagtttcgctttaagatcattttagtcctttacctttcaaattgtccaagcaagcccttaaactttatcatgtagacatatacagtccttagcccatcaaaaattgcc

SEQ ID NO: 66090 - DNA, 820 bp, Oryza sativa
catttaatatcctttctcatctttctgtgattgccaatcagatttatctttagcaaaaaattagagtctgataacctgtaacatcaagagcgacatgcataagagctacatgtaatcctactgccattgagtgctacaaaattttcaagaaactcactcagttattgagttcgtcgccatgccgggctgtctggccgcaccatcctgggggttgctgcccgtgcctacctgggtactggccatcagcgtggccgtgggctggctgcccatgccgccggggctggctaactgcgcccgcctaggactagccggccgagcaagcctggagctggccactcgtgctggcagggtgctggcctcctgcgacggcctggcctcccgtgccgccggtccatgtcctcctgcgggcctgagggctggccatctgggggcacccgccagcgccactcccttcaggggcgcgcctggggcagccgtgccacctggagggatggcatccgtgccgcctgaggattcgtcgtcctcgccgcccgggggtcaccatccacgctgccggccataggggcggcgatctagggtttgcagcggcgtggagtcgaggcacgggtcagggatacgaagcacggggagagggtagttttgtcttccttccgtggggccatgtttgtttttacagtagagactaatgggagtaacaaaaaatttgagggttgtatagttagggaacttttgaagtttgggtgctagagagggaagagtatttttttttatgctacatagggaattttctcattttccgaagggcaagcaaacaagtcac

SEQ ID NO: 66091 - DNA, 12462 bp, Oryza sativa
ttttgtaaggagtgctgttggtgcactttgtaaacacagagagaagtaataaagtcgtcatctactttaagagttcttcgatttgtgtttcaccgggtttcggcggtccaaccggctacataccggcggttagacaggcggcatcgcggcggtcaaaccggcgggaatacggcggtcagaccggcgtcgacaggagtctgcggcaggcgatctcggtggttcgaccggagttagatcttggtcagaccgacgttcatcaagcggtcagaccggcgcattcacttcggtcataccgcgatctgtcgaattcgagggtaacttttatttccgctaaaagtttttgggtataccaatcattcacccccctctggttggcttagttcttgctattcgatcctacacgacccacagtcatctccttgggaggatggttctccggagtgccgcagcccttcggaggctggcttccctcgatccggagacactccccaaacaatgcacataataagcatcttagttcactatgtacctttagaggagctagctactcatatatactcagctctgaagatgcagttgagacaatttgcatattgttttccccttgccattcagtgtgtgaaactgcgcaactgcagccatagtattccaatagtgtttagcatgaaacattcgacaaaattaaaaagttgagtactgattgagagtaaggaactccatgaatgtatctttaatgattggtatgtataagttttataggattggaactaatcaggacatgatctaatgcgaattccctggaatctcgacgacagtgccatatgtttatattttagctcctattttgtgggttgcagataaatgctggggctttcctcaactgtcagttagtcctgaaacataagaatagtacttgggacatctaaaatcgtgttgcttgtagtgcaacatccaatacaattactcagctccattaacaatgaactccgaacagagcctttggatgttaagccatgcaggaatgtcctagctaggaaaagttaccaccaatctgtaaaatcaaagtgtgtttgatttttattctgtgatgaacaattggcaaatgagattattggttttgatatttggagattattggcgaagtggttttggagatgattggatttacaggtgatgaacaaggactgctgattgtcgggtccggtcagaccgggcagtagttgccggtcagaccgacgtgctttgagtggtcagactggtcagcccacggtctgaccggccgactctatatcagtttcggtatcaggttgtttcattggatatctgttgataatttgtgtttatgactttgttaacagtgaaatttgtgtatgtaatactgttgtttgctaatgaaggagtcaagttggagatagcttgtgctcggaatatgttttattggttgatgcatgtgtaggttgtcttgttgcctcgggagagtgttgccagtgatggatcgagagtcaacttgaggataagatgacgtccggatggttacatattatgcgggatacttacactaaagatcaatgcatgtggttggtgaagattccatatggcatatgatggaggtattatgtgcgtataggatgcggagttgaatttggaagaattccaaatttggtacaattggagtttgtaaagttagtttcttggacgggaaggtttcctagggtattaggacttcttgtacaagtttagttcgtggctttaggctgcctacctcaggtatatagagagagggaaggtgtggcctcccggtaccgctttagagagcattgagttgagagaatagttaggatttcgagtttagtcgagattttcgtgaggagtgttgttgttgtactttataaacccagagagaagtaataaagttgtcatctactttgagagatcttcgatttgtgtttgctcgagttcggcagttcaaccaacgggataccagcgttcagaccggcggcaacgcaccggtcagatcagcgggagagcggcagttagaccgatggcagatcaggcgactacgacttctttagggaggttagaccgggtggtctactcctgtcagaccgacgacatcggcttggtcagaccagcggatcaacttcggttagactgattgacatcgattcgaggataacttttaattctggtaaaagttttgattttggggtattacaaccattcacctcctctggttggcttagttcttcctgttcgatcctacacaatcagctaatccattctgctccttaagaagtgcaattataatttgttaacatatatatgcttaagatttatatatggttcgatggtcttaccaatgcaacagccaagcaatttggcatgctactaagctcaactcagcggtacgaatgccaattccacaactgcaaaatcgtaacaatctcgcctactgtcttattcgttgttttttcttacacttatcttcatatatttcatctccacttcaggctttaattatgcatcatctcctcttgattaacgagctttggtagatctatatattaatttggactcaaaagtaatattttattttcatattgcactgacttaattccgaagaaacattgaacgcctagtcttaacattttctgacatgactaaacgaagtatattttatttttttactagtatttatatattttaatcaagtactataatggtactcttcacaacgtacaccatgtgcaattaaacgtcacagcaacattgatatttatatatttttgttacgatgcatattcattgtctggctaacatatgttcacatcaaggcctcgagggtgaggacactacatacgtaaggagatatgtgcctggcaaagggggatgatgttgtaatgttgttaccagcagtaatgtgttgcactttgacacagtttcaaatgaaattcaaaattaaattttctgggcacagacagtgtagagatggaagtgggaggcgtcaggataattacttgtactactcctgcccttgaccatattggagtgcacgaatagttttggctcctccacccagccaagccgtgttgtttgtgttggtaatgatggtcaatgtactgtagtgtttctcatgcatccgaggctgcagggagatgatcgccaagagagacagaacacttttaggaagctgctttggtgataggtgcatagggtagagaatgccacagcagaagatggtgacttgtaccctcaagaacaatgagctgaatgagtatggctgggctaaaaagaaccagcggtgatatgggacaagaggcagaggagatcagaatgaaactagtgaaacaacaaaaagtcatgcaaaatttgtagcttattcagaagcaatggaagcgatgttttctttttccaaagttaacagagtagtttagaacagggcagcgagtcattcgaattgtattagtacttgatagtgacatctcaatacaggaaaaaaaacttgtacacttcctcatttgtaccttatcacttttcgctaatttcattatatatacggttatgctacacgacatgtagcgtgctaggaatccaatggcgtgcctccaagctccttctcctctagttttcccttttttaaatcactaagatgatgccccgcaatttgctgtgagatatacgttagatagttgagaaatgatgaaatgatttggattgaaatattatgaaaatgatttgagaatgatgatttagcatatagatgtttagtttttgaatgaaataaattgtgatataattagtatatgtttgcatgttgagttttgatgtggcatgtttacatgtaggttttacgagtgctaataaatattatgtttatatgtttagctttaggtgtttagtggcattaactttatagaaagaagagatctgtggtcctatccccaccttttacgtgttttcttgttcttttcaccaccttttccatagcgcaaccaagctggatcgcctccctccctactgccgaaattacttccttttactaactcccaccatctatatccagtaaaagaattactatcagtggtagccgaacaaaaaagttactaacggtggttgtttccactttgttagggtctatgcaaatataaatattgctccaataaaataattactcatcattctttccagtaatatagttacttttcgttcttagtaaaaatattactgtcaattggtttataacttcgtaatgtatttactccgttttggcagtacagtattggtaggagcgtatgcatttagtatttcttttactataaaaaaacatgcaatctcacacaatcctgtgcaaataaaaagatgacatgtatcacacaacattaattaatggtgcgggcaatctagcttgtgcatgattataggtaccttgggatactaatgtaaatagaatctagcttgtgcatgattataagttcagtacaccgatctcatgtgcaaaaactgtagctattgcgatatagagtgatacaaatatttcttttgcaaatgccaagctgatagaactttatttaattaaggttgagcgtatgtgtgaagtgcctcgtggagattgctggcgcgcgacgcatagataaaataggagtggaagacatcagggaaaacaataatagtgcacaaagtacaggatgacattttaacgagttcgatctgccattttgttaagtttactggctgcattggtctgagctagctacaagagttcccttcagactagtatactgctaagccatagcttcatctttttgttctacttcttctcgtgcagttccatctaattatgcccatgctgaattgaaatgcaacaatcgagccttctttttttttaaaaaaaaataaatagccatctatgttcaggtataaacaatttaaaataacaacattctggacatgttcaattcgttgctaaaataaaacttaccatttgttggtaggcaacacatcaggtgaatacaaagcaaatcgtgcacacatgcacaaactccatctcaaatcgtccacctgatatgttgccttgttggtaaagctaaatttttgcttggccaataacatcgttgacaccttaccaaatttttatttcgatgtggttctgcgagtggatgttttggaattataaatgtatatacaatgatgaaagtaatatgttttatttataaaactaacaaattttggcaatgcaaatacaaagacctagaacaaaaaaaaacacacacacattttgactgaatttgaataaaatttgttggcttaaaaagtgaaaattttcaggtgaactagttttgtgaggggtttatgaaatttcgaacccttccacctcgatcctgtagcacgtccacacacgtgatttcagttgaaattctgagcctacaatggaatggcacacatgttttctctttgattctatttacatttttttttgcactaaacacttctaggcaccattgatcaagctcgagtactaaacttccagacgttgatttctcgaataaaattaatacttatgggtatgtttgcctaatgaatgccagtagtgctttttaactcgatttgtttttcttacactcagattcacatttttggccaaattattttctactgtttttttttcttttcagcaaatatagaggaagtactgttcagtacactggccattctaataaatgaacatcaaggttgagcatataaatgtgtgaactcactcatggcagagaatgaagttttttttttttgaatgcgcaaaaactttgtatgccaatatatttatatgtgtgtgaattttataggagtgaaagacatggaagaactgtagtactagtcaaaacatgcaggtgagaactattgcagagcaaatccctcagtgtgggagtcgtttcttgaaaagctgtgttactgtcttactggtaggctgcacaaggaagaagtcgtcacaatagatcagatatcatgaacatatatgatatatgaagtgatagttgcacggggaagaaggtagtgttgtactattatagttacaaccgcagttcaccagtagagattcaatattttttagagtcatatatattatagaaatagaagtggaaagcattgggtaaactaatactcctgcaaggtaacatctgttagaggtggtttgagggaaccacgagggcgtcagtcactaagaacatgtacaacgccttcagttagcagttgatgaccgatatggattgaacgcaccggcaaccaagtttggtgctccttagacaaggaaatttttttccatacagtagcatggtgagattggatgatcaacacaattcacagaggttgaagcaaagaataaacatggtgatttctttgacaagaaaatgcttgtacaacctttttagctgctgccgaagaaaaactaagtcaaataagcattggtatgaattctagcttgaggatagatggtcaaaattgttggtcaaggatgacaaaggagcacaagaatcattccattccgatcgaggctatctcatctagtcgtcttaccagtagggatgaaattttggtcaattttggtaattttgaacccccagccataaactatcttatccacaatttttgtatttttcaaaattttaatttggtcaaaatttattcaaattcagtcataactttattagattttcattatcttaaaaaaattgttaaataattttgtaccgaaattttctaaaatccctgaaattgtactcgtcattctgatatcaatattttttttcttttcattgtgcaattttcttttcggtatgcaatcaaatggtccgttagtaaattggatgttgtaaaactcgtccgaaatcaccattgaaaccaaacgcgaaataaacgtcatagaagatccaaacacggtgatgataccgagacacgatacttaataacagatttcagccgtagcctatatatacataacactgattacggatactcctccttggtccatcataattacaatgtattagatttacaacgaccctcagccagtcattgccggcagacgctccctcgcgcctataccaagtcatcacgagtttacaatagatgtgcctctctatttaagagagagcataggataaagtccaaacctaactctatcatatacatgtttcaacttcaagtcctaaactataaccgactatatacatacacatatttgacataaactttaacattgaaagtgttgcccgactatgagaatggtgttgtataaatagttgctataagtatagcactgaacagacctcatgctcctgtcttttacctgaaaaatagacataatagggatggaaggcatccaggaaaacccatactagttgtgaaacaatccaggagagttccaccatcagggctttggtgatcttggaagcagcttaagttagcttaggcaagttggaaccatcgtgctctttgaggattgatgctagtactaaatttgtccaagccttatagactaagaagcgatgacgaaaacaattacgaaatctgtgtcatagtattgtgatataataaaattgtgttagctacaacagcatatcatttaaacttctggtttttcatgtccacttcagccttaataagctagccgttgtggggctattttgactcaaattaaagtcatgttcctattcaccattttgcccagggttttcactttcgatttcaccgaaaatttaggccatttcagtagaaccaaaattcctgcaatttcatgattttttggtacttttggacctttttttttaatttttaacccaatttaactgaatatgactaaataattcaacaaaaatttatgaaaacccgaaaatttcgactgagataatgacttgctttggtggagggggtggttggggtgttccgaaattactgaaatttcaaaccagaattgcattcactcatttcggtacagcttctctgtttgttttactttcaccaagtacaattgtacacttgattaaattgcaccatgtgcaagagttacagtgatgtggggagtgatatattttcttttcaccttttgcaatgcccaactcataaattgggcacatcatatatgaagctagctagtgttgcgctgatgcttctcgaggatgtggtactgttgtagtgttgttgctgctgatgcatggcaccagtcaggccatctagtgaagtttaaggcatatcacatagaatgatagacaaatgcaaatagggttggaagttattgggaaaaccaatagcactgcgaagtaggcgcccaaatgggacatgaaaggacagcgcgacgggagggggactagtcttttgctctaggggcagaagaggttaggtcatgatgccgacgatgggaaaatgtatgacagggtcggccaaaacattctggagattggatgagatagaatttttgtggtgatgttaactattattagaaaactatatatcattagttgtcatcttaaatataaattctagattttaatttgggcttcagacttttcttgtgcacatacttgccggctttgtttcattcaaaggatttttgggcttcatatctttttttggtttttccattcggcaagtacaaacggtactctttactactacctccgtttcaggttataagtctttttagcattgcccatatttatatagatgctaatgaatctaggcacacatatatatctagattcattaacatatatatgaatgtgggcaatgctagaaagtcttataatatgaaacagaggaagtaattgctatatgtataccatgtgcaggaattactacatctaaagtgatgttattttttttaatgtgtgtacatttagtcttggctaataatttggttattaatggtgaaactgctatatatgtcaagtagtggatgcccatgcatagaagaggacggatatttttgcaagcaatggacaacaccatcaaagttcaagaggtttttattttcaagtatgcgcgataagaaatagaagtggaaggcattgggaatactgatactcctcccacccacaatgagtcagagatggtacaaggtgatcttcgatatcctgttactgcccgtacgtgaagatctctaataggacagaacgttataccgcttttgcttatgatcttcaaagcagaggcgtgtgctattgaaggcgattagcatgacatgtagcgtgtgcatctaaaacaacaatgccaaattagtgccaacacaaatgggcagaacagcgggcaacgctgtgcttctgactgcacagctaattgtaagagcaattctacggtccttgaggaggtaccatgaggtaccaaaaatttagtgtaaaattctggtacctcatggtacctcgtagtacctaggtaccacgaggtatcaatttacaatagaaaaagtggtatctcatagtacctcctcaaggaccgtaaaatggctctaattgtaattactacctgcacatttgctcaaattttatgtatcttggtataaacagaataaaagtatttatcatactttttttataccgaatgctgatattctgacgtatagataggtattatgtgttgtttgcaaataataaaccagtcagaatcagtatgattgcagccgtgcggtggagatagattgggagacggccagtggcctggtccagttcaacaatctttaggtaattcacccctgtaggttcccctacccccatctactattcctgtacgagtatccccattggcagaggaggtgccttccatctggtgcacgctcgttgctaggggtgggcattaaaaccgataaccgaagaccggacccgaaaaaaccgaaaccaaacccgaaaagaccgaactctcgggcatcggtcatttgttcgggtgtgacatctgaaagaccgaacaaacttcgaaagattcggtcatcgtgcaatactacccgaagaaaccgaggaccgaagaaaccgaggaccgaagaaaccaaatcaataccaatcactaaacagacaacgtgaccatcccatggaccaaaacagcccaacaacaaggtgaggcccaaatccacgtcaatgacccaatccctatgaccccaccattcgattgaccgaagcactcctaaccctagttagcccacgcgcatgtctccttccttccgcgccgctgtcttctgcagtactgccgcatgctgctactcgccggcgtcgccgcagtgtcgcatgcaatcgtgtggtcacgtggaagccataacaaggccacaggctgctggcttgctgatcctgctgcacagccgcatgccggccgctgtgccatcgcgtgccgtctgcgtcgcgcggctgatttctgccgcgtcgtcgccttccgtcccgccagcacttgtcaccatgcaatccatgctagtggatatccgtcccatgtgactgaggtggagccatggaggttttcaggagcaagaagacgagaagattgaagaggacgcacgttctggttcgagcacctcggtttagaccgaagaccgaaccaaattttcggttaaccgaagtagcggttagtaatttttgcttaacaacttcggtttcctgtttccaaagaccgaatttttaaaaaaccgaactaaccggaccgaaacttcggtctagtccgaatgcccacccctactcgttgcactgcctaggaacatcgtcaataatcttccttctcgccattgattggtgtgtgctatcttattttcgtaaaattcgtctaggaaagaacacagtcaatgttatctatcatgtgcatgcccggcatggcgtgtgtcatcggcgcgttgaagagtgcggtactggcacatgttggcagggtggtggtcgcggcgaggggaggatcacagcagcatagggagagccaagccggttggcgaccgggcttagagggaggcgacggtacatggagttatggacgaaggcaacttgatcaaacatattattttttaataggaatattggttaaaatccagcctctgtatatacccaaaagatgtgtacagccaaaactaatataagagtatttagactaaaaacttataaacctaatatcttgcgggactactatatgttgcacgtccttcatatcatgtttaggtccatttaatacataatacatgctgcataatgttgcagcccttttcctatacatctaaaatgggctaggagtcggatgtaagcttgagggtctatctggtatggggattctccctactactttgatcccacatgttgcatttatataaaaatacagtatttttttcatcgtgtatgtctattatctctgaatatgaaagaagagcagagaggtgaagacaagacaaggggaacctacagcacgtccatggaaaatttacatacaaatgagaggtttcactacacacagaacaggttgggaacccacaatagatgccggttttctgactcaaaccaatttggggtacctttgtccatccgtataggtgtagtgtaggtacatacgtaggattaggaagcatcgtgaagtaaagaatgtcacagctagtttgctgatcgtcaaaccttcagaatgaatccatcatagggtaggtctagttcacaagctatcctgagacctcgccgcacataatcacgtccaggtctctccacatgttgtttcttttctataagacgtctccaccataaagatgtcgtccgtcccattgaatttttatttttgttctgcgtgacattgtgtgctcacactgttgcatttgaacaaagagaacccacgtgcgggagtaattttcaaaatactccctccgtttcaaaatatttgacaccattgactttttagcacatgtttgaccgttcgtcttattcaaaaaaaattgttaaatatgtaaaactatatgtgtacataaaagtatatttaacaatgaatcaaatgatatgaaaagaataaataattacttaaattttttaaataagacgaatggtcaaacacgtattaaaaagttaacggtgttaaacattttgaaatggagggagtaatagcctgctatgcgttgttggccttcttatttgggagcccacgattgacacaacctgcttttcttcatagaccttttttaattcacatattttttcccactgaacaatgttctggcctagaaaaagaaattgataggttgaaactttacacatagcaattttcacataaactatatgcaacgaaacacgatgcatgaaaactttgtatatagaaacttcatatgtgtaaagttttggtatataattttttgcaagtgaattaaaaaaaataaataaaacagatgaggccccatatagcctagttactacttagtgggtcattgctttgttttttgcataggtgggccagtaggaaaaaaaacctaacgcaataaaaaattgc

SEQ ID NO: 66092 - DNA, 777 bp, Oryza sativa
tcgatcgatcacacaggctcactgcgagagtttgcacttgcactgcattctcttgatgatcaatccccggtttagtactagtattatatatagggctgcggctgtgttcgccattgctggtccccaatgggaacagtacgcacggaaaacatagcaatccattagtgtgtgattaattaagtattagctaatattttttaaaaataaattaatttgatttgttaagcaactttcttatagaaactttttttaaaaaacacaccgtttagcagtttaaaaaacgtatacgcgaaaaacgagggagagggggctgggaaaaggggcagccgaacagaggcgccttcgctgtccgaacccgcatatatgttcatgcatggcgcttaatttcttttaccctcaatttgattgacttgggaacttaggtcgataaaattatgctgcgctcctagtattctgagcaccaaacatgtatcagcccaggtctacctcgccccacgtccctttatcccactcccaccgttatcgaagtaaacgatttatttcgataaaaacaactttccagtttccacatcccatcatcccgctcccatcgttattgaagcaaatgatttatttcgataaaatcaacttccctacttctggtatatattatatttttccatgtacccaactaaccactctcacccccacttcattttttcctctttttttttggatctaaatcgattcaccatcctagcccatagatctgtgacgcaccatggaggaggacgacgg

SEQ ID NO: 66093 - DNA, 838 bp, Oryza sativa
cggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtggacgcccaacaacagcggcataaaggccagccgtgcaggcggaaacaccagtcggcggcggcgaaggcaagccggtcggtgaagacgtagacgcccaacaacggcggcataaaagaccagccgtgcaggcgaaaacaccagtcggcggcggcgaaggcaagccggtcggtgaagacgtagacgcccaacaacggcggcataataggccaaccgtgcaggcgaaaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaatat

SEQ ID NO: 66094 - DNA, 16419 bp, Oryza sativa
ggttctaatggtaatgttggatcaataccaccgctccggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagaatcaccgtgattagtctcaccctagtgtaatctgttgaacttggatagtttaggtggatggttgggcctgtcgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagttcgagtcaaggcttagctccagtttcttttgttttccgctgcatttctgtaagacttttatgatgtttgtaagacgtggatctgaatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatcctttttcattgcatatgttctttgcaattggatttgttccgggaaaattgggatctgctcttgtggttcaagggaaaaatcttgtcgcttgtttaagtgggatttttccaaaacaagtcagtttagggttttagtaaaattattgggatttattcgtcagtcagttggggtttgatgggtgaaatgcattaggtcctagctctataacatgggttgcaaggtgtttatgcttcgtttgttattattaatatgtatctaatttcccattattttatcgttatgtgagtccgtcttatttattcgctctcatgcaaaatgatctatgcataaaatttcgcttttattcgattcccttatttgagtcctttattgctttacttaaatttggatttgagcatgcattgatcctactcctttgtcttctctagatggccggtcacccacccaaccaccgcggagaaggcatgatcgattttgtggcagagctggcacgcatgacactggtggtgggctaccccaacgcgccggagtacacgaccattccgccgctcagtggcgagcttcctcaccgtgtccgcttggaggtccatggctacgtggggacttgcctcgctaacatggcggttgaggcgtcaggaggcacagcagatcatgcctgtcaggaggcagcctacttgatgatggccaggttacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaggagaatgctcagttgaagggtcttccagtaccaggaggagtccggatccgcactacgccccgtaagaggacgactgcacccgtgcgcatccagcttgcgcccaggaacccacctccaccagcagctcccgcagcacctccagttccgcccgcagctccggcagttcccgcagttcctccagctccagctccagctccagctcccgcgttcactctctccttcgctccagcatcagccgccagaggtccagccagtggtaccggaggttggctgtctgctactcccagtggcagcggcgagactgatccgtcaggctccaggagtcgctcagagggaccgggtgacgagcaggaggacgctttcgactccaccgaccgcaggagccgttccgagcattaggctcgtttttcccactagtttatcgatggtctagcttctggttgttagtttgtgtgtttaggttgcttgtttggggtcagttgacggtcgatatcatgtgcctatgatatggctgtcttaataaggatgtttgcttgctcttttaagtgtttttaattcagatcagaacaattgcagttttaattcctttataataaagcttagttcttgagcatctgtttttcttcttttccccgtctgctcttccctccagatggtctacaccaggactggcaaccgcacgacaggcgagggcagcaacggtgaagaacgcgctgatggtgtgcaccccaacggtgattctggcaatggtccgccaccacttcccgagaatccgacccttgcccaagttatggcacatcagactcagatgatggcagccatgatgcagcagatgcagcagcagcaccagcagatgcaccagaggatgatgcagcacgccgaacagcagcaccagcagtttggtccccctccccctcagtccaagttgccagagtttctacgcgtcaggccacccaccttctccagcaccaccaaccccatggaggcgaacgactggctccatgcaatagagaagaagctgaatctcctgcagtgcaatgatcaggagaaggtcgctttcgccacacaccagcttcagggtcctgcgtcagcttggtgggacaaccacatggccacccgcccaccgggtactgaagtcacatgggcagagttctgccgtagcttcaggaaggcacaggtgccagatggggtcgtggcacaaaagaagagggaattccgtgcgctccatcagggcaacaggactgtgacagagtacctccatgagttcaatcgcctcgcgcgatatgcaccagaggatgtccgcaccgacgccgagaagcaggagaagttcatggcgggtctggatgatgagctgaccaaccaactgatatctggggactacgccgactttgagaggctggttgacaaggcaatccgtcaggaggaccaacgcaacaagatggacaggaaaagaaaggcggcgcagttccggtccaaccaaggtagtcagcaccgaccgcgcttcactcccggacagcagggtggacctaccaccatgatcgtccgccagcaccgcccgttcaaccctagcaacttccatcagggcaccagtggcagccagaaccaccatggaagtcagcccaaccgcggtacagctccacgcccatcagtggcaccggcacaatcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcgtctgcggaggaggcacaagcagcaccagaggtcgtactgggtacgtttcctgttaactcaatccctgcaacagtactttttgattctggtgcaacgcattctttcatctcaaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcattcttctcgaatccaaagacctagatgtcattcttgggatggattggctgaccaagtttaagggagtcatcgactgtgcgagtcgcacagtcaccttgaccaacgagaagggagaaacagtggtgtacaaatctctagtctcaccaaagaaaggggtctcgttgaatcagattgagacggaaatcccagtggataccgtagagaagaacttgagaaaattggaagatatacccatagtctgcgagtatccagaagtgttccccgaagacctcactaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacaaagaggatgtgcgtcgattatcgcgcacttaacgaggtcacaatcaagaataaatatcctttaccgcgaatcgacgatttatttgatcaactgaaaggagctaaagtgttttctaagatagacctgcgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtattcatcgacgacatacttatctactcaaaatccgaggaagaacatgagcaacatctccgtctggtactcgaaaagttgaaggagcaccagctatacgccaagttcagcaagtgtgacttctggttgacggaagtaaaatttctgggtcatgtcattacagctcagggtgtggcagtcgacccatcgaacgtggagtcagttaccaagtggaccccaccgaagacagtgtcgcagattcgaagttttctaggactggctggttattaccgccgattcatcgaaaatttctccagaatcgcccgacccatgactcagttgcttaagaaagacgagaagtttaaatggacagctgagtgcgataagagctttgaggagctcaagaagaaattagtatccgcaccggttttgatcctgcccgaccagatgaaagacttccaagtctattgtgatgcatcccgtcacggacttggatgtgtcctaatgcaagagggcagagtggttgcatatgcctcgcggcagttgcgtccacacgagggaaattatccaactcatgacttggaattggcagcagtggttcatgctttgaagatctggaggcactatctgattggaaaccgctgcgaagtatatacggaccataagagtctgaaatacatcttcacccaaccggacctaaaccttcgacaacgaagatggttggaactaatcaaagactatgacatgagtattcactaccacccgggtaaagccaatgtggtggcagacgcattaagccgaaaaagttactgcactgccctatgcatcgagggcttgtgtgagaaattgcggcaggagtttgagcatctcaacgtgggaattgttgaacacgggttcgtagccgctctggaggcacggcctactctcgtggatcaagtcagagcagctcaagtaaatgattctgagatagcagagctgaaaaagaatatgagagtcggaaaggcccgggatttccacgaagatgagcatggcacaatctggatgggagaaagattgtgtgtacctgacgacaaggaactgaaggatctgatactcaccgaggctcatcagacccagtactccattcacccaggcagcaccaaaatgtaccaagacctcaaggaaaaattttggtgggtcagcatgaggagagaaatagctgaattcgtcgcactctgcgatgtttgccaacgagtgaaagcagagcaccaaagaccagcaggtttactccaacctctccaaatcccggaatggaaatgggaggagattggaatggactttataacaggactgccccggacatcatcgggacatgattcaatctgggtagtcgtggatcgactcactaaggttgctcactttataccagtacataccacctatacgggaaagagattggcagaattgtacctcgcaaggatcatgtgtttgcatggggtacccaagaagatagtatccgaccgaggtagtcagttcacctcaaagttttggcagaaactgcaggaagaaatggggacccgtttaaatttcagcacggcctatcacccgcaaactgatggtcagaccgagcgagtcaatcaaatcttggaggatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgaacgtcaactgttcggaacagaagtattagcggaagcagaagagaaagtcagaatcatcagggaaaggttgaggattgctcagtctcgacagaagagctacgcggataaccgtcgaagggagctcacttttgaggccggagactacgtgtatcttcgtgtcactccgctccggggagtacaccgttttcagacgaaaggcaagttggcaccacgcttcgtgggaccatacaaaatcttggaacgaaggggagaagttgcctatcagctagaacttccatccaatatgatcggcatccatgacgtgttccacgtgtcccaattaaagaagtgtttaagggtacctgaagaacaggctgattcggaacacattgatatccaggaggacctaacctatgtggagaagccggttcgcatacttgatgccagcgaaaggagaaccagaaacaaggttacccggttttgccgagttcagtggagtcatcattcggaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaattgtaaattacaaatgaccccaagaaaatgcagaggaaatcaggataaaaccctaagaaaacaatgcaaacaataatcggatttgacatgtggaatttttcttgaattctacatgtcgaaatgcattaacaggatttttagtggaattttcagagctctagaaataattttaaccaattaaaattgagcaagcaatattgttaattccagggaaaaatcctttttccttttctttttcttttttcctttctttttcctcctttttgtcaaatgggccgtcggcccattttcctttttccttccctcctccttgctgggccggccgcaggccgaggcccagtccggcagcccaggccgccccgctgcctcctctctcggggtcgccgacaggtggggcccacctgtcggacccgtctccctcctcccgccgatcccggcgcgccgccgcgcccgaaaccgccgccgcgcccacgcctccgccttccccgggccacgtcggccacgtccgcgcgtgcgccgcgctctccgcgcccattcccctctctctcccgctcgcgcccgcgcccgagatggccgggattcgaaaaccgaatcccgcctctctctcctccccactcccccacgtcggccggcgaatcccgcctcttccggccacgtccggccctctctccccctatttaagcatcgccggcgccccctctcgctttttccccatttcgccgacctctctcgagctccccatcgtccccgcgccgtgcaaccacccgccgccgccgtttttgctacttcggccgccgctagccgccgctaggctcgccgccgtcttgcgccgtcgccgccgttagattcgcggggtcgagatctacctcggccgcccctcctccgttgaggttcgccgccggagacccatccccgtcgtgcgccggtgagtgacgccatggccgccgccttcggccggcgctctcgctctctcgcgctcttccctctccctctaatccctctccttttgttcgttaggaggctccggagctcgtcccgccgtcgtcatcgttccccgacgcccgccgtcgtcgatcgttgtcggtgagaccctcctcctcgttttctccctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccgtgcccgcgcgccccggccgcgagctcccgccgccgtccgatctacccttgggtagatcggggccgtcggttcggccgccacgtggcgccgccgccccttccacctcccgtgccactgactagtgggcccgcgagccgccacccctttctctctctcccgggtcgctgaccggtgggtcccgcatgtcggcgccgcacccctccgtgctgacgtcagccctggaatttattgcgcaataaagtatttaaggtttttcttttatagtaataaacacagtgaatcttctaaaattcatagctaattcatccgagctccgtttaatcccattcaagtctcagtaaatcaagaaaaatgtgtagaatccattaaaaatggttttgttctctgtttcagtagtcttatagtctgtttgcaatgtttgctttgtatgtcgttagattccgatccctccgacgctccggtgtacttcgagatagtcgccgaggtccctccagcagcagagcaaggcaagtcatgcttgtcacttgatcatattgatcctatattgcaaatgtcctaatgttttctttcaaataccgcatttgttttgcaatattactatgggatggttacctattgttacagccatactattttgataccatgctcctttgttagcttggggttataacatgattagagtttggactaggaattgcttagccatgcttagttcaactagttcacaatggggaaaatcatattaatgattagactgttggttctaatggtaatgttggatcaataccaccgctccggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgttgtcgcgaccgagaaaattgccttttcccgaacgctagtgtattaatccccgtcccaggaaaagccggggtacaccacacaaacatgatataaaagacacatctttattatatcgataacatttacactattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggcagatgcatgattaatgcaagggggtacaaggggtaataatataggggttaagttttgcagaaaagcagcatttaaaagtcacttagttgcccaaagccattttataaagacgatcctaaagctacacagtattattaaacaaggccgtgaaccctcacgaacctgccttaacccaaggcttacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataacccaacaattccatagtgtccaggtgatatgaaaattcccaaagtctaaagttataaaaccacctaatgttgcctaattaatcagcgaagcatctacctaaattcatactagtggaaccatgaacagagtacccactagttggggttttgtttatcctagggtgaacaaggtaataataacaatagcaataataacaaggtcataacaaaggtaaataggcatggctaaataaaacagtgataacgcgggaatttaaataaagcgataatgcattaatttaaattaaaataattttataaactgggattcaatatgctcaaggatgatgtgacttgccttgctcagagagaacggccttccgaaccttcggcgacgaccacgaaccacgctttgggaacctccggaacgacgaaagctacgcgaagcacacaagcaaagctacaagcctataaagaagcaataacaatacataaaaaacaaagcacagggttctttaggttataacaaacattaagagacttgaacgggtcgattcggagctcggatgaccaagatatgatcatccgaagtttaatgctgttatatggagatttgcggattattataattaagctttgcaactataaaacaggtgtaagcgctagcctggaaaagacaggaaggctgcgctgttgacatgcggaccccacatgtcaacaaaaaggaccacggtagaccgagtacacagagacggtccacgggtcaatggaagcggatcccgtgtgtcaaccgaggcgagtggccgacaaacggactccactagacaccacacgggttacacacgtggaaaccacgtggctaccgagcgggcacactaacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaaggcgaggacggggctgcagcggctcgcttgacgaacgcggacgacggacgagaacggctcgacggagggacgaacgccacgacgaccgggaacgacgagaggacgacgacgacgacgaccgggaccggcgaggaggcgacgagaacagccggcagcggctgcacggggacgaggacggcgtggaacacgccgcagcgatgatgatgacggaggcggcgccgcgagacgacgagccgggcgaccgacgggacgtcgatcggcgaggacgaacggtgacgaggaagcgacgatggcagccagcagcggctgcgtggaggaggggacggcgtggaacacgccgctgcgatgttggtgaaggtggtggtgcagcggggcgacaagccgacgaggaggaatgggtggccgaaaggacgccggcgacgaagaggatggagaggccggcgcggcgacggcgttccggcgaaaccgaggagcagccggggtggagggcgacgccgcgacgtcgacgaaggagacggcgacgtcggccgacgctctgacgcggcgatcggggcgactgaaggcggtacagtggcggcaacgccactgttttgccggcgaggacgcgtctccggtgatttccccgcgaaacggaggcgaagccggggaagaggaggcagctgcgacgccgggagaggtgacggcgcagccggacggcgctcgggcgaggagggagaggcggctggaggcagccggcgcgaaggaaagagaagggcgacggcgggaacgtagctccgggggtctccgcgggaaatggagggcaagccgtgggagaggaggcggctgcgaggccgagggaggtggtggcgcggccagccaacgcacaggcaaggagacaggggcggctggaggcggccggcggcacgggagagagaggaaggtgatggggaggtggctaggggcttgggagagagcaaaatggaccaaaggaaggaggagggcttcgttttatagggcaaggacggagtgccggacacgggagaggccgaaaacggcgccggaggaggtggccggcggcatcaatggtggtcaaagaagagggattaaatcccggtgattgggggcgggattaaagggggaaagttgggggaaaggaagaggagattgagaggattccattcccgcaactaatttgaaaaaaggagcaacggggaggcgagatttggaaggaggaggcggcactgtgcacggcacggctggagagctcgggctctgcctgagctggaagaaggagcactgtagcgcgggggaggtaaaacagactttcggccgggctgagaggaagaggggagaaaccttgggccagacttggcccaaagggaggagggggattatttttagctttttctttttaataaactttgatcaaggttgttgttgcttaataaataattcccatgctctgaaaattcaagtaaaatttgagggctccttttagaccaaggagaatttaacaaaaattctccggaccacattcgaatttttcttgtacgtattttagtgtttgccaatttcttttcgaattttaattaattctattattccttttagaaaatgatttttatttcgggatgaatttatcaggacgtgacagtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgtcgcaacgtgggttagcgttggacagcggatgtttaatactgcttaattattacaactattttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagttcgagtcaaggcttagctccagtttcttttgttttccgctgcatttctgtaagacttttatgatgtttgtaagacgtggatctgaatgtcaacattgtcgtttgtgtaccccggctggtcctggacggggattttaatgcacattctgcttggaattctattcgggaatttctgggcgtgacagcgcgcgtgcgcgggagggctgcggctcggcttgggctggggcaggcccaagcgggaggaggagaggagggagtgggccgggaaggagaggaggagggagaagaggggcggcccgagggagagaggggaggaaaaagagagggaggagagagggactttggccgcgggccgagggagagaggggaagacttttggcccaaaggaaggagagggtttatttttagcttttctttttaataaactttcttaattgttgttgtttcttaataattatttccggtgctctgaaaattcaagtaaaatttgagggctccttttagaccaaggagaatttaacaaaaatcctccggaccacattcgaatttttcttgtatgcattttaaggtttgccaatttctttttgaattttaattaattctattattccttttagagaatgatttttatttcggtatgaatttatcaggacgtgacactagtggtcagcctgtgcagcatactgcaaatcaagttgtcccggagcacttggttcatcacgtacaaccagatggcacagtgattcctcaagttattcctgagcatttggtgcgcaatattcagccggatctacaaaattactaggggagcaatttgaattatcagtatcagccaccatcaccgcatggtcaataccaacaggcaggatcagctcaaccccagtttgttcctcaatacaaccaatttgagcccatgtcacagcagtctcaaggaacgccttagcaacgaccatgggccgatttgattgcggatgtcatgaaggagcaatttgggcttaggccgaaagatgctggaaatttataccgacagtcgtatcctgaatggtttgagagagttcctctccctaaccggttcaaagttctagatttttcaaagttcttaggacaagatagcacatcaacttatgagcatgttagccgatttttagctcagtgtggtgaagcatcggctgtggatgccttgagggttaggttgttccggttgtctttgtctggatcggctttcacttggttttcttctttatcgtatgggtcgattaacagttgggccgatttggagaagcattttcacagctatttctatagtggggtgcatgaaatgaagttgtctgatttgacagcaatcaagcaaagacatgatgagcctgtgcatgaataagtgctacaacttaagttttactaatgctcagttagccgatttggcttttcagggcatgattgctccaatcagggagaaattctcatctgaggacttcgaaagcttgtcgcatcttacacagaaggtgactttgcatgagcagaggtttgctgaagctaggaagaattctagaaaggttaatcatgtatgtccttatatgtatggatcggatgatgaagatgatgattctgaaatagctgcagccgaatgggtaaggagcaaaaaggttataccatgccaatgggtgaagagttctggaaaagaggagaggtatgactttgatatcaccaaggctgacaagatttttgacttgctactccgagagaagcagattcaacttcctgctggtcacacaattccatcggctgaagaatacggcaagaaaaggtattgcaaatggcataattctagatctcatactaccaatgattgcaaagtcttcaggcagcagatccaagcggctatcgaaggagacaaaatcaaatttgatgattctaagaggccgatgaaggttgatggtaatccttttcctgtcaatatggtgcatacagctggccgaacagcctatggaggtcgtgcaagaggttttcaagtaaattcggctaagatcattaataagtaccaaaggaagtatgctaaatagcaggagatgtgttatgaggaagatgatgacggctttgatcctcatt

SEQ ID NO: 66095 - DNA, 1324 bp, Oryza sativa
tttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattagaacactacacaatcttatatgataagtctaattacaggtctaataatcttaattaattgcattacaaatataacaatcatttatattattacgtcacttgcctgctccaattccttctaggactagctcttccactcaggcttgacggacgactccgacaacacgtcttttctgcaagatacaaaaagatgtattaggataaatgcgaagtaacatatatatatatatatatatatatatatatatatatatatatatatatatatatatatatatatatatatatatatatatattgcatttcacgttaacgttcgtcctcgttcgttcgctcgttcacgttccctagctcgttcacgttcgttcgctcgttctcgttcacgttcgttcgcttgttctcattcacgttcgttccctcgttcttgcttgtcttcgttcgatcgttctcgttctcgctctcgttcgttcgatcgttctcgttcacgttctcgcggcaacgtacgttgacgtgttcgttctcgctctcgttcgttcgatcgttctcgttctcgttcacgttctcgctctcgttcgttcgatcgttctcgttctcgttcgttaacggcggtgtggcggcatcggggcggcggttggcgcggcagcgtggcggcggcggcggcggcgtggcgacggcggcggcggcgtggcgttgcgaggccgtggcggcggcggcgtggcgtggcggcggcggcatgcgcgcgcggcggcgaaggcggcggcggcgtggcgacggcgcgcggcaacggcgtggcgttggcaggcggcggcgg

SEQ ID NO: 66096 - DNA, 30700 bp, Oryza sativa
ataaagacaaaaaaaaaagaatttggttttacatgagaatcactttcaacttccttcctggttgattagaacgcttctcaacaagactcttaagaacaatcaacagaaagtcaccctgaaaactgggaaatcaggatcattcatggacttcctctaccatagaaacaaaagaaaacattgtctgattcgtaaagggaaaggacacaaacatgtacataccaaaatagtacgttcatgtacttcgtctactactacatgagtaacatcacttaaatcattgttcccctgaaattagcatgaaaaggaaataatttcttaggaactatcatcacatgacttgaaacacaagtggagggatgttataatgttagctttacatgcaataaaaatattgcacaagacaaactatgttaacatgacggcactacttacagataattttctaagaaggataccggtggtacagaacagaagctttgtcctttcattcctaaaacagtagaaagaacaaagttgaatacatcatagggatcttcaatgcaaaattacaagaattttttcacacatataataatgtgaatatgagaaagaccaaataccgagcactgtcaagacgaacttgatatccgaccaaagaatccttagatccaggagaagattcacacctctcactagacactctttcagccactgaaatggcctacaagtgagtagctataccacgttatattcaacaatctagatctgtttagtataagctgcgtgatcatcatataaaaaggatatctagcataccagatgatctcacagtaacaacactaagatattgtactttatgatgaatttattatcccagaagtgatttcatgaatatgacatgcaatttttatattgcctgcaatgtattgctaatatgctgcaccggaaagataaagaaaagatcaaggtctgcactgtgatcataccgctatcctccggggttgtgtgcagactatgctgcagtaaccaccaagctcagattcaatcatatcatccaaaataaactgtggcacctgcaaatgaaagataatataatcatgtaaaactccatgcttctggaaagatcagaataaactatacaagctggtattgcataacatctagtattgaatatctttctacatgttcaaggaatatatgcaaacctaactttgtaccaatagcagctagcatacctatcgtcaaataatagaagctgattggctgggagatgaagaatatcatgagatcagttcattaacacattccaataggtgaaaatggaccatggaaagaataagatcctaaaacacataggaaggcacttcctgttgaatatgttaagcatggccccgttatcctagcctgttgcactcaattagtcaagttgttttaaaaacaatgtagaatgatagagtcattaagggaaaagtcaggtctatagtctagaaatcctagatcaagttaggcaagcaagtgggagtttcagagctacttggcttcccaaactataggaaaccacgactgccatcagacttgttatgacaagtttcgtgcagcagataattcactatttctcatgcctcaccatcaccaataatgtaaatattataatttcagggagccaaataaagggataaggcataaaaaaagatgatgttttgcacatgatatggttatcttttaaagctggaataacaactggcagcgcccaagaatgaagcctttgtgggggggtacctgagttgtcttcccacatccggtttctccgcaaacaacaatcacatcattctctttcagtaactgtagaaaatgatctttgaatctagagattggtagagaagctcttgcttccagcattttctgaatacaaagatgaggcaattcgtcacaaagagtcaaaggcaaaagaaaaggtattaaattagaagaacagtatagtagaatgtatatcactcttaccaaatagctcgactgcttcattttattttccaaatgttttttcaacactgtgctttccacctgctctgcggatctcgatcctgatcatagaaaagccacattagatatcccgacaggaattatacttacacttacattattagcagtctagtagaggcaagaaggaataatctataaaggaaaaatacttaatacattcgtttgatcattattcagttaaaacaaaaaaaaagattatttcaattagaagaaaaagaaagatatagcatgaatatctcagagaactaatgaggtcaaaatacacggcatgcatgttgtgagcaagagaaataaagcaagattccaaatggaaatatagctaaaaggtgttataattctgtgaaaatagattctacataggagaaacctcattggtgtcgagaaagttgatagaatggagaagataagtctgtcatcagtgacagattaaaaggttatggaaggtaaaaaatggtcaccatccaaatcatgattgtttcacacattattcataaagacaaaaaactgaaatgatgattttattcaaagcttacctgtacgattcaccagataggtctctttcttctcatgaacagagtagctgtcctcgatgctcctagagtcaacagatgtagcaccatctgacgcatcctcaacttgatgtggagttgtattcgcatccatatccaacaacttatccacaaaaccagctcttcgactatcctcagtatccataacccttgaagatgatgatgataactcccctgcttttttgccaaaaccatgtaatatgtagcccaaaggccccaacaaatcgtgattcatcacagaagaaagcaagatcaatttatctaaccttcttgccatcttaaaacaagtgatgcatatggttcaataagcaattggcgcaatgaaagatcagcgaaaaattgatatagagcaaaagctgccactctgttttgtgcttcctgtcgaccaattcagcaaatgtttattgttcagaaatacaattctagacaaggaatgatgatatgtatattcttttctcagtattatgaaatcagaatagttaatactaacaagcatgaaaggtaaaaatgaagaaataaatctgaataagcagtggaaatgggatagcttcccaaacagattaacatgcactatcatatccatccaatgcgcattggggattggtgtgcctccaaaattaaagcaacgccccatcttctaagaattttgatgttcttgcacagaacattgagcactttggatgcataggatagtgcatggagccattgacatctgtatatatgaagacttgcatttctcattgaaataaaaacgaattgtttttatttttgagatattttagaaagtaacagagtgttcattttgtcaatactaacctcaacagatgcatattctttatcttgttcagttaactcgacttttgtcaagcctccagccttccgacttttaccacgaccagtagagccacgcagtacattaacagcatatatgaatttacgatccttttcagatattttactgtattttggcgcttcccaaccaagtttctgacagaatttttgcagaacagcctttggcattttaccagaatctccctgcagaccacaataaatagttagaaccaaatgcacgccagagattaaacagctttgttggttcattgtttatttagcaatatttcgaattgttacattctgcccattgcccaaataatggatctcctcaaatatcgttacaagtgagatatgttagttgtgttctcttctcactgtctagtacggtaatttactgaaacttgaatggtttatatgcagcttttaggagcaagtagcatggaacattgcagcacataaaggccaccccaactatcctactccgtatacaacaaggtttctctaacaaaattgagagaagcggcattataatcaagaaccaagacagcaaaaacacctccaaaattctaaagataaatatgacaataggaggaggggcgttaatataaagtggtgcagatgcacatgaccttcttccatatatcatctatgtttccaagaagatgcccataaccatcatgtgataatttctctattttttgctgttttagtatttctggagccactgcctcccaagcagaagagtcttcaaaaaacaggttatcaagttctacttcctcttcttctacctcctttgtgctggtttcatcaacatccttggacatttttttctccaaactggatcctccatccatatggacaggactctcacatttctttccagttgcaccagagtcaactagatcaccctcagcatttgcaatatcagaatttggaaagacattatctgaactgctgagatcttcctttgagtttccagatgaggatttcgcttgtttacctgaaaacaatcaaacaagaaggcataatataaacctgcctgaactacatataagcattcaaaacctagtcacaattagaagagaaaattcatatggttcactatagaatcgatatccttcaacaagtattatgtgtacccttcttctttcgcctacttggctttgcctcagcagtttccaaacttggtgggcagtgatcttcccatgtgtaggaatcattagaattcacatcatcttcctaacatcagcagcaagaaaaaggaataattgcaccaatatacattaaacaggaattaaaagaaaaagaagagagatacattgaataagcttaatctcgaagtttagcggagcaccatccaattcgtagtggattgaaatgcataagatgtttgtcactaactttaaacggcattcagtacattagaatatttcaatcacaaatgtaataaggtatgtcactataattacgttcgcaacataacgcttcctatcatgtttacaaacatattactgcaaaataaacagtcgaacacgcatattggagagcattttaattaatgaagagttaaaagatgataaaatatttaaattggtgtgacggagagagagtcccaaagtattactatcttgtgttaccagcttgatattaaaacaatacaagatattttcaaggagtgaaaatagaatacttgtcagataaagcaaaattgcacaagattaaaaatttaaacagtcattaaaagagtatcgatattcaatatttgatgcagcaatccaaggaacaaaatcacttgtttgaacatctgtcacctatacctcctcttgttgttccatgtactgccgaatccatgcagcttgtgatgattgcccgtcatccaatgtcacatcttcttctcgccgcctgctaattataatttccaacctctcattgctcccctgcacctcctctgactcacgactctgtggcacccaattgtctttcgctgttgatactaccttaactgagccttctgtccctaaaggccctagaaaagtaatgaacagctgatttaaacatgatagacttcttttttagataatggatttataaaacgcagactctaaagcatacacagccaaaacatgatagacttaacactcaacacttaaaagtttcgaaccaatccatgcctctatgagaaaacacaagcatgagcacaccaaccctgcagttcatgggtgtgtgcatacgtgcagaacctaaaatgcagaataactgcagcgcaaatacaaatgcagcaaaatatgtaaagcactacttcaaacttggaaccagtaaagcacagaacgcaggcaaatcattgtatgcgcagaagcatatattgcaacttcatgcatatgatctgacaaacatgttgatgctggcaaatgcacacgcagagatggcagagttcacagttcaaacagaaatgagactagacagtagacacgaagcgctaagccctaaacccgcgaaaccgcataccagccccagaagaggaagcggtgccactggagaacttgagggggagctcatcgccgggcagattaaagcacagccaatccaacgccgactcgaacgtagccgaatcctgcacccaaaaattaaaccccaaatcatcatcaacaacagaaacgaccaaattccatcgcacggcgggtgctcaacgagtgcttgggagcacgaaccgatagcgcggagagcgcctgctcgatttgcgcggaggagaagccctcgagggagagcttgtcgtacaccccgcgcagccgccgcgccttctgctccctcgactcggcacgcgccgcgggagcatccgccggcgcgggcgctggcgccgcggtcgctccggagttgaggagcaggcggcggaggcggcgctcgttctccgacgagatctggagccgcggcgcggcggaggcggcgccgccgccggccgaggacgacgaggaggaggtggaggagtgcttgggcttctgcttctgcttcggcgcctgctgctgctgcttcttcttcggcgccattccgcctccgccgagctcggcctccgccgccccgatcgtctccgccggcggcgagcttggctacggcggaggcactctctggtaggtgggcccagcgacgcgccgtgtgcgctgtgctttcgcggatactttgcgggacgcgcacattacgggacacgcgttctgggctcgaaagcgtaatcgtgcattcgcgcttcgcgggtactcgcgggccacgcacagcacgaaacacgccttctgggccggaaagcgtatttccacattactgggcttttactgggccgtccattggatctatacacagcctgaaatgtggaaagattccgtgttgaaattaaaagaaattttgaaatggccgagcaaatagcgatcgaacatgtaggcacttttggaggttgggacatgaacatcgagggcgatttcttatttggaatgaacatcgaagcaaatttgacttttgtaaaagtccaaaacggcgatgttgagccgtcgataaaacaatgagatttcgatagcgtttttttgtggtggcgtggacgctaccttctctgctctgtccaactaactaaccccaattggcaaccccgttatgcagcaaaatctctgtctttgaactgatcattagaccgaagatgccttggaattttgagacaagcatcaaagcatgtgcgtttgggaggcagccagcgaccgtgcatgcgtactagggggagaattgagactatacacgcgtggcctttgaatttgtctctagccgattaagtactactatacataaattcttagcagaattatctgttctatacagtagaaaatgttttaaaccattttatttgctgctgttcctctaaacacaaagtccagagatacacttaataatattgtggtaaagggtaagtggcttcaatcccgagatcccatgttcaattctcaacacgcttataatttattcttgaaaaatgtttggatggatgtctctcttcaaatctttcttttctgtaaacacataatccacatattcttcttcacatggagtaataaactaaaagtaccaaggctttgttcggcacattgagttaggaattaatccctcgcagacaccaaacagagcgactcattagcacataattaattaagtatttagctattttttgaaaaaatggattattataattttttaaagcaacttttttataaaattgttttataaaagatatatcgtttatcagtttgataaatgtgcacgtgaaaaatgaggatagcgaagtttagaaagcgcacatactagcacagcctaatgggaccacctatacatttgtcgacaaattttctactaaaaatttgacagatgtaattatagtacaatcgtagtgtaattacactgtaacttgtattaagtttcacgtaattttgaatcgttagatctattacaagattcgttccggtgaagaagaaaaaaatcacagcacacacatatgtgaaaagatttgttcctaggacctctattttactgaaataacatgttaccgagatattcttgaaagttacatacaaattacattatagttacagtgtaattacatgtaagttacagtgtaattatactacgattgtactgtaattacatccgacaaatattagggggagaaatttgatgacaaatatctagcaaaatcgcatcctaactactcttgagtaatatgatatgttttccttaagtatttgtaaatcttttgtagaaaagataactagtcaaattttaaagatgaatagtgccaatatcaactatggctgtgtttagaccctgtctagatgggactaaaacttttaagtccctatcacatcggatgtttgaaaattaattataaatattaaacgtagactattaataaaacccatccataatcttggactaattcgcgagacgaatctattgagcctaattaatccatgattagcctatgtgatgctacagtaaacattctctaattatggattaattaggcttaaaaaattgtctcgcgaattaacttttatttatgtaattagttttataattagtctatatttaatactttaaattagtgtctaaatacaaggactaaagttaagtccctggatccaaacaccaccttagttggatccaaagtttggattttggttgaaattgaagatgatgtgattgaaaagttatttgtgtatgataggttgatgtgatgaaaaaggactgaagtttgtatccaaacaaactttggatctaaacacagctatttaaaaacggagacagtacatatattgagtgacagataacagataattgtgagtgacatctgtatagtgatgaacagttaaagccacatttattaagtagcagatgatttttctttttggtcgtatatatgcccttgtagctggtagtagccgcgacggcttcagtggccgagagttgtaacgggcgcgattatccggcgagatgtcgtcgccgccgtcctcgggctcggagcgctcgctggcgtcgctcgtctccgcggcggcgcactccgtcaagctcaaccgcgcctacctcctcgccccggccgtcgccgcgggcctcctcgccgccgtgctcctctcctccctcctcgacttctccgctttctccgcctccccgcggccggcgttccctccgccgaccgcgggcgcgccggcgaacgcgtcggccctgtcagcgccgcctcgcgcgcccgtgcgcacggccctggacacgctcgggacgcggccgcgggagccgttcacggcgctgcgcgacgcgtacgcgcggtgggacgcggcggtggggtgcgcggccttcgcggagaagcaccggtcgcggtcgtcgccgccgcccggcccggcggcgctgcaggaccccgaggcggcgccgtgcggctcgctgcggctgccccacgtcgcgctcgccgtgaggggggtgacgtgggtgcccgacatcctcgacggcgtgtaccagtgccggtgcgggctgacctgcctctggagccgcaacgaggaggccctcgccgacacccccgacgtcgtgctctacgagatctggccccctcccgacaccgtaagtacacgatcgatcacctcgccgccgccgccgccgccatgatcgaacacctgtaacgttgtttgtgctccgtgggtgcagaggaagcagggcgagccgctgcgcgcgttcatggacatcgagccgacgaggaagcggtcggggcacgaggacattttcatcggctaccacgccgacgacgacgtgcaggtgacctacgccggcaagttcttccgcatcacccacaactaccacgtcgccacccacaagcgcgacgtaagcactctcaactcgaattaatccttccttcctccgaatgcacacaaatggcggaaacattcatcgtcgtctccgtcgccggcggcgggtgcgcgcatgcaggacgtgctggtgtactggtcgtcgtcgcggtgcttcgagcaccggaacaagatcgcgcgggagctgttccgccacctcccggcgcactccttcggccggtgcgagaacaacgtcggcggcggcgacaaggccctggagctgtacccggactgcgcccgcgacggccacggcgcggcggagtggtgggaccacctccactgcgccatgtcgcactacaagttcgtgctcgccatcgagaacaccatcgccgacagctactccacggagaagctctactacgcgctggaggccgggtcggtgcccatctacttcggcgcgcccaacgcccgcgacctggcgcccccgggctcctacatcgacggcgccgcgttcgcgtcggcggaggagctcgcggcgtacgtgagggaggtggccggcgacccggcggcgtacgccgagttccacgcgtggcggcggtgcggcgtcctgggcggctacggccggaaccggctcgtcagcctcgacacgctcccgtgcaggctctgcgagcgcgccagccgcatgggcggccgccacgcgccggcgcccaacgccaccgtgtcgtgacgagacgagacacgacttggccccggttggattgaaagcctatgaatgaaaaaagtttaaaacgtttaaacgaagtgtttgttacgtagcgtagctgcgttttgctttgaatttgttggtctgcgtttgctgtttaggaggagcagaacgattatgaaaaaggctggcatgagatggtttctgctgtccatatttcacattctttttgcagatacggatggattttggaccagcgtgctacagtaaccggttatttgtgctggcaaatactcgttccggttctaaatatttgacgctgttgactttttaaaatatgtttaaccgtttatcttattaaaaaattaagtaattattaattcttttcctatcatttgattcattgttaaatatactcatatgtatacatatatttttacatatttcacaaaagtatttaaataagacgaacggttaatatatgctaaaaaaatcaacggtgtcaaatatttagaaacggataaagtactttagtagtaatagttttgttcagttcgatacggcaattagtaatttaaaaccgtcgtgattccgaaccaatgactagacttgcgtggcgtcgtcaacctcgttccaaggtttttcaacgtcgctgtcgagacgaagagaaaaggactcgtgaatattaggcctggtttagttaaaaaattatttcccagaaacaacacatcgaatttatggacacatgcataaaacattaaatatagataaaaacaaaaattaattgcgcagtttatatagaaatcgtgagatgatttttttaagcctaattagttcatgattagctataagtgctatagtaacccacatatactaatgacggcttaattaggctcaaaagatttgtctcacggtttccatgcgagtttttcattcgtgttcgaaaactccttctgatatccaatcaaacatctggtgtgacaaaaataattatcttttcgcgaactacacatgcccttagttttgtgttcgttccaaggtcttgtgttcgttatcgtttccattttttgctgcagagacgaagaaaaatgactcgtggatatttagtttctgacgcatggcaaatgactcaggtggtgtttggatacagggacttaactttagtctatgtatttagatactaatttagagtattaaatatatactacttataaaactaattacataaatgagaatgtttactatagcatcacataggctaatcatggattaattagactcaatagattcgtcttgccaattagttcaagattatggatgggttttattaatagtctacgtttaatatttataattagtgtccaaacatctgatgtgataggttttacttccatctaaacagggtctgagtgacgcactagaatctccattaatgctgcggcaattttcagtgatttttttttgatgggcaggtaaaaggctgttgctgttccagcgtcgccaatgcattgctgatccccctctctgtactgaacgcgaacatatatgccttgtgcatgaactaacttatcagttggagccaccaaccctcgtgttgtaaaaacaccatactcattaggctccagcttgtcaagcaaaatgcctgctaattgcaaagcgtaaccaacccagtgggatattcatctatctcagtagttgactttcagtaaggaaatcaaatgtttaaagccttattcggttttgagggattgaagagaattggaggggattgaggaggaataattccatgtagaataaaatcccctctaatccctctctcacatggataactaaacatggcctaagtgtctgaaaccatcatcatctaacatccatataattgagcatgcatgattctctgtcaccagggggccatatccagaaattaatgagccaaggcctgggcttccaattgtaattttgggccgcatcttgcctttagtcataggccttgttacttgagggatcacaatattagccacaaccatcaaccacgtgagggaattgcaactgaatcctccatacgtaatcaaaatttattattccactagtttgggtttgacagtgaccaatcagatcgaggccctagggtgagtgtgaaatgtttaaattccacggtaaaagttcagtccatgtgacatccacatattcttttcccccctatgtttgatcattaattacatagtgtacaactgatcacaaccatatagctagcccaaaccacgccttccaaattcggaacgaatggtttgtgaaaaagcggaaaatcccccaaaacaaacacattttcttctttctgtactattttttgcatggatcaatcaaagttttttcaccataattaattagtaatttacacggtccaggaggcggagcgcttgaggacgggcttcatcatggccctgtcctcctcgagggagatcatgccgaggtgggaggggtcctccaccatcatcttggcgacgaggtagccggcgacggaccacgtctgcagcttcctcgcctgcttgcccacgtagcggcccagcttcccgtcgtagtactccggccacccgtccctcgccagcctcgcctcggcgagctcgatcgcccgcctcgcgatcttcagcctccccgtcttgatgcacgccgccgtcagcagccacaggagcactggccgccgcaaattaacacacaacacaaaacaaacatgctcggatcgttagatgagataactactcatttggtcactcgagtggatcgtacactcgttttatacatgccaactaaaaaatcgttaaaattgttttaagaaaagaaaaatgtgagcagatttgggtgcgtcattgtagtactaataaatgttttttttacagaaaaattaaatgcatatggttttcatacttctaatggtctaatcatttttcaaagaaaatatcaatgttcaatttttttttcttcccctcaaaagaaaatgttcaaaattcttaaaacatgacttgaaacacgttcggaacagcatgtttccgtgacttcaaagggagggatttgtaggatgtaattttatcattcttaataaggtatcggaaggtattatattttctaaggatagaaacaatcgaagtacaaaataactaacctggccaggatccgccattgtggtagctccaccgggtgttcttggggtcgcacccggtgacgaactcccactcgtgtgattcgatcgccgggaagctgatcttgagcggcatctccccgatgaggtcctcccaccgctcctcgatgaggtccatgatcgccgccgcctgctcgggcgtcgccatggacgcaaggatggcgacgaagttgcccagtgcgaaccatcggaagtccatccgggcggggctgacgttgccgacgaagtagccgccgcggctgggcatgaagtcgaacacccagtccgggatggactccgggatgacgttgaacttgttgaccgcagtgtgggagtactcctcggtgcggtagcggtagacatcgttgagctgctggaagtcgagccagaagtaggaccgcatgtggtaggtgagtgcgtggagccgtgtcgccacgcggtccatcgtctccttcccctcgggggcgtccggcttcagcatcagcagtgcgcaccgtagcgccatgaagaagagggcctggatctcgattgggtacccgtacacgccctgcaaaaaaaaaatcatttaaatttttattgaataaaaaaggagtaaaactattcaggcgcaagagaaaaaaatgtaaaggctcaaagccttttgcccgagattgctaaaacgtaagccagctaccgtagatgctttgtgttcgtcaagattcatgttttggcctctccttaattttggctattaggctagtcgccgaaagatcatgcggttcctttccttccatatctctcatacgactagcagtattagtgtccgcaggatcttcttggtgctttgctggtgccgtgcggtagcatttcaccactcgagaagcgtcgatgctgcttgttggcactgcgttggcttttcatttcatttttcagagagttcagtttcgattccatggtgaccacgacaccgtcggtgtcagatcgtatccatcagcgtaaatgtgtagttatcgatttatttctgggaatgggagtcgttttaatttctatcgattaggatatggatggttacggttagtttgaccgagctgcagtagctgcatgcatgtacaaacagtgctttttttttctgttttgattattgggatcaattaaccagacagtgatcagtaacaaaatttttcagcattatgttctttattatcagctaaagcagaaacttttttttttctggcagctaaattcatccggtaaggagcctcacccaaaattcatttagcaactgatgccaaaatgatcagcacaaactattttttttaactctttgatggcatataaaagtagatatggtgatcattatcaacaataataacatataggtgtaaaaaataagttttttttttaaattgacaaactagattaattatggtgatcattatcaacaatactactccctccgtttcaagttataagacattttgattttagtctgttttaaatttgactaaatttatagacaaatatagtaatatttataatactaaattagttttatcaaatcaataattgaatatattttcataataaatttgctttgggttgaaagtgttactaattttctctaccatcttgatcaaatttaaagcagtttaattttgaccaaagtcaaaacgtcttataacctgaaacggaaggagtaacatataaatccaaaaagaaaatcagtttttttaattgaaaaactagataaattacggcgatcatgataatcaacaataacgaacaaacatgaagctagtgaggacgaacgaacgacagtagtacataccatcctgcggtcgatcatgcagcagccgtcggcgcagaggagggtggggaaggtgtcgaagccctcggcgaggcactggttcatgatgaggcggatcccgcgctggcactccgccgtctccgccagcgacaggtcgccggtggacttggtgtacgcgcggaggaggatgatccaccagaagccggagtccaccggcgccacccgcccgatggcgctctccccgaagtccgccaccagccgctccgcccctcctcgcttcgcgtccttgagcaccttgaagctcgccggcatcgccccttcccccagcttgaacctgtcgatccgcttctcccacccctgcagcagcagcgtcttgagcaggaagttcttcacgatctccggctccccgttcatcaggaacgccagcgcgctcggcacgaaatccctcacgaacacctgcgtgtatatgcgtgcagtttcatcgatcagattgttgcttttaagattttgagaatatatgctgattggtagcagggttcaatctttcgtttttggcatttgtatcgggggtgctgatatgatgagattatttgaatttttaaataaaatttgtttaaatttgaacaaattttactaaattaaaatgtaataatttaaaaattttggggttttccgataggaacaaaatttcgaaaatttattccggaattttgaacacatgtgaattgtttgaggagctcaagattacgtccgtgggagactatgggcatgtttggggagcttaaaattaaaattctgagaagcagctggttggtagctagcttctaagaatctagaaaaaagctgggtttttcagtttctgatttctagttcattttctggattctacatctacagcttctaagaatctagtctaaaagctggactatttgaggaaacttctaattctgggtaaagttgcagcagctaaaagctcctccaaacagaccctatggctgctagaagttgaggacttggtatacctggtcgtagttgaggacctcgtcggaggagtggtcgacggcggcgatggtgccgaggggctggccgcggaagcagacgagggagcggcggagggcgtcccaggcgtcgaagacgagggggtgggggtcgaaggagaggcgggtggaggacgccggggtgccgcacagggaccggagcccgccgccgggggagtacatgctctcgtagctctccatcatcgccgggtaccctcctccgccgccgccgcggctggccgtgccggagatggagagctcagcgagggagcggtcgtcgaaggagcgctgcctgtccacgttgatccgcggccggtggttcagcatccgcgtcaggtcgaagtcgtccgggtccgccgccgccgccgccatcgacgcgtgcgacgacgccttcctcatccccgccacctccatctcgtacaccgccgccgccgtcgtcgcgtccgccctcaagaaccacaccgtacgtacgcgacgacgacgacgacgacgagaagagaagccaaacgcaacgagacgcacggtcgtcggagagtggtggtgttcacgtgggctcgccggagttcggtgcggcggaggagaggtcggtctctggctcgatcggcttcggcttcgggcttccggtttcgcgcgcgcgggtaaataaaggacaccgacgcggggggtgaggaggaggtgggccccacgagtcagcgacaccgcggattattgctgacgtggcgttgcgtgcgatgggggaagggaaggtggtgggggcggttacctgtctgcgcacaaaagggagtgagaggaggcgagatagaggcgacacatttgggattctttcccagataagggaatttcccaacagattttgaatgaagcaaaagggcaaacttgcatgtttgagttattttcttcgcaaccttatcattggcttaatacggtagaatgggttgagtggatggatgtacgtcatatattgtgttacggaattgatagaaaacttgcgacagttttcttctgtcaaattttcagcccttagggcatccacaatgtgcatataaagtgggtagtaagaaataaaatactactactaccagattatatacattgtgaaatagtaagtaataaatggtaatatgcttattacctagccataagcaataaacaaatgatttctctcatccctctctcatggctaatggttgtggggtccagcttactaccaactttttttatttcaccattgtaactacaacaacaactaatacccactgacgcagggcgcacccttattctcaaagtaggtagtaaacattggtgatgcccttatatccgctccaagattcatgcgggcaacaaggaaaaaaacagcagaatatagtgtcgtggaggggaatcgatcctagaccttgctcttacatagggcagcattccaaccactaagccagcccaaccgtaggtattcatatgctttaatctacttacatagcatttacatcctagttacatagtagttacatagcacttacaccgtaattacgtagtagttataccctaattatatagtagttacatgatagttacagggtagttacatttgtataaaattaggatttgcaaatttttttcaagagcatatgtgttttacttttgaattattcttccttatacatgttgaataatttcttaccattcaatcaactcaactgtggatgctaagatcctatggttaaaaaatttgaaagctttgagcctcaaaaactgtcgacagattactagctagttccttgtgttattatttaataggagtataggacgtaaatctcttctgctacttacagaaggagtttcgtcaatcccctccgcaacgcttccggtatgtgaaaaccctttcctttctcttaaaaataacatctgctttagaaaatgatttcctctaaaagaatccaatcatatgtctagaaaagataaacgagccactcagcccaattctttcaatgaaattgaataaaaaaattgtatcgaagaacatcatgttacaacacacaagtcaataacctttttctttaaaaaataatagtaatcccggttttgcttcaataaaagatagccaatgagcccataaccatagaaaatctgagggcaaaaaatatataatcaaacaatgcgggggtattctatatcttactaattaagtacaatccatctattaagtgatcctattaatacttgttgaaatttcatacaattgtgggggggtcaaagccgggcacatttgcctccactgtcctccaccgttgatattttaattagtttagttccttctcctctaggtggggtggattgagaaaataatatcattggcatccctagtcaagtgatgccaatacatttgtattggagcattttttatttctaaagtgtattagcaaagtaaatagcaaaatgtaattgacggttttacgagactgatgcttacatgttgaatccaccctgctactcctatgtgatgtgtcaaaacagttcgataaatatcgcagaacggagggggtacaatttttggcatgtgtgttccgatgttgcgtgcattgaacatggtacactgtgcgtttgcttattcgccatggtacatactcctattcaacaattgtctagcccaaacatggcaaagtttgaactttaccctaggagaatcttctcgaacttgctggatgctccacccgtttcagattataagtcattttgattttggttaaagtcaaattactttaaatttaactaagtttatagacaaatatagtaatatttacaacacaaaattagtttcatctataattgaatatatttcctgggttgaaaatgttaattactatttatttttacaaatttaattaaacttaaaacaatttgatcttgtttaaaatcaaaatgacttataatctgaaatggagggagttgtcaagtagaatagttgccctggattttattctatctagcattcaagaagatgattttgttgctattagttccttgtttgatgcatggtctcaacatgatcatggggaaacgccatcaaaaaaataattgcaagactagttgtcatactccaggtaaattaaatgtgtgtcacatcggtgtgggttccgattacacaatccagctgcaaacgcaagaaaagaagaaacataccactcttaataaattaatcatttctggaaaaaataattaatactgaatcatttcaagatagaagcatgcagaacaatccatctctttcattgatcatgcattgcaattgaatgcatgagctagattggatcacagaggggaaaagggattgtaaaccaccaaaatctttgttaaccaaatcaatgcaaaaatcaaatcatcatgcgtgcttgagtttgaaacactgccattgctgctggaggaattatgatgaattacaaggctccgcaagaccgcaatgaacaggtcaatataccagcacatgtatgattggcactttgagttttccagcctcatcttttcacttatacttatcagccaattttaaatttttaactttaaatttaaagttaaatttgggttttttccatcgtagtttattttttagtctttgtttttaaatcgttaagaacacatatatgaaaattttattcacaaattattttttatttgtaaatatgttgtttcactttttcctccaatatatcaaacgatgaggctgtttgaagcatatgtacatctactgtatattacgtgaacacgaagcaagaaacaattatacagtgtctctcaaataatttggttggataacttgtgcgtttgattaactgttagtgcaaatagagctgactacgcctatttttttggtggtgtttttaaggtaattgtgaaatgaaagctactgtttattttgtacatcacgttttattttaatttttttttccaaatgaggcttttgggaccaattgtcaatacctgctcacatcaatctcgtcattttaatttagatcttcgatgatgctgttacaaacgacggtgtgaataatctgaagattggcatatacactgtcaaacactaattaatcgttggcaggaataatgctttgttagcagcagtgctatcatagcttggttttcaatcctacatattttttcaaacggggatttgagtttcaccgcttcataaatatggcaattgaaaatgaattaccatcacgtgttaatttatagcacgtgggaataggatcaaagtgtgatgtgtgtcaaagagatatataccgtggcttatcaccaatgtcgctattgaggagcgtcgaattatcgaaggggtcacccctcttttttcaagcataggatcctcactgttatattgtttaagcactcaatgcgatcctatcaagcataggagtatcaatataatgaatccttgtcgatgttacaaaaaaccattgcacaacagtgcactccgataaaaaaaatagacagtcagtcatgtttatatggaataaccatggaacaacatttataaaaaaatatttacttattgtatatattataatggaaaaccatcgtcaaagatttattttagagaccgtgtcattttccaaaacatatgaaaccatagggaataaactttttagcatataaaatttgataggtttaaaatggggtgagctatatttcttttcatttctagctaaaaatattgaaggattgtaaaaagaaaaagagtttacccggcaatgccggatgacgtggccaaccgtttcccgccacgtggaggatctactggtcgctcggctgcccgcgtggcgcgctttgaccggtgcctttgcctcctcgcgagggaagaagaagaggagccctagctatcctatcatcgcctatactggctactgcctgtgccgacggcgacagtgatatgattcagggtagagttaattgggccgccggatatcgcatatcgccattcgattaatcaataatactactcctactagcgttcgagaaattttaaatcttactaatcatgagccttttcgagccttggattaagacccagacaaaaccagaaccgctcgctcttcaagggcgcgcgccgcgtcgtcggtaacgccatcgtcgcacggtgtacggcagcacggctgtcccgccacgcctccgggtgcgacgcgacgcgggcttcgccggcagcagcagccaaccaaccgatcgactagcttgtggcctgcagagacgcgcgcggctcgcgctagctctcgtggcggcggttgtgcgtgccacaccactgttacaagcttcccttggtttgaggtatacacgaatacggcgtgcgtgcgtgcgtggcgggcccctgcagctgcagctgctgctgccggtggcggcggcggcggggtggaagccctgtgcgcgggatggcgcccgttccagcggggcacgggtacccttcctcttacttcgcttctcctctcttcccttcccattcattgcatgccttgcctgcgtagttcgatcctagggggggccggtgtgtcaccgccattgcgtgcgcttggcgttgatcgcgacgctggcatgtcgaaggttacatgaaccggggacaacccggttacacgtcgtggaagagcagatcgagaccgcgatcgatcggctgggctggccacctttttcgcgaacgcgcaaaaaaaattgcatgttgatatattagaagaaaaaaagtttttgttacacgacataatcagccagatcaggctggcctggccacctcgaggctccatgctcacacgagcgcgatacctgcgcgcgtggtgttcttttcctcgaaaatggaggcagaacaagtaaaaaattctgtaaataagaaagaaaaagtaaattatattatgggtcatatatttttatgttcttttttgctttggattatttattgttaccctttggaccgcgtgatccacatgtaaatgacacatggataatagaggtagttagtttcattgacaggtagaccactcggtctaagtgtaacatttggtaccaatatatctactagtccagagtggaaaaacactgcaaaggaaattcaaagtgaaactttagtaagtatatgtggtccaaaatgcaaattactactcaataataaaagcagtagtatgctactggctgctggctggtgctggttgaaaagccatttgcaatgcttaccagaaaccgcaggttgaaacccttgaagcttcatcaacgatcatatatgctgggcaggaggaacttgctggatcacaacgcggcacagggtggttgctcccagcctcccaggtttaatttgagcatatcttagttttctcatgcaggtatatcaatatgcagcaaagcttaactatcgattcattgaaaagagataggtcacctgtgaatcacctgtgaactgactcactgcccctagttcgtaccagaagagaaacatatgttacaatcaaagaaagacatgttaattttgcaacacctccctgcgctctttatatatttcgttccccagtgctggaatgctaccatccaggcattagcttgggagagacaaccactcaacatacaacatacgctccttctcacagttatatcaaaggtagcagtgataaataaaagcctagcagtaaacaaaacctcgctccagatatacacgccttattactattgtatcacttgtacaaacgttttggcaatagttggacaacaaaaatatttttcacagaactgttcaaattagaactgaactaagaatcacattttctatcatgcacatgtggaagctagttttagttctaattaacaaataaacagaggaacagaaggcagaaccgcaggagagcacaactgcacaaggcacaactagataattgccgacagagatacaataatgtcagaatcaaccaataaaaccaggtccttcaggattgcatcacttggaagtttgaaacctgacctctgaactatatatatatgtatctcttggtggatagcctcttttggtaagcttctttcactcttcatgagctcgtcttacctgaggagtatcatcttgcccagtaaagtatatcatgacaccaagaagagcgaagacacatataagaatgtatagcgagttcaggctgacaagagagttcaggaaacccatgaaagatgggccactgactttcttctttgttgttcttcctgctctatatccctcaaggaattggcttatttgagaagcttgatcaccttcctctaacttctctgagccttccacctttggcagaaaacatttttggttaattacagggtgtaacaagttctctattagtgctaaccagccaagcagaaaaagatgtttcagaaaagattataagtagacaggaaaaaactaaaaactaaacataatacttctatgaatatgacagaaaaaatatgagcatgccatgaatatgcattaactcgaaaggtggctttatcagtaaaatagcacaggaaggggttgctgatgctggtgcaggcatggatttctaaggttctctacaattatacttaccacttcatactcctcatttctatcccagacgattagctttggcagctgtgagctcttggaaatatcaaaagtctcgacaaactcatcccattgtttgattccgacatacccaaacaccaagtcacggtttgcattggcagcagacctcaaaacttttaccaactgtgaagaagtttcatctgaatcatcctccaaaattgcaagaacaacttttctgtcatcatcatccaacattttgagtgtctctgtgttgatggggacagtcaaaggaagcagggattgccgtataaaatcttccaagaaacttcctgtgtgcacaagaaaaaagaattactaccacatatttgctaccaagaaattcatgggtgaaatagtatgaacaattgcaggtagctacaattaatcaccctttgttgacataagaactcagaaataatgtgatagtttgaattacttcatattagcatcaagaaaaatataaatatataataataaacacaagaaaagagtaaaaaaatagagttgcctaataaataccttcaaatgggccataaaatacactttgttctttgtactttggatgaagtgaaaccaatgcaggaaccttatcaaaatcataagtgaccatgaagtcctcagaaaaatcttttgcaacagcaaaccatgctcttttcttgtatttccctccataaccagcaatcaacgactcattcaccccaaacccaatgaacattggaaagctcgtgccagcattctcaacaaagctcttgatcgcagagtccgactcaagaatagaaacatcaggtgcaacaaacttattaagattgcggacaagcaagtcagcttttcttgaaccagtgtattcgatggggaccccgtggataaaaagcatcagtgtagggaacccgctgtattcagtaaaaaggaaaggaatattaggcatccaccggcatctatactgtcaagaaaaattgaactagttatgagggaaacatcttactccactccatatttcgatccaagcttcctgtacttgtcagcatttactttggcaactatgatgggctcactcagtcctgccaacaccggtgcagcttcatctaactgcaacagtttattttctcaatcttaagtcctagtataaaacagtataatccacagaaagttccctgctgccataagtagtaagcaaactgtaaaattcgagaacctagtaatggccaagaatgaaacatcttgatgcgtctacaagacaatatgatgattctcacgcgaccacgcccacaagcccacaataatacaaggacttgtctctctaccttttcacagtaaaaaaaaaagctcacaacaatttcctttcttgagttcttccccagagtaatctcgatcataatcaaaacgacggcatataacatctcatttgttgtctaatggtcaacataagaatcatagtgacaatcctaaaactatataataaaaaaaattatcatcctttaccctttcccccacacgccctaatctgcagttcatgagatctcatctcgccgaccaattacgatcccggatacctagtcaaacccaccacccccacaacactcgctgcggtgctgacgagatccacagcgggcggcaaccacagctcgcaacagttgttcactcaattcgcatcgcatcacatctcgcaacttctccgcacgagttcttgatactggtaacaagcaaacacaggtggtgctggtggtcgaggagaggggagtacctcgggggcgaggcgcttgcagtggccgcaccatggcgcgtagaagtcgacgaagaggtagtcgatggcgcccagcgccgcctcgaagctgctctcgtccagctctatcacccgcccgtcgcgcgggaactcctcggcggcggcggcggcggcggcgtggaaggagagcagcaggaggaggagaggaggcagaagcagcaggaggaggagggggaggggtctcgtcgtcgtcgccgccatcgccgccgattccgatctccgccgcgccggaagggagtggtcctgacgcccacggaacttgactagtctcttgatggattggaggggtttattgggatattttcgtattggcccctctacagtagaaacgtgtacattttgctacctacattaggggtctcatcgtttggctttttttcataataagctaaaacggtttattagagaataaaaatgaatttgttggtaaaatttttatatatgtgttctcggtgacttaaaaaccaatgctgaaaaaaaactacgttgaaaatatctcaaaatcaatatcaaaattaagtttaaaaattcaaattttggctttttctttggctgaataggccatccgatggaagcctaggattagatgatgtgaaagttaacctttgttaattaatttggagcgagttgcgtttcgagccttttatcaccaaactttcactttagagtaagaataaaagtgagctataactatataaatttatgtgaaagtaaaagataaagaaaaaacgagaagtattggatcttgagtaatagctagctatacatttgcttcaagacatttacattaaatatatagttagagaaagagatgatagaaaaaatatagtcaaatctattatacattttagttttagtatgagctaatagctactagtaacagttagctatactattaaactcgctcttaaatcatcctttagccaatctttgtttcgcatttattgtactctggagcacataagtgaatcacccgtacaccgacaatctttcaggcttacgtgtagaccatcatttgtaaggtgagatagtagatgcactaaagatgggattagaagtaaaacttcgataacaaagaggtggaccaaagtgaaatctactaaatctgtttacacgaattttacaggtcttttaaatagaaattagtccatttgctccaatattcctccgtaagatcgtataaaggagggcaaacgtacttgatttagcaaattgtaccggctaacactcgtcctttgactaattattttgttaccttgtacccgtcaacattatttgacgtttggagtattaagattagtactgccttcaacgtcaaatattattgactgaagggagtatataatcccgtatgtgaattctagctgacgtactgatttgagtccaaaaacatgtgtgacctccaacatttccgacagattggcagattgcacatctctacaaataatctgaaaactaaaaaagaatatgaccaacatcttctgaaaagaatggactcgtgaagctctgaaaagcacgaacccgtgaagataatactgttgcaggaaagaacggtaagtacagcttttcagaaatttccagcaacaacccatcaagcagaaccatgatatagatgggcagtgcaactaaaatacaatcgtggttagcatattcaagaactcaggttccgcttccatgtataatatccacatcagcaaaagaaaacttgaaaggcgaggtgtaaacaagtagtaaacatgaattccaactatcaatttcaatcacaataagaaataaaaaaaaatatgagttaaaacaactgtgatcacgctgcctggtttctccacagccaggaaagttcatgccatgatattattaacagaaaatagcagtattcctacatcaaacgccatgaaaaggagcttacaacttcaggcaagtgcaaaatggagtaacaagcaataaccaatttaaagtgaagtcccaattttaacttcgcggagtgctatagaaagtaagttcattatgtagcacttagagagcttatccggaggcggtcttcttctgctggaaaacaaccgcataaactgggactgcgatgccaatgccaactgctcccagcacggaaagatacaccttcggcttctggtgcttcatcctgtgcaagttgtacatgtgcttggcatggaggtagtagggctcatcatggccatgccctcccatcctcttcacaccagtggcatggaatccacgagaatctgttatatgcacagagaagagaattcagcaatcagaagtgaactaaaatagtagagttcacaatttgatgatacaggaacaagccaaacatctcgaaggcaaatacacatccaaaccaataactatatttgaagatactactaaacaataaaaaaagaacaagccaaacatcaaagatatatttgatgatactactaaacattaaaaagaagaacaagccaaacatctgaaacgcaaatacacatccaatccaatagccaacaattccaggtctccactcttcccccatccaagctactctgattatctctaagattcgctagaatgcaccatagatacatatagcatgacaagatggacacgtatttcgacccttggcagaaaaccattagtaatactgctcatcattaacatcacagacaaataaactagttaaaaaacggcagcgagcaggtgactagacattttgtgagaaaaacaggttatttgcacaatactctcctctgcacagatgaaaccagggcaaccaaaacgagaaattggacattctgccattgccaaaactaggttttgccaaaatgccactccgcaaaagggattcgttaaaatgccaatctcaacccgtggctacaagctacaatgctatacgggaccaaattaccctcgttctcctcgcctgggcatgtggagctgcttgctgttgggtcagtccatggcacggagcagcgaggacgtcgctggcacagcggctttcggcgaacgacagtgacggtggcgttcggcgagcggcggcaccggcaggaggcggcggaggcgaacgcgccgccgccaccgcctgacgtacgcgcgccgccgccgccgctgccgtccgacgcacacgcgcaccgccgcagccagcaacgcacgcgcacgtcaccgccgccgcccgacgcacagaatttggacatcagaatttcatcacagttcacaagatggccatccgtttgatcatttcacagtgacggcatatcgcagattcacattccaccggcctacggtcgattcagtcaccacaggctagcccaaaaatcaaccaccaacatggtccatcgcgggattcatccaaacgagaatgatgtagcgattgatctaataaacgcctacgcaaaccaaatcacagcggcccaagatccatcagccctagaaacatttcgatcgccaaacccccgattcgcttttccaggagtcgcggatctaccgtccaacgcatccaaaccaccacccgaacaaagagaaacgggaacatatgcatccatcgaggcgaatcgctcgccgcccggcgccgaaaccctaaccaggccgcctcgcgcggtcaacgcgacgcagctcgaggggattggggaggagaagggaggggtagggagcgcttgcctgtcttggaggcctcagcgccggtggcgaggaggcggatcccggagcggaggccgcggttgagcgccgtcgccgtcgccatcgccccctctctggtttcgctcgtgttctcgccttaggtcgcccccgccgccgccggtctggtggtttgggttggggttgggtgccgcggtttcgctgatcttggctccactaccggttaggtcaatctcaccactcccgagagatgcggggggagtgtgagtgggcttcgtaccttgggccccagcgctgtaacatgggccgtgtgggcctccatgggcctgaaaataaaagaagaaaggaaaacaaaccagacgagttgaaaggcttcctttccttccttctcttcctcctcgtctgctccatgcttccagcacattgcaatttcagttcttttcactgcacacttcaattctgccaagtgccaagaaccaaatgtttgaagccatatatgccatggaacgatcacacttgacacactgacactgataccttgagagttcctttttgagttttgataacccagaacgatcaggttgcctcctctatcatgacggagatgctatcaacctcctggcatatctgctcgatcagagggtgattgctgtcgtttgaagagaatgtgacgacctcccccttcagctcgatccagctacacccggtctccttcttcagccctcgttccttcatgaaccctctgacgctggcagcgctgctccacatctctttggcggcatatatgttcgacaggagtgtgtacattcctccgtcggagggtctagccttcaggacatttctggcaatgatctctccaagctggatttccccatgagagttgcacacgctaaacagcgtctcccacgcggtcgttcgatggtcagatgggattctcctggtaaaatcataagcctggtgtataaagcctgatcttcccaagagatcaaccatgcaggagtagtgatcagatcttgggaccaagttccagtcttcttgcatgctgcgaaaatggtagcagccttcatataggtaccccttatgtgcgcaagcagacaatatgcttaggaaggtcgcatgatctggtctaaatccagcttttgtcatcatgtcaaaaactttcaaagcttcatcagcaagaccatgataagcgtatgttgcgatcatggcattccatgtcactgtgtcccgctgcaaaatcagctcgaaaacttggg

SEQ ID NO: 66097 - DNA, 5555 bp, Oryza sativa
catggtagagttacctgacaagtctagaatctccatcttttccatacctgagaatatgaatgtgaatggatccttttcatctttggttgccgtatagtcttgatcaatcatcttgattacacgaagcttctgtatcttgttatgctgccgtttccaaatatgtctcaagttgtgcggtttcactccctcaacattgagctccctgacattgttcatttcctcaatcatctgtggggagaaaacccactgtgtgtactgtaggtctagcacccacaaaccatgaaaacagttccaagactgaacctcctctccagcatcaatgttcagatcaaggcagttatcaagcccaaggaatctcaatccgcggcaacagaggaaaggaggtgaagcaaatctaaaagtacagaggctaagttttagcactctaaggttctctgcatgttgaaacatgtcattataattttgtaaaagatgtgcaaggttgagctttgacttaaaaaaatattctactagttccaccgtgtcttttgattctgtgtcaatttggtgtgctgccaagaaaaatgatgacactgtttgagccactgctgaggcagccaggaacccataattacttgaaatcaggtgatttgttgaaatccagttgtcagtgttccgcatcatgtggtaaagtccagggtcgtcccattcttgccacatctcttgttgtagagcatcagcaatctcccattcctgaatgatcccatcacacacccaatagtttgaagcatgaactgcccagtcatagtcaatgatgtctctgccaacaaaattaagtttcgatatatacaaccaacatttggcaattgttgttgggtgcagcttggctactccggaacatgtgttggaagcaatttctgccgcctcctcacacaatatatcccaccaatggctttgatcctggaactccatcccatatattttgttatggaattcggcagcaagaaaaacatctgccacttgcaccttgtcctgaattctggtactcagccgaaacctgcccctgaaggtccacaatattttgtttcccttatacggttgatatagaggcagaccaaaattagttacatcttttatttcattatcactcccattatgaaaaaccacaagaaatcttctactcattaggacatcattaacagctattccaacatcattgatcacgtctctggagctttcatcttttccattgatatcatcagcctcatcctgctcatcaataagatcttttgcttgggtcatctctagtttctctgcaattttcctctgcatttcccttctgcttttccacctcgagcaatcaatgtggattatcttttcaaacttcaattctgggtctgcgatctggaccgttgtaagccgtttggcaacagctctgaggacagcagatgcacccaatccttcccaaccatcaaagtagaccacatttgatacatctgatttctttagtttgtcaattatactatcaacagcctcagcaacattctctgcggtaattacctgcagtggttaacagtaattaactgaggttagctcagctcagctgggttgcgtacaaagtaacacgactgtctagaagaagaaaaatcaaatgaacactatattcagagaaaaaaaaatgaaactatatatttagagggggggaaatccttatttgctatactccactttgagctgtcaccaaactaggtatgctgatgtaggcgaggctggtgatgtggagacttgttgccgcagccaccgtcccccacctcgtccatggctggcgccgcctccccatcctaagcatcatcgcccagatctagtttggtgtcaagcgcatgcgaatggctgctacttggggccatcagcaactggatggcaactgtggcgggctggcggcaaggtcaggaagccgatggaggcgggagaggaagagttgatcagcaaatgggagacgaggatgggcggccaacggccatactgcccatcagccatggggatgggagaaatagcaagaaagaaaatgaagagggaggaaggcgatggttcatggaaatttaagtatttgctactattctatttatcaattatccaaatgccaattttaattttgtgctggtaaatttaacgccccgcgctttgttacgggatatatattagatagcgtagaaataataaaatgatttggattgaaatatcgtgaaaaagatgatttggcatgtgcatatttattttgggagtacctatagaacatttgacatttttctaggagaaaaacttaaatgtaattacaatctaactagtatgtaactagaggtttactctgatctaacaaaaagtatcttgaggtatcagtacctcactgtatcaaatcgtttccgatcgttggatccaacaatgcccatcctgtccagtgagatccaacgatcggaaacgatttgataccgtgagataccagtacctcgaggtactttttgtttgaatagcgcaaatctcacgtaactaagatgtacttactccgtttcacaatgtaagtcattgtagcattctccacatttatattgatgttaatgaatctagatagatatatatgtctagattcattaacatcaatatgaatgtgggaaatgctagaatgacttacattgtgaaaaggatagagtaatttatatgtaagaaagttttgatcgaaggcgggacctcgagcccacgagtcgcccacgcgccagcggctcgggggcaaaccctagccgccgccgccacccaccctcctcccttctctctgcctcgccgccaccggagttcaccgccgaacaaccatgcggggagccaggatggcgggcggggccataccgcggcgacgcgtcgtcactggcacgagggaggcggggcgaagcgcggagcgcggtgagccgagcggagggcggcgcgctcgatggcgagggaggccggggatccggcaccgcggtggctagatccggtgctcccgcggccggatctagctgcacggcgcagggcgacggctctatcatgggcacggaaagctacggctgaaggccgccagcggcggcggcagcggcacgagggccgcgtgccggcgaggggaggactgtcgcccgcttggcagcatgctcgtgcctctctccggccggcctggtggtgtgcgcggggaggagctgtggggtggtggactgggctagctggtggctgagaagatgatgtggtggttcagcgacggttgttgtgtgaggtggtggtggcaatggatggaaatcgctggcgaaagccttgcttagcacttggctggcatgacgacggcgacgccctttggcgccgtttcctttcttggaggcgtagttatggcatttttcttcatcgctatcaatctccaggtgaaaactatgttccggtttccggacggacggtggcggcgtttcatgtcgtatccttcattggggcatcgtcttggagaaccttacccttgcttcgattactgttagcgaactcctgtgtcagctcgaagcactagatgcctaggttttggcgaggccttctccttcctggctccattcttgtattggtggcatccagcttcttcatttgtctctgtcaggtggagtcgaagctgtaacgtcgttggggtgcgacgttgcttggcaacgataacatttgcagtttctctctagggatgttggtgttgccagtgcaggttttggcgcctcaggggctttggctgatgtctaaagtatgagcttgctgttgttttgctcgttttggcggtgcctccaatgatgttatgatcgccgtggagtcggagctctgggtcgctgggcggcaaaggttggcaacgatgacacgtgccttgtgatgtcaaagttgtatgccgcttcttcagcttttcgacatcgatgttcgcctttggattctgccgtcgtagtttggttagagttgtgtggtgctcagtgtgttgtgttgtttgtaccggtcgtggttgaggggcttggcgagtctacttgccgagaggttattttttctttttctgtaacccgtctagttttttacttctgcttaattgaaatataatttgcagttccctgccggtttagtttaaaaaaaaattatatgtaacttgatcatttcctttttcaaaaaacacagcatcccaagtggctagtgccgttgacttgcaagcagcaagtcttgagttcgattaccaacttgcgcgtggaaaatttgtaagttttgaggaaataaatcttaaaataaattgtacatatatttagtatatgcttaaatgttgagttttgtgtgctttacggtagagccaaagctcaaacgatgagaaccttagccacgtactcctttcgttttttaatatatgatgtcgttaacttttagatatttatcttatccaaaaactttgtgccaacattttaaaaatataagtcatgcttgaataaccttaatcataaaacatcataaaaaataaataatgattataaagacgaatagtcaaacatattaaaaaaagttatttgtattatatattaaaaaatgaaggtaatactacttaaaaacttatcagtgttggacaaaaatagcaacacacatagaagagagaacagcaggacgtgctgcgtcaggtggcatcgcgtccaggtgagccccgtcatacatgaatcgataaatcatcttgtgcataaatcatattgaaaacaatatttttgccaataaatacctctcggagcataatgaattgccctcaagaccagcaaatcagggcaagtggaacccagatctcaccaatcagcatcacaccctacaaaaagacatgcattcagtgttggtttcttcgaaaaatttagatcggttctccaaacagaaaaaaagattgaaattttactagttagagagaagggacagaagaatcacttctcatttggagctgggagagaaagggagagagaccaattaagaaatgatagtgaaattgaggcaataagcaaagtgcgtgtctgaggatatcaggcagaagatagatggagcttagcaccagtgatcgatgcaactggtatgaatatattgtccctagtttgagtttcgctccttttaacaaagcttctaatgcgtatcacttttgaacaaagcaaaaggcaaagctctagcatcacttgtctgggtagtttataccttacttcctccgtttcacaatataagtcattctagcatttcccacatttatattgatgttaataaatctagacatatatctatctaggttcattaatatcaatatgaatatggaaaatgctagaatgacttacattgtgaaacggagggtgtacttatgagcaacaggaacaaattgtgtattgccatatacggaacactaacacacctttaagaaagcgaattacgtgatgtactccctccgtttcaaaatgtttgacactgttgactttttagcacatgtttgaccattcgtcttattcaaaaaaatttatgaaatatataaaattataggtgtacatgaa

SEQ ID NO: 66098 - DNA, 13465 bp, Oryza sativa
actcatcatgttgtcctttgatagaattctgttcgtagaaagtatatgcacgttccttatatttgataccctggaatactctgtttggtttgggctttcttccaaaagccggggtaatatatgatcttttatcgaaaaaaaatgatggagatcacttggcttttttggatgtttatcacttggctcaagcacttccccaaaactatgtcaaaatagtggtgtctgatcacatgttagttgaagtaaactacaatccgttgctagagccaaaaattggggtcaatcgtgatgatgaggaaaagggttaaataatggctgtcaccatggtttttaagaaccagcagatatgtatacacactcaatctgcgcagttttgatagggtaatggggtgaggatagctatattctcagcctctctcagagcatctccaataatgctccaaagttgaagatgatagctaggaatttccgatatttcaaaatagcagatgccgttgtttcctttaccacatgtttgaataaagaaataaaaaaagctcaagaagtatggatatctttcccacgaaaggatatatatatatggaccaaaccatcaagcagtacatatgcaggcacacatatttggggacattcataggcgtattaatggtcttgacacttcagcgtgtgaagatagggccgtggggtggaactggaggccatgcttgggatgaaggaggccatggtgccagtgctggcagttacaccggagtacgccgaatgagtatagggtcttcctggtgtgtcagctcgatgttgtttgaatacgacgacaatggcaaacgtgtgaaaggtaccctgcatggagagagagacaatggaatacccgaggtatgtagcaagcaatacttgatagatttgtgatcttaggatttaggaagtgattttccaagtgaaaacaatttctccactccttataggatctactctatcttattagaaacttatatttattactgccatgtctacccaaaatctaaatattttttgttgaaaattgattaggcgccaccaacatctgacgtcatcctattcgtcgccctctctgggtggcttttagttaaccggtacctataaattataggtacaagtttttctaaaaaaaaccgacacatatagtatttgtgttgattttcctctacaaccagcatatatagttacccaaaggtgacgtttctgtaacttttttcatcctgtggaggtagggaaaggttcatatgtgccggttttaaatgaacggacacctatgagggttttgcagtaatgatgcgctaagggttcagtactgtagctgtagagaaagaaactattaacttaattaccttcagtggaaaggtgggtaaattttacaattaatataccatttaaagaaatgcccacgcaaatgaatggttggattttactcacaccagtgccccttgtcacttgtaccgtgtatcgtaaaacaactcctggtaacgacgatgggcacagatcatgaccaatttattaaagcccaaggcctctgcttcttgcttctgacaatctcataaaggttttcatgagcggtgaaccggtgactagttcatttaatcatgatctaatagaactcatcaactagttgtattatagaatcagtagggactcttctttaatcgtggagttgtattaatttttccactgttttagttatgtaaaaacacagacaaatactcagtcgtcgattgaacggtttaatttgggagaaaattaaaacaaacagcttgcagagagatgctttgtactaattaatcactgactgacaaataacctgatgcatggacgcacacaggaggagctcgacttccatggggaggtgttgacgcacatgtgcggctaccatgacaaccacctcatccggtggttgcagttcaggagcaaccggaacaggacgttcggaccatacggcaatcttctagaagaccaggctggatggacgcggttcgaggtctccatggagcactcggggtccatcgtcggcttctgcggccggagtgacgacttcgtggacgccatcggcgtctacgtcgccgtctggaatcccgagaggttctatgatagcatgcgcaggcagggcgtccgcgtttaccgggcgtcgcctctgcgcatggacctgcgtcaaatagaagaagagaaaaagaaggaagaagtggaacgtgggcgcctacagaaggagctcgaggaggggcgagaaagtcttcggaacatacgattgaagcttgatatgccgccggatcagagaaaacgcctgatacgacgcgacctgcgagtggagcatcaagaaatcgaacgtcagttacaagagatgcagcaactggaacgcgagcgtcagcaactggagcaacaagaaatcgaacgtcagttaccctcgcgtcagcaactggagcaacaagaaatcaaacgtcagttacaagacatggaacgcgagcgtcagctacaccggtggagaaactttgtaaccggtggagaaactttgtaaccccctttagtcccggtttccaaaccgggactaccaatccgggactaaagatcgctatctttagtcccgggtgaaataaccgggactaaagatcgatctttagtcccggttggtgttaccaaccgggactaaagatcgagctgacccatttttttttttacatggccctgttgctgcatggtttatatatatatatatatatatatatatatatatatataaaccatgcatatatatgtttcaatacatatatatgcatacatatatatatgcatatatatatattatattatattatatgtatatacatgcataatatatatgtatttatacatatatatgttatgcaaatgcatatatatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatacgaataaactatatgaatgtatgaaattgattagtaattaaacaagaaatcgctacgtaatgaaattttgaatttatttatacgtacattgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagacttttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgctgtcgggccctttgaatctccattctacaacgataaaagggagtatattattttctatagtctacttatatacaaggacctaattaattaaaggagacgtatagtaaaaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcctagggaggatgatgtaccgcctgcgccatagaataatggcatggcatgtgtctcgtagatgcgtctcaccgtctcctccagggtaatccagctcgaggtcctcgtacgcgccttcgaccacctcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgagctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaaccgtgctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccctactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactagtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattagaacactacacaatcttatatgataagtctaattacaggtctaataatcttaattaattgcattacaaatataacaatcatttatattattacgtcacttgcctgctccaattccttctaggactagctcttccactcaggcttgacggacgactccgacaacacgtcttttctgcaagatacaaaaagatgtattaggataaatgcgaagtaacatatatatatatatatatatatatatatatatatatatatatatatatatatatatatatatatatatatatatatatatatttcacgtcacgttccgtcctcgttcgttcgctcgttcacgttccctagctcgttcacgttcgttcgctcgttctcattcacgttcgttcgcttgttctcattcacgttcgttccctcgttctcgcttgtcttcgttcgatcgttctcgttctcgctctcgttcgttcgatcgttctcattctcgttcacgttctcgcggcaacgtacgttgacgtgttcgttctcgctctcgttcgttcgatcgttctcgttctcgttcgttaacggtggtgtggcagcatcggggcggcggttggggcggcggcgtggcgacggcggcggcagcgtggcgtgccggcggcggcgtggcgtggcatggcggcggcggcgtggcgtggcggcggcggcattgcgcgcgcggcggcgaaaggcggcggcggcgtggcgacggcggcggcggcgtggcgttggcatgcggcggcggcgaaggcggcggcgtggcgcgtcgtcgtcgtggcgcgtcgtcgtcgtggcgcggcgtctcgtggcgggcggcgcgacggagagagatcgagatcggagagatcgatcgagatgcatgaaggggagatctggcggcggcggctctcaccccagagatgcggcggcagcggaggaggcggaggcggaggcggcggcgaggacgacaagctcgagacgatggcgagatacggcggggtcggcgcggggatttgccctaggcagtggcggcgaaggagagaggccgagagagatcgatcggccgaaaacgtctaagtgttggtgaagaagacgagggcgcaccgggaatatatatacccccggatctttactcccggttgttgagaacaaccgggactaaatctttactcccggttgttgagaacaaccgggagtaaagaaaagatatctttagtcccggttgttctgaacaaccgggagtaaatatcttttcccgctatttcgaaattctttttaaacccggttggggttaacaaccgggactaaagattatagcactgcatatgattttcgcttacatatgtgtttataaaatagaagttaatgcattaacattatttcaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttcaaaactgtaatgaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgtctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgcgctctcgtgtagaatgtgtacccattgatctcatatccctggaatgtcgtgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaattggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacctcttcagaacgcccatgtacctctcgaaaggaaacatgttgtgtaggtacataggcccgagaatacggatctctttcacaagatgacaaagcagatgcgtcattatattgaaaaatgaaggtggaaatatcaactcaaaactgacgagacattgcaccacttcattctgaagggcttctaatctatccagatcgatgactttctgcgaaattgcgttcatgaatgcacatagctttgttattgttgctcggacattgtctggaaggataccccttattacaactggtagtagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctagctggactcaagtaatggcttcctttctcctttggttccgggtgaaggtcgccgtgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcatgaccatcttcgctctctataggctggcttccaggcccctttccgaatactactttaagatctttaacaatagcaaacactgttttcccgttgcgatgtttaggcttcgtacggtggtcggccttatgttcgaagtgcttgcctttcttccgtaccgggtggtttgctgcaaggaatcgacgatgacccatgtatataaccttcctacagtgcttaagatacgtactttctgtttcatccatacagtgaatgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccagggggggaggttgttgatacacatcgtaacgggccaagtgctatggccgttgctcatctctccaaaaggattcatgccatccgtactcaaaccaaaccgtatgtttcgtgcgtcctttccaaattctttaaattttctgtcgatgtttcgccactgcgaaacatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcatagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaagttatgggcctccttttcactttcgcagtcctccctggcgtcctgcaacatttgaccaagatcattcgcaacgtcgttaccattagcagctatttcctcctcgcccgtttgatttccttcaaatccaacatactgagcaaagtccggaatattgtcgtcttccacttcatcttcttccatttcaacacattgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagtgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgcagcttgctcgggcagctggaggaggaagaagacatatatataggggtgggactttagtcctggttggtagcaccaaccggggctaaagatcaccgggatctttagccccggttggtgctaccaaccaggactaaagtcccacccctatatatatgtcttcttcctcctccagctgcccgagcaagctgcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacacttttt

SEQ ID NO: 66099 - DNA, 12644 bp, Oryza sativa
  unsure (1)..(12644): unsure at all n locations
aaggatagagggcacatgtatcaaatcaaatcaatacaatcggggcaatatggtccatacgaaaatactaagtaaaaaaactaactcaagggtggctgaggcatatataatgatatattctaatttagagaagtataagtagcacctatctagtttcaactttttataatattccctccgtttcaggttataagacgttttgactttggttaaagtcaaactgttttaaatttgactaaatttgtagaaaaaagttgtaatatttttaacccaagacaaatttattatgaaaatatatccaattattgatttgattaaactaatttagtattataaatattactatattttctataaacttattaaaatcagtttgactttgacctgaaacggagggagtagtatattggggattttcagttgggtctgggggccttttaaagtgcattcaattagccctaaaaaattgatatctttactcgtatatatatactcctatcaatccgaaaattccccatttctattcccctgcgcccccacaccgaaaattctctgtcgcgcgcgctccttcctcccgtctcctctcctctcctccgctcctcgcgcgcgccatctcgcggaggggatcctggtgagcatcgcacttcctctctctgattcatctctctctcccgccctcgattttttcgcttgcgttcgttaaccctagcttctcttgtagatctgcaagaagttcttctcttaatttcagagccttaataacagtttgagtttgtttgttcccccgcaaaaaagagtttgggggggttcaattgaagttggatccgccgcccctgcagatttggtcgcctagcttccttacctatggcggttcaacctgcagagcgcggcgtggaggctccacctctgacgctgtcgatattcgagttcaacagtaaggttgtgtgtgtgtgcgcctccggtgacggtgatgccgcccgccgcctgttgatccggttcaatgctttttgttgatgcgagcgagtatgggaattcttcgtgtctgatattgggtgtgcgcgcgcgccttgctctgcaggtgatgcaggacgagctgcagaagctggcgctcaaggtgaaccaccacgaggagaacatcaggtttctcaagtcggagctcaatgccgtcgaggactcgtgcgctgacctgggcagtgagatcctaatgccctgtgacaccttgcttttgtatatacttttaatttacggattcgtggttatattcgtgtactctagtaatgctatatatcggtaccatgatgcagaataactgcgtagatcattaattaaacactatagtgaataattcgagccttgcgatacctagtttctggtaaataaggcctgttaattattaactatggagcttgtggtcattaatttttagtatgtcagatatattttctgtaaacttgagttttatatgtatgttcaagttggccagatgtggagtcatggatctgtgaagaggatgaatgacccatatgttggcatgaaaatatttatgagaggagggatggggtgtgaaaccaaccatcaccaacttaaatatttaaaacagtgaaaatacctaaatgtagttagtgatgtcatcggaagaggaactcgcagtatttgggatgaatgagcatccttgtgagtggattgcattgtcctgtactttggtacacaatggaggatagctactgttagatgtgaccagtaggcatgggttaatgtagaaagagctaagatagcaaaggtactcagtggaggtagagagagatagagactcaacagtcaacatgaacaggtctgttgagccgttgtttgcccaatagtagctaatgtcttggtttactttatactagctctactcctttttacttgatgttttgggcatcaatacagtatccaatgcatatgtttgataattaacatttctaataatatatttataaaaaatattaagaatataattgcatgaaagtgtttttcatggtgaatctgtaatatcaattttttttgcatattagtatatcttaatatttttgtatatattgatgatttaaattttgaggttgactatacacattctgagacggcatctatttaagaacagggggagtatatgataagctgtaacatgtgtaggaactgatacaccctaatgcaataattctaatgctgacaagcaaatctgacataccttggtagaggtagaccaaaaaaacttgcgttctaattcatgtcttacttactacccatgcttatcctaaggtccatatggcaagccaactgtggcatttgctgcttctgcgtgtgtgcctttaggtgctagtgtgctactacttcgcatgacatatgcatctatctaaatcaattgaggcctctttgagtagaacattggaagttggttgttgagacaacatctctgcattagtggtaggactagcaagctattgcaaaatctttttattatcacgttggaaattgaatctttttgcatgagcctaacatatccaccattcctattatctaatgttcttagcaccattggattattgcattagatggctgtggtaaatttgaatttatcatgcaagtaacaccatttggataaagatatcaaagctatctataattccatatactctttctttaactcatttccataattccatatactttttctttatcttattgcccctatttatatgctgaaccctggaacttttctcagttaaaataggcaattattattcatcgatggcggcaattgcaaataatgacacatctgttgaagaagctgaacaacgcactattcaaagtatactcaaacaggacgagacagcagctgggattatatgccaactgaagattcgtcattatcagcatgcatcaaagctgccactgatgaaagatgtccttggtgtcgtagctaccttgggaaaaataaataatgacaacctcagcaggtcattattctctctttgttttgacatataataagatttattgcaccaactggtgcaaagttaatgggcagaattatttgtttacttttgaggtaccatgaatttgttatagggtactctcagagtacttgggattggacaatatgcttggtgtcgtctgcaagacttatgatggtgtcgagggtcttgaaacatatgacaaggaaggtatggttgataaaaccagtggcattcatggactaggtcgcacaattggaaaatttttagatggaagattcactgtcttttgtcttgaaaatataaggtgtgttttcattgtgccgttatattttggactctactggatggacaccttaacattataactattacactttgcaggccattttctggtgattttatgatcgatgatcctcagaggaaacttcttttgcataaaccaaggttgcctagtggagagttcccacctggttttcttggttttgcagtaaatatgatacatttggaccaggcaaatttgagttgtctcacagctgggggccacggtcttagggaaactttattttacagcctgttttctcagttgcaagtctataagactagagctgaattgcgaaatgctattcctttgataaatgatggtgctgtttctcttgatgggtctatactaagacctaatggctcattctgcctaggtaataggtatgcaattatatggatttatcctttaacatcacatcatatacttttatttgatcattagtgttctgcatattgtgggtccttcggtgatatttaattgtcctttcattttatgagtatatgcgtgatacattaccctggtttgcttactacataaagtctggtaacanaatttgcactgttctgtaacaaggcatattaagcttaattccacctcttctttttgttaatgattatacatgaccttacttttgaagggcaagcttacgaatacaatttcctgtaactgcaaatcttggggtctcaaacttacccgtaactatcactgaactggaggagcaagttaaacataagaattgggaaaaggaaaggcttctcgaggatataaaaagacaagaagatttgttgaaccaagttaaggatttgttcacaagaaaaaggaacagttcatggcttatatcactcaaccaggaatgttacaggtgaacttacaatttattctgttattttcttgactgtactaatttattagtaatttattgtcatccggagttacagttagataatgaatagaattctctatttctatgaagtgccactgtagcaagtacacatataggtcgcttgcttctaacaacggaggggaggccggactgctggaggggtctgctagagaatctaatacacttagcttttttaatattttttttccaaaactagatgtttgtaggatgcatgtagctgccttgtcactttgagagcaaatgggaggtcagacgtgtcttctatctgatacgctaagcttggtttttgtttttcctgaaactagatgtaggatgcaggtagctgccttgtgagagcaaaggggaggccagaggggtcttctagatagtatatgttccattttgaagaaaagaacttgtttgatgatataagaagtataactttgttgctgcagtcaattgatgatcgtttgtttgatcaaattgtggctgattgaatggaagtagcatgtgcattagtgcatagcaggatccacatccattctatggcttatgttagcaatgttaacttacatatgaactagcatctaatattgtaacatactagtacaagctatacttctgttaagacacctgaagagcaatactgtaaattattgtccatatattcttcttggatagggtaaaatctcagtcagctaactatttaacttgcccggtggaaactggcgaattctaggatgaggtccaggttcaaattgtttctttgaggataaattgcatttaatttatacttcatttgtgcccatcatttatgatatgtattttcttcaaatttctattttcccccaaaatatattgaattcagaagaatggaaaatggtgatacgacaatggatctgatgtcttcactttttcagagagcatcgcaggcttcaccgacaattccttcaccagctactcctggaagcaatccatttggatcaaggcctccccacctgcggtaatagcataagactctaggcatttccttcagattggagtttgccagtgatagatgatggcttgatggcttcatgccgtcagaatgcattgtgcaacaatcttgatggcattcgaggaaaaaaaacaatcttgatgttactggcataccatatgttgctaagttagtctgtcattttgctagttgcaagttgcaacagattatactctcttagtttttttttaaccctttcatcagctcttttgcatcttgtcaaaagaataccctttaattagctcttctgcatctttgttagaggaagataatagagcaggtagcgaagaattgaaggaacatgcaaacgggatgtaccttctccattaatttgttgaaatgcgtgtggtttcagaactttcctgctggatgatgcaaggaatttttgttttgaacatggtgtagaaagcagctttatcatcaatgaagaaacccaactttgatgagaatttaccagtttcaatttctcttgctgatctttaagtgatgatgatccaaagctgtagtagagatagatgtataactagggtgtcaccacctttatctggcatcaacacaattgcatgcgtggtgttgccgtttgattcaattttcaaatgactaatcataataacgttagcctatactttatgtccagcatttttaaagtttggttgtatacttgtatacattctgaaaatgatcttccgtctcaaaataagtttatttttcatctatcctacacatataccaatacaaaattaaaaaaataccctcaatcaaatatcaatgtaattatttctcaatttatctattcctaatgcatttatcctctacttgcttaaaaataaacttattttggaataaatagatgaagccaaaaatgattttattttaggacggagggagtaccagtctaatgttttttgccgttgttcataatacattcagcaacagcattaccaataatgtcgcagtgtcaaggctcaatagtaatcaagccagtaaatcaacaatctgatattgctactcttatcataggatagtagtactttcaaagtttcgatacaatttcgctattacacctggtagcaatatgcaacccatgaatgccatgaggcactgggatattacgtcagctacagagttttgcaggctggggttgaagttttgaacatccttgtccagcctagagaatgttaaaaatctgaaataattctggaagccatccttggtgatgcacactgcctcctacttgatcacctcatagacaaatttgcttacatttccaggcttgaaatttcttggactggatcacctctcagctctcgctgcaagttggaaaatccaagtgagatcaactgatatgctacaatgtacgagcaagatttatacatgtcatttcttatacaaaaggagttttttttcctcaggaattctctgttttctgtaaaattcctactaaaatcataaaaggagtgtgtttttttttcttggaacaattcttagtttcctatgaaattcctataaacaccataaactcataatcatgtgataacggaatgaattgtgctgtgccataagctcataatcaaaatactccctccatcccaaaatgtacgacgataactaacattataaaaaaacaaaaaatccctccatcccaaaatgtacgacgacaaccagcatcataaaaaagaaatccctccattctaaaatgtacgatgataaccaacatcataaaaaaagaaacggagggagtagtaataccttttgtattttttttgttgttggaggggaccttcttccctctgccggaagccacatcgtccatgctctgcccctgcctccggtaccggccgccggaggcgacgaagcccggggcacggccggtacgccttgataggccaccacccgaagccggggacggtggctatgccgccctggatccgcccctcgccgttgcaacccctctccacctcctcccgcccgcaccctctgcatccctgcatatacatacgcagttacgcacacggcattgtcaagaaggtgcaagaaaaagttgagctggtatttttgaatttctctcttctttgatacaagaatcttactacatgtacataaagtagtttttttttttggcaatcttcagaagtttcttttttacaaaaagacaaaaaagagctttggcttacaaatcatgaatttgttactcaagccaatatatgtagagatgaatggaaaaaaagtgcttgccactccaaccaatatatatatatatatatatatatatatatatatatatatatatagagagacacacacagccactctagccaatatatatgaataagatgaaaaaaaatagggggattaagagtccaatgtcctaaccgctagaccatggaaccattcgttggtacggagaacaaaacaaatctaatatccattatatcaaattcaggaacccatttccacataaattccaaggatttattctgacattaaaatggaagccaagaaccactgattgatgctaataacatgccaattatagattctgaaacatgaagctccatctcagaaaacaaacgtatacacacaagtatgaagcatatatatttacctgaagttggggtcatccctgtagctgacaaattcagtctcagaaactgctactccttcctcttgagaggaggaagcagcagcaactgcctcttgctccttggtcaccacagaagcagaagagttggatgagctgctgctgctgcacagaatgctccctctggccgcctgtggatgcttcttgcagagcagtgaagagctgaggttgcctgtgaggaagacggggttgtggacggcggcagaagcaggtggagcagggagctgcagccacagggaggccgccattgttgcgcctcctgccctctcctctgcttcctcctcccggtgaggtgagagagagagagaaatggaggtggaaatttgggggtgggggggggggggagattggaggacgaactgggtgccacgtgggctacttacctttgtggtgggataatgcgtggtggatgttgctcgttggattttatttttcttccggaaataaacatattgttttacgtgttcttccatgaagaattttttttagggaacttccatgaagaattgaacagccactcgtgtaaatgactaaatgagcccccaaaaaaaaaggcagaagaatttttttttctagggatcttccatgaagaattgaacagccactcgtgtgtaaatgagccaaaaaataaggggcggcttcaaaagagcaattctcccaaaaaataaaggcaggaaaaaattgatgcaaaaaaaggttccaccgagatttgaactcgggttactggattcagagtccaatgtcctaaccgctagaccatggaaccgcttatatccaacatcctaacatatttaaattaataaacaaaagaacttgtccctgccgattgctaggtccaggaaacactgcattatgatcaatataatggtcctatagtgttcctgttcagttgattcttgtcttgtgctgaaactctgcatatactatcaccaacctaacgaaccaccaatacttactaaatttgttctcatttcatttggttctcgtggaatcttcatagaatttaaaagtcatcaagataaaaaaaacgctgtctcttctctcctctgaattccatcagttgcacgaacagaaactgtcagtcacactcgcatggcagctgacatttgatttcccaggctcgccgccggccggcggcgccggcacgctcgcctcgtccagccacgcaccgccgccgtggctgtcgtcgccaccgccggctggtgttctgctgcgcgccggcggccggtggacggcgctaggcacggggaacggccgcggtggcggtgtgccgccgttcgattgtctttgagcggtccagattgagtgatcggtgtttggtcagcgattttgtttgggccttcctgggtgttttctgggcttcaggcccaataccacacgtatcatttccaggcccacctctttaggagaggatataagaaaattgagatatttaaatcgaggttagatgttagcacatgattaatggatgagtattgattattttatatctagaaaattgattaatataaatttttaaagtaattttctatataacttttgatagaaaacgtacgtttaacggttcaagaagcgtatgtgcgtggaaacaaatcttccatctttctagttatctcgaacgctgtcttagtttaaattttagattagactgcagctgccggagttcatggcatggatgaagcacatcgtcgccggtcgccctcacccgccgctgcggccacaacgtccatcgctaggcaagtagaaccctaacatttttaatggagcgcactgtgcacataaatttggatatagagattgtacttgtactcttgtaggtgtaattggtatgtgacttctcacagttggtggataagaggtacctgtccttatatgcaaattgcactatatatagtctataaatagatcatataatgttatagataggacaggcctggttcattatcaaaacaattaaacctgaccaaatattaggaatatagtggattttggtatacttttacactagtgactttcgggagagatttgggattacaccatcatataaaatagaacccgtctaaatgttatccccataaatagacttcactaaaatggcattctcaaatagaagctacacgctaaaccttttgcaatttaaaatgatagaaatgtcatttgtccctctacttatcttccacctccaggctcggtgcaacaattggggtgggaggcggagtcatggagctgatagggtcaacgagatgatggtagatcccttaagtcaatatcatgtgtgttcttcagtgataaggcatgcactatcactaccacctaccacattggagctccacaaaggacagttggtacatgagcatgatgagaaaggacagccaacactggagttccgtgagaccaggaacttgaggaggttgtggctacataggagcttgacgaggacaatgatgcatgggcttgaagagatcacaacgcgagagctggatgaggacgacaacgtggaagctaaaggaggttggcgggacttgtgattgagcattgggccttgagctggtggcagtgcgagaaagtgcctaggacggtagtgaaacatcaaggactaaaggacggatccagacaacaagcatggtagaggagggtcttcacatggaggacataaggaggaaccatggcagtgaggggatgaggtggccacaacagcctacaccccccgaggagaagacatggatgatgaggttcagccagaactagaaaagaagtgaaggtccaagggcatttctagtgtgcagctctttttgcaaatggtataagagtaaagcccatttacataatgatatttaggttaaacctatttttacgatgacataatttcaagtttttcgaattttggtagtatggggctctgtttggtttaaaagttcacaaaattttagtatacttttaagaaagaaagcttccaaaactatcatattttagcacgaaaataatggtcggattttgtttattttgtgcccttaaaaaattggtaatgataaatcgataagatcaaaatataaacatatctacatctcttttcttttagagggtctattcgactgtttgatatagtatacacaacacaactagccagtatatccgttgccacagacataaattattgtgcttgctagctgtgttgcagccgaacacaaacccttccatatcccaaccgtatcctctgattgtataatgtcaccgcgtgacattacttcaatccacaccatccaatctaaatcaacggccacagattaattggtactccatctaactaatcaaactaactagcagagtatgtactatgtaggtatgtacttaataggtgggaaggatttttttttaacactaaagcagtctcttcatcttcattaaacattaacccatcggcttgtagattaagaattgccccgttccgacgacagaggatgtggcagcacaaaattgatgcacaggattcacttcctccaggataatgtgctaatcgctgcatctaacaagtactaagtgaaacctaattatcatcatgtgccgattcttccaccagtcaacgatgtttgcctcttgaaaatgcaatatctgatctagggacaattatagctgcacaatttactaattagtttgattaattgcatgtcaaataatctacggccgttgatttagaatggatggtgtggattgaagtaatgccacaccgtgacattactgagtaatgtcagaggatacggttcgttccatatcatgcagattacctatctttggtatcggtacaacagctatcttatgtaaaaatttctttatgaaaaaaaaacccgtatactttttttgttttaaaatatataatattcgattagccactatactataaatgtgaaagaagcacaaagaatactactacctttatctaaacttattttataacttgaaataaatttgatccattccataataataaatctacacatattccctcctcccctcttccaaaaaacccccaaccttagattgaattttttttagacgaaggtagtccttccatcccatgaaaaacaaatatagtactggatgtgacatattatagtacaaataaatcttgacacatatgtctttaaaaaaaacttaacctaggcaagtatgtgacatctattacaatgaatctggatagtcctttgtcccgatttattatactagaaaatgtcacatcccctcctaggtttagtttttttagaatagagggagtatgtatgtccagatttatagtattaagatgtgtcatattcggtaatagattgatttttgatgagagggagggagcggttcagatggaacagtagtccatccaggcaggcacctaggaaacccaggaattatggccgcatttatgttgtcggtatcacccgtatcacatcacaatacgtcaatatcacatccggatgactaggtaaaccagtgccggagtcagtccagtcactcacaaaatttactcgccggaaaacccaaaagaacggaaaagaaaaaaaaagtcaggcagtcgtcgccgtgctcgccgcggcggggtccatcggtgtcgccggcgccaccaccacaacccagacgaggggagacggcatccaggatccagcaataatagcgcgtcgcggtggtcgtcgtcctcacctaatccccccccccccctccccatccatctattctcagccaaaagctcccctcttctctctctccctctccctctcgct

SEQ ID NO: 66100 - DNA, 1904 bp, Oryza sativa
ttttttaaataagacgaacggtcaaacatatgctaaaaagtcaacggtgtcaaacattttgaaacggagggagtagttactacttagtgggccattgctttgtttttttgcatacgtgggctagtagaaaacaaaaacctaacgcaataaaaaaaagttgcacaaaggcccagaagcctgaccaaagaatacctctaacaccactcgtgttgaaaacatgagcccaaaagcaactacgcattcgctggtagctgaaagaacgaaaggggtgtccctttcttttttcttttttttttcatctgggccaaaaagggcattcagagcaatcaccgatgagccatttcatccacagagtgttattgaaacctaatgatatatagcctccatttttttcactataacacaactagtgggccctttgtgtggtagtcaaatcccaaaatcccagtccagcaagcagaggatctaatcaccaaacctaactaaccagcgtggcgaagatctataaaaatagagtgatgcccactgtcaggatgtatgccaagactgtaggggtgtgtgcacatacgattgggaagatacgtaaaacgaggtggcctattaagttgtgtttgggagtgagggttcccagcacgtaaaacgaagcagcctttagcgtgtgattaattaagttttagcaattttttttaaaaaaattgatcaatatgaattttttaagcaactttcgtatataaactttttaaaaaaaacgcaccatttagcagtttgaaaagcgtgtgagcggaaaacgatgagaaggggttgggaacctagacaaacgaaatgagccttagtgcatgattaattgagtattaattattttaaattttaaaaatagattaatatgatttttaaagcaattttctgatagaaattttttgcaacaaacacacaacgagagaaatattctctatcacctgctgccgaatgcagttagactcatacgattcagcatgtaccagacaatatcattatttctgaaaaaaatcctgcctttggaatcgtgatgattctgttccgacaaggtcgccatgtctatgaactgcactgctgtcgaggaaagacatctatatcttgtttgaattgcctgaatctcaggtgataattaagctagctgattccgtacttcgcggctacatgggtccattccttgaaggggtgattagccgtttccaggattctgtattacagcaggcaaagtagttatttgctcatcatctaatctacaagtgatccgccatccaaaccctgttctaaaacagtactattattatgacaaaagtaccatgcaatatcatctgtcatgtaacttcgtcgtgtcctcatttagttttgtcaaaactattgttatcgcatcctatatgaagtgtgcacattcttgagctagctacccattagtccatatcgaggtcaagaataatcatatacccattgggcgggtgctattggcgagatgaagaacgcgatggtggcacacaaagacgggggtggtcgcaccgaggagaggatctcgacatggaagagggagcccaaagagatgccacagagtacaacagggacatgggcgtgagtcaacaaccacgctatggaggaagccgacttagcgaaacctgatatctggcgagccaagtatacgtgctgcgtgtccttcataatatgtttaggccaatttaatataggcaacataatgttgcgatcctgtcctcatccatctgaaatggcatagatgcctattgtaacctgttgcgacttatctagtatgggcaccatttatcttaacacatatgctttattgactcaattttaaaatttatagcagatgaaaaccatatgcggacccacatatttatacttattaatacaaa

SEQ ID NO: 66101 - DNA, 3238 bp, Oryza sativa
actagggggagtaaagcgttatggaagcacatatatcagtgctagtctactctccagatcagtcggctaaaatgccaccggacagaaataaagtaaagatgcacgatgatggctgcaaactctaccatgaggaagagagacaacgggtcccacagaaggatcacatgtgcaaattcagttatggtagaaatgtgagctactgcagcattgtttcgtccatgtttagttttcaaatttgcaatttcccagtttagttaatttcatctctgtgtcgctgtctagtctatattttctggctgcattctcccaaactgccaaacatgttacatgaatttcgttgtataaagaaaataaaaagccttgtactattttcatttcctccgttctaagatttttttttccgctaggttacgtcgtacaatattaacagctcagatgttagtgttgcttaattcacaatttgcagagctacgctagttgaaaaaaatgtttttgcacgaacatatatatataacaaattgtaactaatgccactgctaataggttcatccagatgacacacatccaactttgctttctgtggagatgatacatctaactcaaatatggttaaactctgcatatctgctcacatacggttataaataaaacatagccgtgccaacatgcatgagcatcatgaagagggaaactcatgattttgcattgagaccatagcaacggaaaccatgggaaatgtggcatgtagacctacacatataggactgggaaacaccaggaatcaaaggagtgcactgtgattaggccaaccaagcctacccaagaatctgtgttgaggtagccaacataaaacttctctggttttactctaacacagccaaatgagtaggccatccaagctatgctgagagccccgcagcagtgtctgcatctttcgatcgatgagtatcaattgaacaagcgagtatttggtttgaatagcagattaggacagcaaaacgatcaccaaccaacggagcaacctgtactaaaggagatgtaacaaaatagaacagtgcccactgccgggattaagggaaatgcctgacaggattctctgacttaactacacatgcaattgagtcacagtcatatgaatatgaatcccactttgctataatccacatgtcagtgactcaactgcacaatagctaagtcagataatcccttttcgaggcactcatatgattatgttatcatatatgaatcacttattagtgttgttagttcgaaagattcaatttttttttgaacataatactatatctttatatataccagtcagcagtagcttgatggttgtcttaattgcaagtaacaaagcccaggccgaagcaacacatttatgtgtaacagaccctggtctgcagtagcttggtcaatttggtcagtaaacctataatgtattttagggctgtgaacctgtgatgcaattgcatgtacttgtttggttagtgacctataattaatttatggtcagttattctattatttggatatgtgactgggtttgtccatatgtatttacactgtattagatctccactgggttttgttggatattacctgtgcaataacctctgtgctatatggccatatgggttgttactgggtataatatttagacctatgtagtattttgaaatggacttaggctgcgttagcttgtgtgatatagggtgagaaaggacctcgttttctgcacgcatgcttcccaaactattaaacggtgtattttttaaaaaaatcttctataggaaagttgctttaaaaaatcatattaatccatttttgaaatttaaaatagttaatattcaattaatcatgcgctaatggctcacttcgttttgcgtatcttcccaatctccccaatctccttctcctcaaacacacccttagtccacttgttatttaccacttcaaatgaattaacaagttgggtgaacatattatgtaaattgctacatcttaactagatttatatctaactaggtttgcaattatatcgagctcataaacaggttgctcattttatggaccttcacatgccaataatgcgtaaatccctactctttagatgggtaggccaaaatttaaccgggattataattgggcttagcacataaacaacttgacaatagcatggctcttgacatggcacaagataatgtgtgacgtttcctaggttcgacaatgagaaaactaagagacataaactaaatgacatcgtcactagcttcataatggaaaaaaaagtgttttcatcacagaacatgattaaaaacacatgataggtgacgaaagaatttttgtcatgtcaacatcataggttttggaacgtggcatgtttttttagttttttgtgatgtaaatggagcatcacctatcataaaatttattgtgttgtgatatagctataaattgaatggttgttttggtctattgctcttaaaggaggtgactatattgattatccacatgacttgatgtgcatattgcatttgtcttcaacattaatgccctcaaaatatgggattactacacctaacctttaaaaaatctgagatttcaaaaacttggccggcgagagattattgacgctgtcaacgaggaagatcaacggtcttggcacgggcgacatgatcatgcataagaggcgagtacagtgatagagccggcggcaccgttaaaccctgacgagtaatagtgttttttgatgatcgactaattttaataggtgttaataaatatccgtagtgcaaacaacaatggtgaaacccccgtgcggccgctcaacctgcccgagaggtagctctgccatttgaggtgaccaaaccaacctcgcaacattgaacatccggtgtgagcaaaccaagtggcctgatgtgctccactacagtcccaatcccgcccatgcaagccgacatttatttgtatggccaaagcctcacagaatatcagtaggtcccaagattcttcatatcgtacctcaaatatcctgtccaatatgggccacatgttcatcgtaccaccattccggcccaacctatgccacacagtattagagaactgatcttttgacatggtacctaaaatcataaatatctcggttagattaaaaaccaatactagagatgctttagtaccggttctaaaattttcaaatcgtctctacatcctgtttcttgtgcatttaaag

SEQ ID NO: 66102 - DNA, 4727 bp, Oryza sativa
tcctgtacctgttgcatttaaagtccaagcccctggaaatatatttagttccggttagtattatcaaccgatattaaaaatgcatatttagtatcggttgatgttaccaaccgagactaaagatagaagatcaaaaagtctgggttggtgttaccaactggtattaaagattcatttttagtactgatgtgtgttatcaaccggtgttaaagatgccttcaaggtaagttcaaaaggaaagtatctctgttcaagttagatgtgtgtagtaggtgtgatggttacgtgtgagggctgaggtgagagatcttgacctcgaatcccacatcccacatattttttcacttgctatatatttttagtaccagctctgttgctacaactggtagaaaatgggggttgtaaatcaggactaaatatcagttctctagtagttgttacaacttgtggtttgcacattccggttcaacctaagccaacccatgcatgcatttattggccttgcaaataaactgatgatcaggagttgctacaatttctggtttgcgcattccggcccaacctaagccaacctatgcatgcattcacattggccttgcaaataaactgatgatcaggagcaagcaaatatttaaagtgatgaccgatgaagaaaatgttgctgcgaaaaagttctgaagttaagaacttctgaatatgtactcatgagacgagacagagaaatggaaggcatttggaaagccaatactgaccagagtttgagaaaaagctcgatcaaagggcctccaccaacttctctaggtttcctgggacttgcatgtgttctatttgtcatttgaatccaagaaacggagacatgcaactacgctcgtcatcaaatagtgttccttaattgatcaaggtttacgaaaagtgaagtgatcaaaattcgtttgagctcaatatgctaacaagcagggatctgtctcaaacttaattggattaattatacgtgattactgatcattgtggtttagctttgaacaaagatgacaaactgatttggcaggccatttcgctgcagccggcctaaaccaagcaagtaatttttttgagcggtccgagatcaattatgcaagcatataaccaagcaaatcaaagaaactattatctcattggaacacatgatttccaaacttgtttgtaacaaggatttttgacagatcatgctggttaattaggaagattctactaagtgtcaaattttccaaataatattgctatctcctcggctggctgtatttgcctgaactgccaaacatgcatttttaaaggtataagcaaaagaaaaatcatttccacaaataaaagcttagatgagttatgtctgactaaaatgttggggaatcaatccatttcaaacatttttttccttgaacttaaataaacaagattgtgattaacaacattgctactgctatatgcatatagcgaggtatttgaaaaattggcgctgctataaagggaaatgtcccctagctagctaaagtacgtattaatagatataaacatgcttattattagataaagaaacaaggaaatagaaaaagggaaactgagaagatcatatatgggcagcaggtaagctagctgtaacttttatttttagtcggaaaatcaaagtgtgtctaatgaattaccgataaccatttacggtaaaatacgaatgaaaagccattacccattttttcataagtagttcaaatgtacttgagctattaattcctcaatcatttttcatccaactattccacacgctttgtcagcatgccccttgctcagattcaaaaacattaaggacttagaattatggaatttataaccagggtctatgacggtacatcactgtagcattgttgcaatccttcttcaacagaatataaaatgagggtagataaacgaccaagaatatgcactactggagaaaccatctttgatcggtcgaacaaattccacaatagtcccggttgcaataaaaatagggactaaagttcaattggttagagctactttttaatctttagtcctgtcctggttggtaacaccaaccgggactaaagatcatttttacccccggttcaaaaaaaaacggcaggtgatgtcagacccctctattaattatttttagtcccggttgatattactaatcgagaaaaaaagatcggcatgcgcagagaagacgaggcgagcgcgcgagatcgaggaggaggaggcgcacgacataagttctatctcctcatccctcacctttatctcttcctcatctcctcactcaccccatcttcctcttcctcctccggatccgccccctcccctctccttcccattctcaggaggccgggtggcggcggcggtggcctcgcgcagcggcgaaggcggcctcgtgcggcggcggccggcacggaggccggtgtggcggcagccggtggaggtcggcgcgcctatcgggattttttttcttttttttcttttttccttaatgtgtaatttgatctgtattattgttgtgaatgattttgagaatgaactatgttgttgtcaatgatttgggatgaactatatacgttgctttgaatgatttaagataatgggcgtgagatatacaaaatagcaaaaaaagaaaaaaaaactttaatcccggttggtaacgatcttactcccggttgaaaaaccgggactataggaggttaccaaccaggagtaaaaatcatttctccaccagtgacgacagctgagaacttctttatatatgagattttcatagcaacaacagtttcggtggcataaccaaacttatatgattgggaggcaccaggaagcgaaggagcgcagtatcacttggcgaatcatccaagcccaaataagtagcagcattgtgtttgccaacacgaggtgcgataaaatctctatgattaacaactgcatctttctttgccactcgaacgaggagaccatacctcatggagggcaattgagagcagacgacacacaccaaactggactagccagcttgtgcagtttgtatcaaaacataatgatgcacactgccagggtgaagggaaggctggggttatggtcagcttggatttccggtgatatcgatggacactccgactccaaggacctttcttaggaccaaaaggttttgtaggtagagtgtagtaccgtgtaccacgcaatactttttcttcgcaatattgaacaatttgttgattttgtattagtaggagcagaaaacgtttataagtttgtttacaacatcccgtcgcaccaagatatataatgatccatagccatcgcgaaaactctgttccaatgagccgtatgtgtctatgaacaagtcatgcaatgatgtggagggaagccatgtatcttatttcaattgcccacatcctaggcgatcagcttaccaattccatactttggctatcaggcattttcaggttcctgtagcacagcaaacaaaagtaattattcggctaccctctcttcttcaagagatctaatatccaaaccatgttctaaaagaggacaattattttgacaaaagtaacatgcaatacgattagtcctgtaacatcatggtatcctgatttagttttgttaaaatccatcacaatcatgacctatgttactagaacgggatcggttatctctaacgggcttaaacatcatctctttcgggcatgacccccgtgactaagcaaaggtcagtgacgtgagaaaatatctcaatcgggcaaccggtcatcacggatgacacacatctcaatcgtgccaacacaaaagcttgtcacggatgactctcatctctaacgggcctaaattatagcccatcacggatgactctcatctctaacgggtctaaattatagctcgtcacggatgagtataatcaaaaaaaataaattttgtttttttgttcgcctcaagcctttgacctcactcgtgtgcacccgggaagaacttctatgtcagtcacccatcccaaaattgctctagaacaagcacgtttaacctcatagttctttgaagattggcttccggaaaatatattgtaacttgttggcatgagtattatattaatcctataaagccctgggccagtatgacacaccctagcatcccatctattcataaacatttattcacatacacaaccatcaatatatttaacacaatcgcattcacataatatctattttgatcacatatttcactagtaaaactgagttaattggatcaaatatatattttgcaagtattatcatgaggaggaggcaaatcagacttctagacaaaaacgaattttgaattgaattttacaatactaaatgaacttatataaaaaagatgtcaaaaataaatttgtagaactcattgagatctaccaattttatttttgtcatttctccatccggtcttgatttaactatataaaatttgaatttcaaaatataagaaatttaaatattttttcgggtagtaaatgatttcaaatggaaaaattatcaacaacaaagttgtataactcatcaagttctataacttttactttggtcttgtttctatataaaatttgttgaacaatttgaatttgaatttgaaaatacgacaacctcaaaaaatattttcaaatactaaatgatttcaactgaaaaagtcatcaacaaaaaagttgtataact

SEQ ID NO: 66103 - DNA, 1735 bp, Oryza sativa
gcgcaatgaacagtgacttttcttatttatcccgattttagtgtattttccatctaaatttgattccacaattcctaattttacatatatgcattttactcaatattcgtgttatcttaactaatgaattcaccctagattaatattactcatattttatttttatataatttatttgagttttaattagggttaattcttattccatcgcaatgaaatttaattgatccaaatatggtcgcgataatattttatttattactatccacacctaatctttatttttaatttatatttattttaccaatttgtttttaaggtttatttctaattaactattctttactcacgattaataatcttcgagatcaactccagataaaatagacgaataagatcggcatgatgcaattagtttaaaaagtttttgaaaatccgtatttttagagttttggttttgtcggtcgaattttcagggtgttacaatattttaatgataataacttgataaatataattattttctagttaatcacactaataaaagagtagaaaataattaaaataaatatattgtgctaaaacatgctaatttgttgtgtaaatagatactaatatatatatttatctattagtttattatatcaataaggtgaacatgtaatataaactatacacaatcaagctcggtcaagctcggtagaagctcgagctcggctcagtaaagctcgtgagcttttgctcaggcttgggttcggtttgtttggagctcgagccgagctcgaatcgagcctaagacaagccaagctcgagctcctcgcgagcctcgagcttttttgacagccctacatcgaggggaggatatggagaaagcagaagtggccttgcgggctgggatgctgccgagtctagcatagacaggggacatgagtcaccaactaggctcagaggaggcagcatatggacaaagccgacttggcaaaacttgacatctggtgaaaaaatgctacactagtacagatccttctatctgtggggcctctaatatgcctacaaatagcgggccatcacaaggaagtcatttcaatcgggccgaaaagtgcccgattgagatatggtcacacagacatgttagatgggtataatacttaagcccgtcacggatgacacctatcagtgactggccatagtttaggcccgattgagataacattccatatctcaaacgggcctaaatttacggcccgtcacaaatgaccatcatctgtggcgggcaccaactttaggcccgattgagataacatttcatatctcaaacgggcctcaagttggggcccgtcatagatgaccatcatccgtgacgtgtaccaacttgaggcccgtttgagataacaactaggcccgtcacagatgactcatcagtgacgggctatatactaatgcccgattgagatgacttaatctctatcgggcaataactaaagcccgtcaacgatgagtatttttccatttttcatatgaaatatttatatttgtaagttgaactatagctaaataattaagtgcaatataataattcattttatgagtcaaaataattttacgggtagtaaatgatttcaaatggaaaaaatgtcaacaacaaagttgtataacttatcaagatttacaacatttagtttggttatttttctatataacattttttgaatagtttgaaattgaatttgaaaat

SEQ ID NO: 66104 - DNA, 2849 bp, Oryza sativa
cactcgcgtgcttgctttactctgtttggggctgagtttaggtttgatatgaatgcctaagtttggattgaatatggtgaaaatagataaactataataataaaaggtttcttgaccgggttcctgggcaccccctctctttaatgtagctccgcccctgcccagattcaaaacaacttaagttttgcatcttataagaagggtatcaatggtgtatcatatatagtagaacattatttttgcatctatattgcatctactagttgaacacagataaaaagagggggaggggaggagcaagagtaggacaaccgaagacttctgtatgatattttcataatattcgtaggttcagtgttttcgctaggatgataaatacatatttagggcgctttgattcaaaggaaatttataggaattttagaggatttcatttctataggaatttttcctataaaaccctttgaatcaaagaaatgaaccctatggaattctatgaaattcctatggaatgcctcttcccgtacaagttttggaggaattttaacaagaggtagaacctcatggaagaaatcctttgagtctttatctttcctcaaattcctgtgtttttcctgtggtccaatcaaacggtcattcctatgtttttcctgtgttttagaatcctctgttttacacttgcattcctgtcagaatcctatgttttttctattcctccgttttttcattcctataattcaaaggggtccttaggattgggaggcacaggaagcaaatgagcgcattatgtcttgacgaatcaaccaagcgtgaacaagtagcagcatcctgttattgaattctggatgcagtaaaaactctcgggttttactctaacagtacaactgcctcttggaatgggcgttgaacaagggatgattgcacaacatggaggacagttgacagcaacacaaaagcagcaacggaacccgaataaggcttcagtagtgtaaaatggaaggttcatgctactgggacaaaggaaaggcgactttctccaggttggctggatgcatggtgagacacacttcgactccaaggatttttttccaaggattacatggacggacatgtggcagctagatgcattcgtccaaatatttgatgtgacaggtaaaatatttttttttaattcattcatattgtacttactgcagcagcagcttgacatgtctgtacagtctgacattcagtataatttcgcaggactgaccggttctttgactccggaggcgaattagagacaaatgaacaatttaagtgtctttatgagtgggtaaatcatcctttctttttataaaaaatcatcctattaattatgtacataactttctttttaatgtatactagttgtacaaccacgcattgttgtgggatattttttttataggttactttattttattcactacataaagtacatcccatgtagtcgcgtgtgacacttgttgagttgttatccaaaattatttgcacttaataaaaggccagcttctgccgtagtggagcggaggcccgtcgccgggaggcttgggctggagcgtagcggatcgtcatcccttttagggttccaccatatatatacctcttgtaagccgccgtgcggcgttgtaacctcaccccagatatagtgaagatattttgctggctggcgcccgtggatttttctctcatgttttgggagggtttttcacgttaaatctcgtgtcttctgtgattgatctattgttttttatcgtttgttcgcttatcgtttcctaacaacactgtggttaaaggatatatatatatagtaaaaatattgaattttctaccctaaataacttaattagggtagtaaaatagtttaccccaaactaccaagattcctcctcccatgtgatgtgccttgactagtacaaacatctgcatcctagaaataacacacaaggttagggaattaagtcaactggtattgatagttttggggttaaataagccaaaaaataacttaggatgtaaactggactaccaaaatagttcgggtagggaatggaacctttttcttctgtgggatatatcaacctttttgcattattcttttcttagctctttttccctttcagctaattactacatcatgtgcaaataaaagtcatatacaaagttatatttattctgcatttaattcagtagtgctttgctagctactccctccgtctcaaaatataagtatttttaaacttcaacacagtattcgagatattactttgaccaacaatatctataaaagtaaaatattttaaataaaaagagttgaatattatgatagtttgtttaatcataaatctagtaatatcaattttatataattgatctttttttaattaatagtcaaagttaaaaatgtttgactttacactatgctaaaatgcttatattttgggacagatggagtaataaattgcatatgacaggatatgcatataggagtatgtgaagtgatcatgcatccaagaggaaggaaaagggtttgtaacatttatggaaccgatatgatatgcatagcaccagtagagatttagaaatggaagtggaaggcatcgggaaaactaatgctcctaccaacatatgatggagatgggttgagatgattttccacagtttgagtttgccattgaggatcttacctaaaccagaaagccggccatgccttccatgcgtaacattagtggagaatgccccatctctcccggttcgcaacaccgggaggaggaatccgggactaaagatcgtcatttttactgccgtttaatacccaggagtagaga

SEQ ID NO: 66105 - DNA, 20812 bp, Oryza sativa
tccttagacattgtttctcactaggaaatcctctctaccctttgcccatatttatcttgtgtccttagatgaactggaggaagatataatcacacatgttcccttggattcgatgcccttggaatactccgtaggggaagtgctacatcggtatatccgtgcgcttgcgaattctatctgtgattgtaagaaataccaacattgttcctgttaaataaatcatgcttgtttatggtttacataatgcctgatatttaatttgctccttatatcctgataatactacaagattcatgcagttttttgagtacgcactcgattttatctactatatatcttgtcttctacaaaatatttttcaggaacaatcaagcactcgagtaggttgtggtcgagtacacccttttatcgagaacgttctcggtaaaggctgagttgtcgctctcaacctaccaacggagaccgacgacctatctcatgtatagcgcgcgtcggccatggctggactatttgaaaattggtggttaacggataattcctcgcgaacgttgtcggcttgatcacccggcatgattgtgaacagatatccgaatatgctataagttgggtatgtgagtcatgctggccacatgagatgcacatgtaataaccaactctagcgcccctataggtgattgagagatgcttgctcctggttaatgactagactgttgtagcgacgtctcgctgccgatcagtttaaattcacttgtggaccgttgaactccatccagcgttgtcgaggactctatgtctctacggtcttacaccgggatcgaccaagtgagtacgacaaatattgataaggggagtcgtggataacaagtgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcagatgacataacctgatcatcagatcaatacacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggttgcgtcgagtttcctatcaacgagtgcgatggaatcaacttcatgagtcgccgacttcgttttcgctttgggagttttcgcttcctcgtcgccgacaacttcaacaagttctctctgactcagattcaaatcagtcgggaaggctcaagacggctttgttctcatctggtcatcgccatgttcgtcgacaccatcctgtggtcagattaatcttaaaaaagaaatatcagtcgagatgttgcatgaacacgcccgaaggtttgcgtcgttgcatgccctgccatctgagatcaatctctgggagttcgacgatttagttttcgacatcaccggttcaagatcatccattaaatacatgccctgccatcggaggaacctgatcactatcaagccaagtcccacgcgaccgtcgcgacgattatttccaaaatcttctccgacttgggatctgatcaaccatgactaattaaagcaactcagccatcagcaccgactcgtgacaggatttgcatgtccgactgccactacacattgccattatattgatgcaagcagtcggcatctgttggatcttgcccagatggctggcggactcacgcacgcatagcacgcagcatgcaagcacaagccatactgcacatacagatggtttccaattcggtataatccagcatgttccacatacagtgcatgtctgtcacaagctgccgatatgatcccatgtccatccattaacacatatacggaggaggacactgagaacaaagctaagtgtctttattttcctttttatgtaatattttccattgagcaattttttatatctgctcatgctaactactcgtccagcgccggacgcctagttttatcattatttatcatattgatttttaatctcagattaatctcttgctattttttgttgttgttcgcatataattacgcggcactattgaggcgattaatgctggtcatggagtcgaggcgtctcagctttccggtcgatcggccgcgagtccactctgccggcttgtcttcgccaccgccattgctgataacaacaacgacttcaccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctaatatgccgccgctgttgggcgtctacgacttcaccgccggcctgcctccgtcgccgccgagtggtgcctccgcctacacggctggcctaatatgccgccgctgttgggcgtctacgacttcaccgccggcctgcctccgtcgccgccgagtggtgcctccgcctacacggctggcctaatatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgtcctcgcctatacggttggttggtcacaccaccgttcatgggcgtctacgacttcaccgccggcctgcctccgtcgccgccgagtggtgcctccgcctacacggctggcctattatgccaccgctgttgggcgtctacgacttcaccgccggcctgcctccgtcgccgccgactggtgtcctcgcctatacggttggttggtcacaccaccgttcatgggcgtctacgacttcaccgccggcctgcctccgtcgccgccgactggtgtcctcgcctatacggttggttggtcacaccaccgttcatgggcgtctacgacttcaccgccggcctgcctccgtcgccgccgactggtgtttctgcctacacggctggcctattatgccaccgctgttgggcgtctacgacttcaccgccggcctgcctccgtcgccgccgactggtgtcctcgcctatacggttggttggtcacaccaccgttcatgggcgtctacgacttcaccgccggcctgccttcgccgccgccgactggtgtttccgcctgcacggctggcctattatgccgtcgctgttgggcgtctacgacttcaccgccggcctgcctccgtcgccgccgagtggtgcctccgcctacacggctgacctattatgccgccgttgttggatgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatactttccgtttggtttgccaatgaatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccggctcgtccgccgccgactggtgttttcgcctgcacggttggcctattatgccggccgttgttgggcgtctacgtcttcaccgaccggcttgccttcgccgccgccgactggtgtttccgcctgcacggctggtcttttatgccgccgttgttgggcgtctacgtcgtcaccgaccggcttgccttcgccgccgccgactggtgtttccgcctgcacggctggcctattatgctgccgttgttgggcgtctacgtcttcaccggccggccgccgcatccgccactgactgatgtcaccgctagcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgccgctgttgttgggcatctacatcttcattgccggtcgtctcgtctgctgctgactagtgcccttacctctacgtctggtttatacagctaccactactgatggacatcatcatcttccgtcgccgactgattatgctgccgtcgattggtgcttttatcttcacaactacgcgtcttcactaccggtttgcttctgttgccgccgacttgtgttcacttcattatggcaatacaactttgtcatcatggtggagcgacttcatctttattatcttcggcaccggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttctcaactaaccaaagagtcgggggctacacaaatataaggctcaaaatttgacaaattttatgtcaagctgaagaaatcaattaatcagccaatgagtcaactccaggagtctttatcttcatctttgcttcggagcagatgttctacttcagcaacttggagattatggatatcccatatctactcagcgctgccataatctactccaaaattctcaagtatcaagttcaagatttaatctacatgttcgggagtttggagttatcaaccaatcagctcggtttagacgagttggacaacaacatctactttcctccaagtgaagcatctacaacagctgtaacactaagttctacagtcatcttcgtaaatcaagaagcattgcatcagttttctttatgcacacgctcacatcaaggaaacttctcaagcttcgatatcttctcaatggtttgatggattgttgtcactgacatcatcaccagcacgtttacttcatcggccctgacgtctccgccgttgctaaggggtgactacgtcctcgccgtcggttacttttgtcatcaccgactttcatcgccgacttgttatttcgtcttcacggttggcctactatgcaactgccgatagaggatctcatcgttatcatggactgctacattactattgactggatcaacgacatggttatcttcatcaacatcctgtcaagtctcttcaacatagcctactctgctgccgttgatgggcaacttcgtcatcatagccggctatctctgttgccgctaatcatcattaccgtcggatgcgtttgccatcgccgactattttcttcatcttcataattggtggatttcgccatcaccgttgatgcgcgtctacgtcttcatcgttggtttgcttttgtcaccaccgactgttctttcgttgttgttgggcgcctacatcttcactgctagctgacctgactgttgccgactggtttcttcacctccatagttatgcaacttcattacatttgattggcggcatctttactaccactgacatcttccgttacttctgatgagcaatttcgtcttcatgttggtcatttcatctccatgccgaatgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatttattttggagtatcccataagggataatcattcagatcagaagctattcatatgagctacacttggtctatattacccggaagatttattactcgggagcatgttacacgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtgaaaccatgtgtcttctagggacttaagtacatctgttaaagcagtgtgcgcatggcgtatgcccaatactttggaaatttctttattcacaatatgcaagcttctttatagctattttgctatatcactcatcatattttacaaagcggttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgtatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcagatgacataacctgatcatcagatcaatacacacccggcggattcaaatccccaaacaggagtagggtattacctctcattgagagggcctgaacctgtctaaatcctttgtctccgcatccatccacttttaggtctcgtgcgctacccccttttattattgccgaattcatgtttcgacaacaagagatgcctttgtggatacggtttgtttccatatgcttatcagttgccccaaggtgatcgagcgatgcctactccaggttttcaaccagatggtcgtagtgatcttttgacacctaacgcgacagtcaacatggtcatgataacaacaaccgagactgacaggattgccgtagtcacccggacgacaacgtctaggactaacaagattagggcgacaacggacaaggttaacgacatcatgacatcacatggcgacgacgaaactccagatcccaagacttccagagggcccgaggttgaggccgtaggtccgggagttgaacctctgactacgataatccctcatcgacttcgtcatcgtcaggaggcagttcttgcaggtcacgagaacgccgtccatctgtttgtcacgcccggaaattcactggtaatttctggacttatttgtgcataaaatcctcgtccaagaatcagccgaggtacacaaactgacaatttaatatacaaatccatcataataataacgttatatacttacaaaagaatagaaaacagcagcggaaaaacagtctagcgatggctccagctccactcccacaggcagctcaactggggtataagccaaacgtcttctccttctggatcctttttcttcaactgaggtttgattgattattgcaaggtgagtacatggaatactccgcaagccacatagcaaatatgcaagtgcacaaggataccaaaaggatggtatattatagggctcatttgcaaaagcagcatttagcaaacattcaggagtagtaaaacagtagagtaattaatcattaatattaatcaacactaaacaggcttgtacccactcaatttatgacaggataaagttgaattgttagttggcattctgggatgtaagattggttctctaccttctttgggattacttttgggcaccatatggcctagagtggtggactttgctctgttagtagacagcatagaaagaaggctgacagcatgctccatatttctgcctcatggaggaagattaacattgatcaatccagtcctttcattaatcccaacctactaatgtccttattgcagctaccagttctagtcatcaaggccattgacacagctcgaaagaactgtctgtggagggggaataacccttcttctacaaggaaatctctaacctcctgggacagggtgtgcacccctaaagagaaaggaggtttaggagtgatcaatctgagagttcaaaacacagcgctcctcctaaagcacatggtcaaattctataatggtgctgatttaccctgagtaaagctgatctcacaaacatattatgattctaaagttccacacttgatcgtgaataaggattcattttggtggagggatatcacatctcttgcagacatcttcaagggaatagccaaatgtgaaatcaggacaggaacaactgcccttttctggaatgatctatggaatgatgattttaaatgcactagctaccccaatctttttgctgtgaccatgtataaaactgattcagtgaaagccatgtgttcaagacctttagaagattcttttaccctacccctctcagatgtggcctattttgaatttttgcagctacatcaatctgaacatacagtcaggaatgggggatgcttggaattttatctggggttcagacaagtacacagctaagaaattttataagcttaacttttctgcgttacaaccctccagacccatgatttggttgtggaaaacaaaatgtgtcatgaagataaaagtttttgcttggctcctgttctgtgacagactcaacacaagagatatgctggatagaagacattgtgccaaagaaaatgatgacctcacatgtgttttgtgcaatgcggattgcagagaaacaaggttacatcttttcttctcctgtccgttcagtatcagttgttggcagcacctgggaattgagtggaatcataatttggagtttttccaaatgatcgccctagcaagaatcaagtttgctcagacgggcttcctggagattttctttttggtagcttggcacatatggaagcaaatgaatggtttaatctttcaaaacgttcaaccctccttccaagcctagagatcactttttgtcaaagaagttcttctgcatatatgcagaatgaaggatcccttaaagcaatttgtttttaattgggtacaaaccatatagtctttcttgcggtttcctcttgtaactctgtaaccttgtaaatatttttcaatctttataaaattacaatgttgggcaaagccttggcagtaattccggtaaaaaaaaacactgaacagcacacccatgctgcacaggcccaaccatcctgaataaccatacccggctgtacagatctaactccaaaccaggagctaagtaaattattattagttatagcatcaataattatcgtgagaggtcttagactaatcatgaaaaacattgctcaacccgtccatgaccgcgggtacggctattcgaatagttttactctggccagaggtttacaaatttacccacaagacacaactccacaatatgtcaccatatcatcatgtgcccatgctgaacatgtcaccatttgtatagttgtgacaagacccctcacatagctcaactcaaagcagtgcacctttcctggatcataatcaccccctcaaaaaaccagacgcatggactccacagcgacccccacggacttctcgccgcttcacagtctggcgcaccaaaatgagccttgctatacaaagtgtctagccgttgcccattctgacttgtcgttagtatggttaatgtctcacaacagtagctcgtgaactggtccttaattgttatgagcacgaccatcaaaaccatgtgctcacaacccaccattaatcaagttttagttcacaattagttaataaccaatcacgattgaccatcgtgagctaccattaaatatccataagtcatagtgaaacatgatttatctcattaatgagctattgtttctaagcatggctaagcatctattataagcatatagctgaaccaaaccaatatataaggtttaagctaatcaaattataacccatacgaaaataaagtcatcttcggccataattaattgggaaaggctcaccacccgatgacattcgaaaataatgtaggagttcaaataaaacaatagctttaaacgggttcaacatgatcaaagggttatttgggatctgtgtgacttgccttgcaataatcggtctccagttagtcttctggaacacttccgatgcactcacgaaccttcgacacaacggaaacgacaagctaacacacaaaatgaggaaaaagactaagaaactccaaataaacagtacataaaaagtaaaaaaacatgtagatcattattttagatgaattatgagacttgaacggcctcattccgactttatatgaattagttatgaattttacaaaattaattccaattaaagcctattaaagaaaaaactattccaaattgattaaacaatttacaaacgatttataactgagattaaagattaaaacaacctccagaaattattggaacgaatttagtaaacgacatatagtaaaaagaactaatatgccatcgaaaagggataacaggatttatattgatttttggatggctgagaataaacttgaccgagttgaccaagatcggatggctcggattgatctggcaagcgaacctcaacgagtcaattctacgtgacacgggatcacccaaatgatcaaccgaaaccagcgaacggaaccggcagctctgaacggctctaaactaaaggacgactcaacgtggatgaacgaacgaaacacgagaaacacctcgttcgaacgaacgagctaacggctcaactatggctgcggctaaaccggtgagctagacacgattcacgataaagccctggtactacaaacgataggtcggtaggaatttagggatgcacctacggctttgcaactcagctaccgggctacgggcaatgaacaaaccacaacatcgacgactcgggatagcggtggtgttgcatggtctggggcagcggctagggagcgacggtgacacggtttagcagcggcacgattgcggcaacgactcggcaaggcgcggcagcggcaatgacccaacaacgacttagcaagacggctaccgagcggtagcaatggctcggctgagccggcaatgcggcagcggctacggtgcattggcgaggcggctaagcggcaagcaacatcacgtggctagggttagggcgacggcacagccggtagcgacggtgcacgggctagggcagcaacgcgccgagcaacaacacgataggcatggctgtggcaaagcggtaaacagtggcagcggtagcgatgcacgacagcggtggctgctacaagcggctcggcaaagcgacggcaacgccgcacgacgtgcaggcgcagcagtggcgacatggcagcgatgacgcagcaaaggcgatgccgcagcagcggcaacagcaagcgacacggccgacgtggcaaggcggcagccggcacggactctggcagcggcgcagggcttggacagcagcggcgacactaggcggcggcgtgcagcagctgtggcacagcgagcagcgaggcggcggcatctagtggcacagcgacacgacaagagatgcgcatggcagcggcacaacagcgactacacgaagacatgaacgcagctacacaaagattaaacctagggaacggaaaggaggcctcaccggggaagatcgaagaggaagacggcgacgattcggtggcaacacacgatgatgatgacgacgctaggaccaaacaagattagattagaatagattttttttttgcggggaagattagaatagattaagtccctagggataaactacaccggtaaacgacatgggagagaggagagctcactggagaagatgacggcgatgaccaagacgacaacggcgaggggtgacgacaagcagcagcggcggctagggtgcaggaggcggctaaacaggaggaggaggaggctaggggcggctgcaacaaaaacaggaaacaggaggggagaggacggcttatataggggaggattgaataagattaggtggggctgagggaggcacggcagagggggagatggattcctacttggaacgcaaggaaccatgccgggaaaacctagggtttggcggagagataaactcgaaaatgaatccaaattcgcgccggattcaaagggataaagtcagattttgggggccataggtagaggaggataagaggaatatttcccctcaaccaattttcgaaatgagccacactatcggccggatttgatggaggaggcggcgatgcacaggctcgggacggctggctcaggctctgtctggcgctggaagatgaacagtagcgtgggcaggagaggtagactttttgctgggctgaaaagaaaagaaggaagtgataagaaatagacttccccgaagaagaaggagacctggctttgtctggagctggaagatgaacagtagagcggggacgaatagtagactttctgcttggccgaaaagaaaagaagaaagggaaaagaaatagacttccctgaagaagaaggagacaggaaggaagcagagataggcaaagaggaaggacgggctgaggacaacagatagacttttccagtttcagcacgaaaaggaaaagggaatttaatttacttttccaattaaattaatcactaaaataatgcttgaattgttaaaaatacttccaattctcgaataatttcaagaaaaattcagaaagtacttgaacactataagtatttaaaaaattatgaacagaccatttaatgattaatttaatatttaaataattgctgaattgctctttgtattattaaaattagtaattgagctctgaaaaatccgagaaaattccagagagtataattaaccacagagaatttaataaaaattaaattcagcaaagctttatatttaggaaattttatttcccaaatttaacttcacttgtaaattaatgaataattaatataaattctaataacaatttataaatcctaaaacgaaaatcaggatgtgacactgttactctggattctcttcaaatggccaagttatgactataactggacttcgactaacggtgtagcgattctcccactacttatgcaatttgttaagtacaaccatacacctggtcttcgcctagtgtgcttgttgtgtcatcatctacgtcaatttctgtaagtgtttatatgtacaatatttgtccgttgatcctcttttcttacatcgcctcgtcttgaagtcagtcctattgttcctttacgctgttctgacagagcctccgagaaacctaaggggatttcggctagggacgcccagagttgataaggctttgttagatgctgcagagccaaacgaccatgtcagagtgctcactggatgtgtattaactaagccgtgtaatcgagaattggttttcccaacttcacggctgggggctaggatttgccatcctcagcttggttcgttataagatttaagttgcctttgtggaaaatggtttttccaaaaaagcagctgggggctaggagtactgtcgcaccctgaagttcccctccttgctttaaaatccttaaaatgaatcctccgaagaaatgatttaatttaacctagagttgaatctttaattaataaatgcatttaataaacggaatcgacatgtggaatttttcttggattctacatgtcaaaatatgctaacaggatttttagtggaattttcagagccttggaaataattttaacccattagaataatcaaagtgcaatatttaatccctgggaattcctttttttttctttttctttttctctcttgttgggccgtcggcccatcacctcccgcgcccccttccttaccgggccggcccgttttccctcctcctcccgaaggccaggccgactccccctctctccctcgggcgctgacaggtggggccacctgtcagccccttccccaacctccagccgctccccaagccggcgaccgccgcgccgcccactttctccgccttccccgcgcccccactcccgcacaccccgcctttaccgcacccacgcccccactcccgctcgcgcccacgttgcaagatggccgggattcgaattcgaatcccgcctctctctctctctcccctcccccaacttcccccgcaaacttcggcgaaatcgagccactcccgaccgttcccgacctctccgcccctatataatccatctccacctcctcctcctcatttttccttttttcgccggcctctcccgagctctccaccgctctcgcaccgtgcaccaatccgccgctggctcttccattgctccggtcgcctctagccgccgctagggtcgccgccgcaccgcaccgtcgccgccgtcgggttcgcgtggccgaaccccacctagcccacacctcctccgtcgaattccgccatcggaggccgccgtccgccgtgcgccagtgagcctttccttagccgccgccgtcggccacggttcccgctcgccgtggactccctctccccctctaacccctctctttttctctcttagggagtctcggaacccgtcggccgctcgccgtcgttccccggccatcgccgtcgccgttcgccgtcatcttcctccacgccggccaactcatggtgaggcgcctctcctcctcttttcccctccctctccctcctagcgccgagccaggccgagccgccgcttcggccgtgcgccgccgccttcgcgtagccgccttcgcgccgccgcctcccgccgccggttgccgtcaccggcgacgcgtgcgccgccgcccttgccatggcgggccggccggcttgatgccgagcccggccgatgcctcgccactccccttgggccggtgccgagtggggcccgcctgtcagtgcccctcttttcccccttgtgtcaccgactaatggggcccgcatgtcggcgccgcccccctccttgatgacgtcagccctgggatatattgcgcaattaaggtttttctttttatagtaaaaacacagtgaatcttctaaaattcatagaaaattcatccgagctccgtttaagcccattcaagtctcagtaaatcaagaaaaatgtgtagaatccattaaaaatggttttgttctctatttcagtagtcttatagcatgtttgtattattttctttgtatgtcgcttagatttcggctctcccgacgctccggtgtaccttgaaatagtcgccgaggttcctccagcagcagtgtaaggcaagtcatgcttgtcacttgaacatgttgatcctatattgcaaatgctctaccattttcccttaaatactgcatcgttttaaaatgttactatgggatgtttacctactgttacaaccatgctcctttattatcttgggatataacatgactagagattggactagggattgcttagccttgcttagttcaactagcacacaatgggggactacattaatgcatagatattagattctagtaatgatgttggttaatgccaccgctccggtgtcggttaattaaaatatattaaatggtgggctgtgggtgcatggttttgatggtcatgcccatggcaattaaggactggttcgcgggatgccttggaagaacttattgtacttaccacaagcgagcgtgggcaacggcttggcccgtagtgtaactttcctctagctgacgcatccaggcaagggtgggcgtgatggagtttggatgggccctgcgacggcctatccggcttccggattcacctaggcacgagaggggactgcccgctaccttgcgaggagtgggggtgaaacctgaggtgtggtgtgcttggttagagggggttatgcgaaaggtcctgtcacggcctctttccggtatgtcgtggtgccatgtcgacgcacggaaacgtgtcgtggggctgtgtcttgtgggtacagttgtacacctctgatcagagtaaaactattcgaatagccgtgcccgcggttatgggcggtcaaccaaattcaccgtgattagctcaccttagtgtagtctgatggaactgattagttcaggtggttggttgggcctgttgcaacgtggtgtagcgttgaacggtggatggttaatattgattaattattacaactgttttactgctttcaactactgtttataaatgctcgctttatgccaaagaacctctctagctaccctttggtaatatcctgcatcatacctctgttctggtatgacttgctgagtacagtgggtagtactcagtcttgctctatttttccccaaccccagagtttgggtatgcgtcagatggcggtttctccgaggagtaggcttcgtccgtgccgtcgaggatgcctgtggagtgttgtttccgctgccgttcaagtcaaggcttagctccagctatcttttgtttttccgctgcatttatgtaagacttttataatgtttgtaagacgtggatctgcatgtcaactttgtcgtttgtgtaccccggccgatcctggacagggattttaatgcacattctgcttgggattctatttaggaattcctgggcgtgacaagtaccgaactccgtttgctgaggacaagtctggcgagaatactcttttattgccacacgcagattcaatttattctcaaattttccatacatattataccatgatacccttgatcgttcgctcgggggctatttctgtttaatattttgttctattgatttcaggaaaattccattcaacgttgtcgaggactctaggtctctatgatcttacatcaggatcgactaaagcgagttcagcaaatgttttgagtattgatttcaggaaagtcggacattagaacagtcaagtcaaatttcagggctttgtcgcacactttacgactactcgattactcaaggacggttgatggagctcgacaaggaatatggaaagaagcgatggtgtacccgctgagataaaatttcttgacttcaatccaaattctcgattacgataagacaggagacttagtcgcatgctccataccttttcagttgacatcgtgattaacctagacaaaaccagtatggcgctgttgatggctgttaagtaccaaattaacgccgtcaatacctgcataaaaccataaaagtaaaacattcaatgtagtggtagggtttatttctaaccatttccacgagtgttggtgtatatttggatgcaggtgacgaaccaccaaagttgagacaaaaaatacatagaggaggatgtgaattaaacatccatattccagcctatggagctttggacccaaaaacctaatgaaacacattcaaatgggccaattgcaagtacatttgggctaaggggttatccaccaaagcctatgagaaaattcggagcaaaatgggctagaaagggtttggccgaaccaagtggttcggccgaacccctagctgcgccgttcggccccaaacttcacaggccggcagttaccgacttgccacgacagtttctaccgactttacttgaataaccgtcatctgctggacacatggcactaggaggataaagatgctcattggatgcttggaggatctccactctctcaagtcacctccacactataaatacccttctcctctccctcattcacacacaccaaagcacgagctgaattacaagaggctctagtgtactttattgtatattagaatagggagagagaaaggtagaaggaatcggaggaatcccggagttgtctgttatctcctcttacttttgtatcttgttaattactctgctttaatagaaacattattctgagcaattaaggtttgcttagtgagaattacttcttggttagttaattgcgtagacgcggtgtctgggtaattaatctccagtggttgctgcatatcctacagtacgtttgaggtgggtatagaggtggtgacagccctcaagagcacttaagtcctccctgtccgggtacatagtagagcgacatctgggaacagcgggttgccagtgcctaaagtattgcgttaggattaatgttaagctttccctagacactgtttctcattaggaaatcctctctgccctctgcccacattagctttgtgtccttggatgaaccagaggaagagataatcacacacgttcccttggattcgatacccttggaatactccgtaggggaagtgctacatcggtatatccgtgcttgaggattttatctgtgacgttaagaaataccaacatgcgcctgcggaggccgataagagggatctagcgctatctctgatcacaccgagaatggtcaagagagcacgacaacagttgttccaaggttttcggtcgagaacatcaactcgctcatggttatggataccacatacctaatagtagttgactaaactcggcagagcccaccacatatcatgtcttatacaaaatcatacctcgtatatagaaggagtttcggataaggaagtacgaatagagttctacatagaaactataaggactactcggattgtagccatattggtctccctagtcctatatggacaaggggacatctatgggtttaaataaaccccctaggaggagggggagaggacaatcaatacacaagacatatacaagccaacacacgccaagacatgccgccggatatcgatatcagagatatgcctagacagactcaatctggtgcctgcagaggccaacgagagggatctagctctatctctgatcttgccgagtgcggattcgagtaggaaaactaccccgttgtcgactacgtgatggttttctaggccgccaagttgacaacggctagataggttatcctaaatattgcactagtgtgattatgatgaataagagcaacaccggcttcggccaacaggagtagggctattacctgacaaataaggggcccgaacctgtataaaaatccttgtctccatttcttttacttcaatctcgcatataacctggtaccaacgatccccatactatgcaaaataccgtagtcgtgataccaaacatcaacaataccgctatagcacttcacctttgggtgaccacaaaaggatagtgaactcagggaacgtatgtaatctacctaaggctaagactgttcaaggacaacaactatcggtaggatagctaggctagaaagg

SEQ ID NO: 66106 - DNA, 43146 bp, Oryza sativa
atgctattcgtggagcgcagcactttatttatattgagaaccagtatttcattggatcttcgtttaattgggattcaaacaaagatattggtaagcatatggtgtaaagttatttttttaattaatgtgcacccaccaataaaaaaaatccagaaacaaaatacagtgcacattacattttcttgatttgcaaaccatttcagcaattcagaacacagcaaatcccttatctgatcctaaattggtattcaaattgtgagttttcaggggctaataatttaataccaatcgaaattgctctcaaaattgcaaacaagataaaggcaaaagagagattctctgcatatatagtaattcccatgtggcctgagggtaatccaacaggtgctcctacacaaagaattctttactggcaggttagatcaacatgtctgctttgtgtcttgtttaatgtttatatagattatacccagttagttcatttgacatgatcgcatgttttttttgttgctcctgtagcacaagacaatgcaaatgatgtacgaaacaatatatagggccctgaaagaagagggtctagatgatctatatgagcctcaggattatctgaacttcttttgtcttggcaatcgtgaagttgctgacagtccaagcacttcaaactcaacaagcactcctcaggtaagacgtcttgttttttcctttgacaaactatgctgaggaccctccattggttttagttttccctgcaaggttaaatgcttttttttttcatttatagtattaaatacagtaattaatgtcacattgaatttcaacaaaagtcacaatatggtcccttaagcctgcgtcatacgagaatgtgaaagctgctgatcttgccgacctctgaagataaattttgctctgacttgccatattacactggttcttaaaggatattgatatcaagtcttgttctctgatcctacatggaggccaaatatccaatccactttagtttctttatcagatgatacatggaaattctggttttgtacacttgtgccttttatttagaagaaaacattcgatcggttagaatgatttggctcaattgtctagatgttctacaataatgtttcatcttgttggagcactgtgtatagtatttaacttttgatttatcaaaattacaggatatattaatatgtatgatatgcttgctagcaatctcgctgaactttgttatttttttaacatctgacttgcatgaaaactgcctgcatgcaacctcgttcatttattctacatttactacccaggaacaagctaggaaacatagaagattcatggtatatgtacattcaaaaggcatgattgtggatgatgaatatgtgataattggatcagctaatatcaatcagaggtccatggaaggtatcagagatactgagattgcgatgggtgcgtatcagccacagtatacatgggcaagtaaggtttctgcaccccgtggacaggtaacaacacttcatgcctgtatggctgtatcacatttctggagatctacagagaaccgagctggcatcatatgctcatatattaaacattgcgccttcagtgattgtacatttgcaactcgtttgctttacactgttattgtctgttgttcagcactactgcatcaatccagccatatatatttgttgcaattatcttttgttttggcagagtaacctaaagggaaattcgtaccctatcaatcatatttttttagataaggctaaaaaaagctaccactcactcttaagaatatgttaattggaagaaaaaaagagaagctaccattcattctcaagaatatgttaattgaagaaaaagagagctatctacaccatccatcatggtgggaccagattgtagctacaaatgtatggaaaatacaaatgtatttgtagaaatagagaaaaagttgcatatcaagtacagtcatatttcaaatagccctgtacaactgtgaaggaatctcgactagttgtctcttggtttgagggatatacctattttaggatgactgatatttctagaaccacactctaattcaaatctgctgatttcatgtgtagatttatgggtacagaatgtctctttgggcggagcatattggagtggttgaggaaggcttcaactatccagagaccatggaatgcatgagacgagttcgccaaatcggtgaacagaactgggaacgatttgttgataatgaggtgactgagatgagaggccacctaatgaagtaccctgtaagtgttgaccgtaagggcaaggtgaaacccttgccaggatgtacgtcattcccagacatgggtggtaacatctgtggatcattccgagccatccaagaaaacctcacaatatgaatttcgattatctgtaagtatacaattgctagtgattctgagctattctgcttcctgaggttatagatagcgtgaaaattttgctagcaatataggttgaaaccaagtaggacatgacaagaaaaggttattaccctgcattttttatgcctttcttaagagaattcaacatttccatcttaataggttttctttttatgtatactttttatcaatgtatagaagattaagaatgtttgaaagcccggaaccctctgtttagggaacatggctttggtagcaactttgattgatttaagtatgtagcgacatgtaaagccattaaaataagtttctagtgtaattattttcagccttgatttgctggttccattttctaagtgtcaatgaaatctaatccatttatttcttcgtcatgcccttggtaacataagtttccgctttgtttttgcaatgcttcttcaaggttacataatcaacaagcagatactgaacctatgtctagagaagagtaaaaattaagtgggtgcaaataaaatctactctaaactctaaagacagttgaacattttcttttccttgaattacatgcatttttttgctcctgaaacgaaattatcttttgttcatcatttcttccatctctcggactgaatcttcacacccatatacctgcccagtgtccatattgaaaactatactgttagtgtgttgttactcatggcaatgcactttcatgagctaaaatgatgccagttacctgccgagcatcatgacggtggcctgagggttggtgccgggggagtacttgaaggtggagctgtcgatcaccctgagcccctgcaccccgaacacccggtaatcgtcgtcgacgacggcgccgacatggcagccgccgtggtagtgccagatggtcatgacggtgtccatgcagtactgctccggcgagcgcgagtcgttgacatggcgcggcagcaggttgacggggaagttggcggaatcggtgaagatggactcgacggaggcgttggcgtaggtgaagttggagaaggcccgcgactggatcacccgctcgatcgtctcgatgccatggacgcaccgctccagatcctctgcctcgcggaagtagttgaacgtcaccgacgggttcgccctcgggtcggtggttcgcagctcgacgtggccggaggacaccggcccgaggatcttctccaggatgaagcctccccggaacgccctcctgtccagccgcatcatcgcctccgccgcccgctgcagcgcctccggcgtcctctgcttcggcggcagcgtgccgagctgccccgtctgcggcgacagcatcccgaagctgcgcgcccaccggagcgcgccgtccgacaccggcatgccgaactccgacccgctcaccccctcgatgaagctgccggagcgggtgatgccgacgacctgcaccagggagagctccaccggcaccggcgacgggatgaacaccgagttcatcgggttgtcggcgacgccctgcccgaccatgggttggtccacgatcacctcgatgccgtgcgcctccaggtgcgcctgcggcccgacgccgctcagcatcagcagctgcgggctccccagcgtccccgccgacacgatcacctcgttcttgtcgccgtcgcggaggtacacccggtgctgcacccccagcgggtccgagaacaccaccccgtacgccaccgggtacggcaccccgtctgcacgccatggcaaaagctcgccgtcgtgaggtcaagcttcttcggcgcacagcacattttccattttcatcgtagctgtgtaccttggcttttgaagaggatacgggagacggtggcgtagaggaggacggtgaggccgcgggggcgggcgtggcggaggaagtcggcggcggtgtggcgctggccggagttgtcgaagatggtgccgccgatcttggtgccggtgacgtggtcgaaggtgaagccgttgtcgggcgtgacgccgacctcgagcagcgcgtcgcggagcgccgcctgccacggcggcacgtcggggcggaacaccagcgagcgctccacccaccggtacgacgagttcaccagccgcgcgtcccacccggaggcgcgcacgtactcgttgctcgcccgcgtgtagaacccggcgttgaggcagctcccgccgccgagcacccgcgcccgggcgttcaccacgccgtcctccgagatgaaccgctgcgccggcgacgccggcgacgtgtcggccagcgcgtccgtgaagtgctgctcgctcgacatgttggcgtacggcaggccgccgcgctccagcagcagcacgcgcgagtgctccgacagcgtcgccgccagcgggcaccccgccgtgccgccgccgatgacgatgtagttgtagctcgacaccagcggcgcgtcctgcgcgtgccgcacgaaccgcaggttctccagttgctctgcacaacgccatcgcacgccatgaacacgacgacgacgcaacacgcatcaacgcaaagatacaacgcaacgtttacgcaccttgctcttccgagagcgcggcgaggcagagcgagaggagcacggcggcggcggcggcaagcaccggcgccgacgagctcgcgcggccaagtgctgccattttcgccgggcaaattcgctaactttcacattcccctgggacgaaacgttcggtctgtttatatatccggagttagctcaatggtagatcaagagtagatgtcttgaataatcttgcagattgctttgcactgcaaagaagatcttcgagcagctttgtaaattgtggagccctgagaagaatataacatgcatgcagaagtgatgagctgatgaaacattgatcaatgatctgatgtggttgtgagcaagcaagcaggagagtttacttgccaatcttgcgattgtttcgaacgtgctttgatatttttgccattttaaaatcataatttagtcgttgctgagttatttttctgttacgagacagtcggggcaggctggatttcaatggtttcttcttgatttattaagtcgtaaaagaagcgtaattttaatgagttgggtcagctcttgggcaagattatgacggtgcttaccatgtatgcatctcaactaaatctgataaagccccattgaaacggtccatttgtacaaaaaaatattaaaatattaggtgatttaattttagagtaaattttactatagacgaacttttattagcgatgtttatcaatgttctcactttataccggttattattcttacccatcctcaactcttttatccatatataacttgtcatataccgatgaatggttttacatatatatgtgagagtttattgatgagtaggagccaatgtaatcgagattgttcatgctcgagaagagagatgggtggtatgtggtccaaagtgaagcatctgtaacaaaaggtggtccaaatgaatttgctcttaactttaaattaacttcttggcccattgcagttgtattgcccaatggtaaagttgtaagttttaagacggttggtttctttttttgtgttttactcctcctccttctttcttcgtcttcggattgctatacgccagtctagtaaaaaaaatatccatttccctaaaccacattcgattgaaaattaagaggaaaatcttacaaatatctaacctttatatctacctcacaatttctgctctctgcctctccaacaatgttgattatgtccagagacattgacagtggtctgaccagttagagagagcataggttcctccgcttagagtgaggctaaggagatagcggcctgatggtggacggtggcattgggaaggcaacgagatgacagtgacgccgtcgtagctacgaggacaatggatagtggttatggcgagagaatcccgatcatgtaattaggtgatggtgagttgctcgagacggaagatgagaatagggtcaggcacctcgctagattggttaggtggtggtggtcatgaattcagcgacaagaccattagagacgaggaagacaacagcgtaaggacataagaaatggtgatggcacatgagaagccatctcaaggaggatgatggcaatagggatggcgatggaggtgcttgtcggcgagcatcaccagcgttgagggagatgccattgaggctaaatggtggtggtgcagagggcatgattggttcagcgtagcacagggtgaggttaggaggagcgatgtggaagtggtggctagggcttgactatttgtttgtattggagggtggagataaaatgtagattttagatgacagatcttgcgattgagaatttgaaaaatctggtgggggattttcttactaatattacttggggttatttggttagttgcttcactttgtaatgccacattttgattatggcgtagttttctaggtaaatgtttgcttcgcccccacacctttttagccttaggacatagtatatgttatactactacctccgtttcaaaatatattttagtccaatttatagtattgggctgagtttagtgtcatagaaaatagggggagaatttactatttgcaactaccaaaatgatagcactcaaataccactctcctaaattttcattcccaaatgccatccgaacgcacatgtcagcctcacttttcattcaaacataagtggtgaggtccgggtgacatttaggaatgaatatttgggagagtggcatttgagcactagtattttggtagagtgacaaatggtaaattcttcaattgaaagcttaactatattacacttaactatttcttagccgcacttttatcaacacgccacaattacggcaagcttgcttacgcatctaacaaacatcagtctcagttttttcttttaccaaccactgcatcagttcacttcaggtaaccaactgacaactagcctctagtataacggaatgaacaaagcacacacacaccaggcaaggttgcctgcctaactactaccactacactactagccacttactagccagtagccactcgcagcgtcctctgttccagtacgtgtggttctggttcatcatcgtcaaacgaagcaaacgacgacgaaacaaactcccggatacggcgcccttctttggtcagaatctttcaaacttcaaagcaagaaaaaacacaaacaaacaagaaccatctctgcattccgccatacattcgcgtcgatcggtgtccactgtacaggttgatcgatctctcgatcgatcagagatagatcaacgcgttgatcgatcagcaagttcagttcagttgcggcggccggggcgcggcgtgatcttgatgacgaggccggggaagacgtcgtcggggtcgtggacgtgcgggttctgctccaggatgtacgggtcgccgcacctgtcgctgatgctgtgcagcgtctccccttcctccaccacgtatatctcctcgcacggccgcgccgccgccagccgcgccccgcgcaccaccaccacctcctcctccttctccaccgaccccaccagcagcagcgccaccacgcccagcgccaagcaccacgccaccgcctccgccgccgccctcctcctcctcctactctctcccgccattgccatgcagctagttgttcttgcctcttctctgctttggttttggttggtgcttgagtagccgggtagagagtaggggtggtttatatagggtgagacatggaagcaggtgagattcagagagatggctccggtgttagcacttggcatgggggagaggatcaactggagaaatggatgctgatgtgttgctgtgtgctataagtgctcactgatgagtgctgaggcctgacagaaattgtattttttttcttctttgacatttttaaaacctgatgaatagttgatgatttctggtgcagagaattgattggtgagttatgggttcagcgtatctgttgctgccatcttgttatatactactagaagtatcttaatttttatacgtacaggtgtattcaggaatcaggatagtatctttcatcggttcaaattatccagaaaaagtatctatcatggtccacaagtaaacatatgcatcatttgacatacacaggacaagggcataaaaacatggcattaggtaattgaattacctggctcacgtgcaataatccgcatttgtgatctggtgattacctttacctttggaaagatctttaaacgtgtaacagcggaagacagagcagcagcagtacactgcaccagtacagacacctcacaacgacaaccgattcaacgaagcgcacacatgctcccgattggttgcgagtgcgtcgacggaaagcgccgcaacgcgcacacacacagacgcaacagcaacgcaatcacgcaacgtgattccatgtcatccaaacattcgtgaacctaaactcgttgtcgtcgaggagaaaaagcccttgaagatggtagtttatctcaacaggcaggagcagaattggcacgatcgatgcccaaaaagtcctacaaagcagcttcttttttgtgagctggtgctgtcctttgtggccatggaaacaagggcgacgtagtggtgtgattttgttattgctcacggtcactagcccgccttctaaatcttcgcgtttgggatcatgtgaacatccgtgagctggacgacgaactagtttactgccacttttgtacccatcggacgaaaaaattactacaattggcagtaagttgttgcctccgtctcagctccaaacccagataattctgaaaaacacctaattagcaattttctctgaaaagcttgctttttgattcattttatagatttcataactataattttctatatttaaaatgaaaaactaaatcattgaaagagtttctgattctgaaaaaaaaattacagctgcctgaagctcccaggcctaaactccaagcagcacggtgcgcccgtcagatcgccagtaaaatcctgtgacgccgtgcagcgcacatgtactacacgagttgtactgtactgtaccgacatgcgcgcggccgcgccacgtaccgagttcccggctcgattcgcacatccgcccgcctgccacctgcgtcaacgacacggccacccgcccacctgcagtcgggcaggtgtcgcgcgcccgcccgcgcgcgcccttccacgtacgtacgcgtggcagtgcaacgatcacgtctcgtctttccgcttgatttggaccgaggcaccgaggcccccctcgcgcatgccatatctcgtctcgcgtcggcgacctccgatccaccgagcgcgcgcgcgcgcatgcgcccgcatgggcggggagtggcacgccatggcacgggtgcgcgacaacgacgacgacgaccccggggcggcggccggcaaagtcgtttcatccatgcatgcggatgatggaatgtatcgatcgatatttgcgcttttgatctgcacgatcgatggaggagtacgtgcgtgcgtagagcagataaataacagactataaaccaactataaacacattttgatttcgagtaaataaaaaaaaaaagaagagcagcgggctatatatttatagtcagctgtagcacgaattctaagatacaagtgcgtataacatgtgagattagatattaattgtgtagaatatgtttataggtaaatattatataaattgactattaagttaattataaatgatttaaagtcagcagttggctatactattaaactcgtacgcacgcaacgcatatgcttgggcggctttcggaattcggaaatcggaatcgcttttgcacttttttgccagtgtatgaacgttccgcgcgcgggtgatcgatagatgttgctgtcgtgcaccatttgctctccatgcagcgtgaaaatggaaaggaaaggatgggggagggtgatgactgatgagaggggggagatagtgggttaggccggaggcacgtacaacgcctatgtatgattcttttaattatgtcatatatgatatcttttgtcatttgtcaccttttgtatcatatcatacaacgcatggtcgattgttagtcagggtgtatgtatccctctctgtcttcctatatcttccttttcgcgaatgggaaatttctgatgagaaaagggaagaggtatggtttggtgtgtaatgtttgctgacaccgttgacatagtgacggtatggtacagcacggagcttaaaacgcaatttattcaccatagtacatggcctacaataatttcgacttatataaaaatgtcattatatatctaaatatcattcaacgaaaggtcattatctaaaaaagatctttcaacgaaaaatggagtaaaaaaatttagacggaatatggagtaaaaaaagtacactaggaaagttaattacaaaaccatattggtgttaattagaatataatctctctctgtcccaaaataagtgtagttttacattattcatgtgtaatatttgaccattaatcttatttaaaattttttattagtattatttttgttgttgttagatgataaaacatgaatggtactttatgtgattaattttttttatttttttaataagacggacgatcaaatgttggacatggatacccacgcctacatttttttaaggatgaatgtagtaactataatataattacaatataggtacattgtacctttaatataagtcaagataaacaatcaacacgtctggttgctcagttggtaagccttctctttgaaacacactttactctttttcttcttagaggcagtagcatatggatctcaaacacattgtgacatttttttaataaaaaaacagtaaactgcacgaccaagccctagacttgctcactcgtattatataggtcctaaactcttcaaatacatttctacatcatgaacttggtaattaaaatgtgacattagatcctaagttgccacggcacctgcgggatcttatgtggtgacatgatcatgacatgccacatggccattgcctctttctcctttttttcctttttcttcctctttcttccgttctttcattcatgtttcatatatggtggaaaagaaaaagatgaaaaaaaggaaaaggtagagaagaaaaaaaataaaaaggaaaatttgttattgtaatgttcatgtggcatgtcacgtaggatccctgagatattgttgtaattatagattagaatgacacactttaatattttcgaatattaaaaaaaatactttaagagttaaggatctgagtaacatggatgaatagatttatggatcaaccatgtaatttactcgtaaaataatataggggtagaattatagcgaatccgtttgactttatagatagcaacatactccatcagtctcgtaaaaatcaatttaggattaaacaagatatatctttttactttttatactaggatatgccctatgttggtttctatgaggcggagtacgtacaccgttccgctggccggtaggcaaaacgcgcgtgacacaagcaagtggtactctaactttctgtactggcaacgggtatggtttgggccagcggtcagcctagtgtgtgatcgtgctgggcttgtagcgtttaacatttcattcagggccaggttggcaaactacaatgacccggaggcccacatgaacacaacggagggggcgtatcagagaagaaggcccgagacacaccatttattttgggtgggctgcatcaggcattcatcagaattgcagcctctaaaaacaagaattccaagtgaatagcacaatatcttcttctcgaacagaaaagtgaattatatattgtgccttctcaaccgtttccctgtgacgacgtactaaaaccaaatggaaatgtcaagtgcaataattagggactatacagtacggagacacgcatacggcttccaaaaaacttccaaactcttaagtcagagagctgacaaatttgccttcgggacccattgatcactagtgagcattaaatttcatttctataacaatagtatcttgtaattttttcaattgatccctcaagtactcctccactactaactacttactaaggtgcattagacaatcgcgacaaaacattcctttaatcaactttccctttctttctcaacatagttaatgttatcaagttcgaatgctaaaactaccaatgatgcatctttactggaaaaatttagataaaactctagaataaaaggtgacctgatgggtctgctgacgttgatctgttacatgaacataaacttatccaattatctcagttcaatgtcagcaattaagtgacacatgacccaatcattttcatcaaccgatctaccaccactactactaccaccttcgcaataacggcaatgacaccccggctagatcgatcggacggcgggcgacaacttggtggtgcacatagggcgcaacagtcgccgtccgatctgatatataggtaaccagtgtcaaaacttttggctaaagtagcagtagtagtagatcatggccaatggggccaattgccaaccaatctgatgattctgtactttggtagtcttggctccttctatatttttaagagagagatgaaatggatgtttcgcggctattctgtgagttctaaaattcaatgagggggaggggggattctacacgattgagatagagatgggaaatggatgtttagcatctattcctttgagttctagaagcatgtatttttgaactgatgtttaggattaacttttctttatcttacaaatgtactatgagccttcattggcttgaatgttgtatcataaagtacaaaccatgaactcagcgtactatcatcaatcaataatgaacctggctgatttctcagcttgccaataacccattgaattattgagaatggttgaatatagtgtttcgtcaacaaatacgctgtcctagttaggcttgcctaaattctctacattttctagccatcctatcctggttgtctgccctatgaaaccactctctacagtattggattcttcacaagaacaggcttgggtcaagaacagactcgatagaaatcataattttcaagtcaaaaaagaatagtaaaattcataaaaccacatattctctagcagaactactacgcaactacagatttaacataaatttatcatgcaattacatatttttatagaggaatatgacaaatttgccaattatgacaaaacaacataagttagagtttagattctttaacactatggttttgctgaacctaataaacaatataggtttgtgataaatttttttattaaatatgtagttttacagtactatgtagttctataaaaaaagttgaaaactaaacatatagttctgcgatacaccacttaagatgtagttttgcctgtcgcaatagtttggctaaaatacatgtacttttacataatttacccaaaacaaaaaattaagtgtagtactacaaccgtacaagcgaatgatccaattcaagcaaatttggggtgcttttctgcttgtttccccccaactctccagtctccacacaaaataatgcccctgatcgttttgtttatctttaggccttttagcagctcaccctcctcacctcccacgagcctcctcgcggcgcacaaaaacaaacccagacacacaaacaggcgcacacatccccatagcccccaaaaaccaaaaaaaagaggagcaaaaaaagaagagaagaagagaaaaaaaaaatcccacgccgcgttggctcgcgatcccctcctcccccctcccctgtcgatttgctccccggtggtggccgcccacgacgaacccccgcgccgcgcgcgattcgatcgctccttccggattctgctcccggactcggatctcctcctcctcgtcgagctcctcccgccactgcccgtgtaggtctacctgagtttggggggcggagggggggaggggagggggaggtgatggggattggccgggcgcgctgggtggcgctgcttgtcggcctcgcggcagcggccgtggtggcgacgttgggtgcgtccgagggcgacgccgatccgctctacaggtatgtagggctcgtgactccgtggattctttgtccagtgttgcgacatctcttcaaagatttggtgatttggcgaggcttgtgggggtgtgtgtgtgttttacgtttggttcgaggagctgattgcgtgtgcaatggaatcagcgagggtgtgtggcggtagtcgttcttaggcatttgctcgaacacctggtgctcgttggctgtagagcgcaagatttggtttggcctcaaagcatgattcgcccccctgaatactggtattttggtcattgatttcttatgaagagattgcaccaaggaagctaaactttttagaagtaactcccaatgtgtgtgtgctcttttgattatctaacctatatccatgatcatgcgtgagaaacaaagctttgtagggtatttcatgaccaaagctgggagatgtgacctcctgatgaagtcctgtgatttatacatacaaccttagtatttgaatccgtacataaaaaaactgtttagttctctgttctataaacatgttgggatgttgaaggttgaactgatgagcaatgacaagctaactgcctgatttgtccccaacttgtacagagcctgtgttgacgaatgcgaaaagacgggttccctccgagagacctccgtgaggcactgccaagttccaactgatgaccatcctgctgataaatcatggtacgcacatgaaccattgtacttgcagtggaaagaatggaactgcaagagtgaatgcagataccactgtatgatggagagggaaagtgaaagggagcaacttggattagggtcagttaagtatcatggcaaatggcctatgaagcgtgcatctgtgtttcaggtaatcaatcaatcatgtactaattaattgcttagcttttttataaacttgatctgtctaggcattcctttttcagttctaccttgtgtccttcacctatcactaattgcttttttttttcccttcttgcaggagcctatttctgctgctctttccgcgctctctctccttgtacaatttaatgggtggctatcttttttcctcctgctttcttacaagctgcctcttaggcctgaaactcaaatgacatactatgaatacactggcctatggcacatttatggtcttctggccatgaatgcatggttttggcgtgccatctatcacagttggtaagcccaatacattgatgaaaagtatgattccagtatatgtgtttgatcataattagttgaacttgattcttccattgcttgcagtgatacagtttggacagaaaagttgtattattcatcatttgctgcttttattgggtactcccttatcttggcaatattgcgaactctaaatctgaaggatgaagcttccagagtgatggtggcagctccaattctggcattcacaacaactcatattttgtatctcaatttctatgaacttgataaaggtaaattttagctggacatgatattgaacttttgaaaccattttacttattataggtttttcatgatgaatgcatcattcctgagtcatgacttcctgcagataattgaaatactgtcttgccaatcgatctgtatattttgtagtagtgactagtattgcttgtaaaacttaagcagtagtgaagttctgagtaggtatcatgttgctctatttaaacctgttactgtactaatgtcgaacctgcactctacatttctacactcagattatgtaataaactattgaggatctacctaactgttagaaaatatttgtgtgtcaatatttcagtaggtatgtgttaaaatgatattgcgtaaccttttagaaagtttacatctatgtatgctgatggttccttttttttttcttttcttttgcaggcctaaacacaaaggtttgcactgctgctagccttgctcagttcctcctatgggcagtatgggctgtcatgacaaaacatccttcatgttttaagatcttgtttgtcattattggaaacgtattctcaatagtcttggaaacctatgacataccaccacgttggggatatgttgatggccgtgtattttgtgttgctatttctattcccctcacatatctctggtggaaatttgccaaggaagacgctgagatgcgcacttcaacaatcatcaagaaaacaaggtagtgttcagcacaagtgaatagcacaaggatttgagcctatgtgaaatcttatgctcgagattcagtcttaccttgtaaaaatttgatcgttcatgttctttctaggcagcttgtgaattatgtttttttccatccctttttgcctcagctcagaggtttagggttaatgcttagggtgtgactagtcactttatattcattttcttgtaatcccgacagtgtaacacggtatgcttgtagctgtggtaatgtaacagaggaacgtagattcgaagctttctgaatgtatcattgtgatctgtggcataataataattctggttcatgaaagcatgtgatgcttgtgctttgttggtccctactttgcttttttctctttttccttggggatgttgttcatatctctgtcacccaagagaacatttcatgaatgccttttcccctttacacccgacacgatgaagactgctgaaaagagaatttcgttacccgggttaagtgcagtctaattggccttaggttgatgacctgtagagtgtacatttacatccaaacagaacagtaatcttcttgtttccattgccactctgacaaaactatatacagatgcatctgctttattccactgcccctaactcactacccccctatatcaaccttcactgaatctgttctatctcacgtttacattacactcgatttgacaactttgacatccaaacaaagaactacttcggcaacgcaatcaggtcactcaccagctcgtgcaacagctcgtccatcgccatggccgccaccaccacgccggcctcgcgctcctcctcgccggcgtgcatccaccgccggctccgctccatctccgccatgacatcctcgccgtggtacagcacgtcgttcaacgtccacggtgttcccgtgccctcaagccaggccttggcaagtctcatcgtttcgccgttctctcgccgtctcctctctcgtaacagactggtcggtgcatgcaactcaatatttctggagctgcacttcgcctcgacgaagaagtcgaggaggagcctctcggtgacgtcatccaccacgccgaccgacacggtgtccgccagtaggtctaggaggctgtcctcgtcgtcgtcgggatctttttgggagacgccgtcgttccgatgatcgtcgtgtcgtggcggcgccgccgctacgtcgtcggtaatgcactggtgctgtactgggacgatgccggcaaggcggtcggactccgaggcggcgaagcgtgcctcgagatccacgccgctgagctccgccatgctcccgagccgtcggatcttgggctgcagttgcatctttctccctgatccacggtaaacggtaaaaatatactaatgagttatacttcaagtaagtcgtaggaggctagaagcagcaagtacttgttgaccccatacaatttttaatatagagtttgtatatacaaatataaaaaggtaaaagggatagagttactagtagctagtaactttacttaagcatagagttcttttacatggcttagggatagagtttagtagcagaaattatttattttgagaactattagaaagtatttaaaacctcatttcaaaaagaaagaaagtgtttaaaacatttagggcttgttcggatcgtaggataggaattcagctcacatggaaaatagatgatcgaaaacatagaaatacaggagatagaatcgttcggagtaaaagattatgatgtgacatgcactctatttattaggaattttttcaagaaatctcacctcacctcatactaagaatcttatgaaattagcttgtaagattacaatccttaggaattttgtgggatccattcttatgaaatgaatgatgcatatagaaaaaaaatccaaggaatttaattcctacaatcatcttatgaaaaacctctaaatcgaatgagcccttagtgaatagtatttcccaaaaataatgtggaaaccctataatcctaacaagcccttaattaaccaatcccaaatccagtaaatttcgagagtcaaatatgctcaatcaaccaagataaaaaaaaaagctgagaaaaccactggcctagtatgtgccttttgtggccatctccgacagtcactggtcgggtgggcccagtaggatctttacacgatccgggatttccgcctttcccgggggcccgtatgaacagtacaaaaatcggaacatcttcttttgtccatgccccgtttcgtgtccgagcaagagacagaaacagagcagattccggttcggcactagcactaggcgacgaacacctcggacccgtcccgacccatctcatctgaagatttgacaccattgtgtagactacacaacactactatcacacagttaactcgacacgttatgcattttatagtacgtaattgtcctttggttttaggataaactttggtttgtgacagattcttcagaaaaaggatgagtgtacgtgttcagttcaatcagtttgcttactctggagctgggcgaggctgtcgctgaaagagaacgagcacgcgccggcggcgaccctctcgtcctcgtcgacggcggcggcgtcgtcgtcgtcttcgtcgaaggggaagtccatgacgcccaccggactgagctgctccttgtcgtcagcctcctcctcctcatcctcctccttggatcccctcttcatcacctgcatcacaccgtacaccagcaatcatccaccaattttgtctcaaccacacaaccccattttgtcatctcgtccatttctaatccacgacctttcgccacggcagcgtcagtccaagcgacgcgtctgtagcggcgtacggcacgacacatcgtccggctttcccggacgtcggctatagtgctaagctaacttgtcgtttcagcgataacgatgctactatcagcatcaccgctgaaacgacgagttggtttaattttagttggggcattaaaccatgtggccgtcgtgtgcacatgcagagagcggaagctacgcgaggtgagggtagagcgtgccatgcacaggacactggccccgctgcatcatgcttccggacaagcccgcactaactgtgcaacggcccgctttgcatttacgctttgcaaccactgccccttctggtccactgagccacagagctactgctcatgcatgcacagcaccagcgagccaaccacaccacagaggcctctaatctctacgaataattaattagtggtatcatctgcaatgctacttctatccttgctgatcaatggccgtaaaatcagtagccaggtacaaccctactgattgatcgatcaatgcatggatggacaggtcatttcgaccgatctcgatcgatcaatcaccacaattggagcagcagctagcacagggcagtagtagtactacgtattatcgcacatggtacacgaattactactgtactactctacaccctgtgtacataggtccatgtttggctgtatacgctcatcaatgcaggagtcagtagctagggctcccctttggatactcgtaacatgaacaagtcaggagattatccgaacaatcgagcaatccatgtgttggtgaataatggatcgctgctaccgaatgaatgtgcttcggttgtggcatttaatcgccgtgggtggggtctccgcttcgatcgttaattggtggctaatcccacttcgccctggagtttacgcaaattttggggcactaatgcaactaaacccaagctaccagcagctgaattaacgcccaattattgattcctcatcaaggttagtgagtgagtgagtgagtgattgagtaggagagaagtgaggttgatggaatggttgattacctcgtggtcggctccggtggtggagggctcgccggcggcgtggaggctgtcgtcggagctggctgacgagatttctgagtagtcggagtgggagcgcgacttcctcccgcctgtggaattgctggactcggacgtctcggagtcggagctggagctgcagcagctggccacggcgggggcggtggagctcgccgtcgccggcggcgccgcggcggcggcggcggcttcctcgtcttcttcctcgcgccgcctccagaagcctcccctgagccgccgggacaggctcttcgagaggctggacagcttgggccgccgcattgcggacgacgaccggtcggcgacgaggcggtgccgcattggcggcgccgccgcctcagccgcgccgccggcgacgcagaggcggcgagggtagcagcggaagccagcggcgctgcaggactcgcagtccagctccaggaggtccttgagcctcagcggcttactccctcccgccattgccgccatcccagactcggatccgatgacagaacgagcaatgcaatgcaatgcaacgcagagacggagacgcgagaggtagcaagcgcgcggtagcttctccgggcgagtaaagaaatgtgcgtggggtttttgatgtttttggagcttgtttggatcgacgcgagagcacgtacaggtgagctgcgggttgtcggttgggagatgcagcgagcagcgggcagcgacggtggtggcggtgggcggagcggctgagctggggagagtgggagaaggaggaggagagagatcgcctgctaaatacacgctcggctcagcgcggcggatttggtttgccccgaggccgaggttatcgtggcgtttctacctgctactagtactcactccatgggaggcgcggtggctacgatgtaggagtacgagctataggagtttttatggtttggtcgctgcctagctttgtgaccaaacgggagtaggagtagcttggaatgacgaaaccggagtgagctttgtgaccaaattaaagcagtaatccctcagtttcatattataataagagcccctttgattcgaggataggaaaaatacaagacgtgaaatagtatgtttctcaaatcctacaggaatcaacaggaaagataataggagctatttgatcgtgctatgagaaaaacaaaggaaagttcacgctattttttctatgaaatgtgaagcatatgaatacaatcctatagaacttttgtttcttttctatgaatcaaagcaacatgtaggaaacaaatctataggaatttgaatcctataaaaatcgtttgccaattatatgaatcaaaggttcctaaatcgttttgattttttgttaaacttttttggtttgatcaagtttattgaaatatataataacatttttacacaaaataaatatattatcaaaatatacttagtgttatattaactaattcaatattatatatgttgctaatttttttataaatttagttaaacataaacaatattttttttaaaaaataaaacaacttgtaatacgaaatgacaggggcagtagcttggaattactaatccaatagagtaggttggcactgtctgtagtactagtactcgagggaactggataggcggtcaatgcgtgtaataataaggaccgttccgtgtctctactcgtacacgagtgtttgctgggtgaaaactgatgtgcacgaacacatgctggtaagaagttaataagatcgatccgacgaccgaacaaggttgaattccgtaagaaaaacagagagatcgaaagcgatcacttggtgatgcgtactagtagtagtagtaacgtaaatactcgatcggtacaatttctcagtcaaaagaatacttcctctatctcttaatataagagatttttaacattttacttgtttgaccactcatcttattaaaattttttttataaatataaaaaacaaaaagttatgtataaagtattttgaataataaaggaagttacaaataaaatagataataattttattttttttaaaataaaacgaatagtcaaacagtacaacaaaataaaaaaaatctctagagggcggatacagtataaaagaagtagtcggtacaatgcagtggttgtactgtacgctactctgtttctctaggactgaccacgtaagatgtgaaaggctcccctgtttctgtcgcaaccagggtggtgtcccgtgtctgggtgatcgcggcgtgaactcgtgtggccttcgccaaattacagcagcagcggcggcggtaaaactcggcagaaacgacgacggatcggatcggtgaatttgtttgggggccttggaccggtgacccggtcccgactcgtaccacgcagtaccggattcgcggcgaggcgagcctcggagcaggggccagtaggggcgcgtgcagccagcgtccgcggcgccattacgccggcgacgtggcgcgcgtcccatcgcgtgaaacgcggccgcgcctgccggcaaaactaggttctattcttctctacctacgcgcagatcgaacgccaatctcaacgccacgttccaaaataaaccaatcccatatgggatttaacacatcaggtttctcttattgcttttggtacggttacaaaacctccgcgataaactacgtggtaaccgtgagacatatcgtggttaaaaaactgaaaagattaccgtgtatggtaattgtgataaccacgtgataaccgtacggttttgttaaatccttctgtacattttaccgtgtatcggatctgcaaaatcgaagcgggcaaatttttacacgctttgcttcagcttcgaactgaaccacacaacttttttacaataaccttcactaatgtgatttgttgttcgtgtttccagacgattaaactactgctccgacgagctttcggcgcggcttccgcggccgccgtggcgacgattcgacgcgatgcgattcgattctgcatctggcctgcagatttcgctcgtgtagccttctgcacgagtcaagtacagttgactgctacacgtggagagttggaggggaatagatactgtctgcctgcctccattcttttacttcgaaaacgaggctcgagcagccgagctctagtccagtccagctgtgccttttgattctccttgcctgttctccttgtcccctgcctgattattccacccagtaatggaaattaaccgtgtgcacaattttaattcactctgttcaacgaggtcaatcaatcttcaggagagtcgtcagaggcttcaatttttttcgaaggtaatcgaacatgaatgcagaggtctcgaactcgaaccaaattggcggcaccaagcaaatgcatcgaatcaatgcagcctgggcgagcaactgccgacggaacagaagcacgacggacgctttgatggtatggtcgccactagctgctgcctcctcctccattggcagatgggagacggctcaggacaccggtctcgcgattgcagcctcgtttgggcaggctaaacttgatataaccatccgtacgaagcgcaggtctcgacgaatttgagttaggccgctcaatttgcattagtaaactcggtcgagttgcaacagcagcagcaaacagctgtaaccagagttgcctcatgtgctcaacccgcagcagtaggatacgatgaaaaattgggggttttttctttttcctgcggtactgatgtactgtagcctgcataacctgcagtctgcatgcagcgcgagctgcacgtaaatgtgccggccggctcacagtttcgccgcggcttctggtcgtcgtcgtcgttgcggcagccgatacaggagggcgtttccagagatgaacctacagctgtgtgcgtgttgagtcgccgcgttggtagaagcagaaccaaaactgcatctttattgttgcctgttaccacttcgtggaagctgctaatgagggcatgtaactatggttgtccgactcttaaaacttgtaatgtcgacggttttattccttattgaaaatattacttgcggttcgaaattttggctctatagaacagttgcggatctagaatttataggataggtattcagaattttaaaatagcttttccaagatataacgatacagattgatatgttgacggtacgatacactattttcatattactatgacttgtgcgcatatatgataaaatatatagacttgtgcacctcttatcttgtgttagaaaaataactacatcatatctaaggaaactttaagtttataggaatgattttgaatttaaggtttaattaaatttttggtgtaggagtatatagagactatgtgatgaaaaagggtttcaaggagaaggtcttgttttaaaaatgggactaatataaattagaggtttggaacttagaagtaacatgtaatatggacatcttggatcttacacccctccccccccccccccccccccccgcgtgtttcacattataagatgttttgaccccctctatctctcgtctagatttactaacatccatatgaaaccaaacaaatatatgaagcacatacatggatgtatttcagaaggaagtatgagcacatatatatgaagtacatacatttgaaacaaaggaagtatttcagaaggaagagatttaaatataaaactcaaccaagaaactccaaatcaataaaaaggtcgaaattataaagttgagatgatactaatttgggcttttctagaaatggatggaaataagaaatggttcaaaattctaggaatttaaagcaagatacatcaaacattcaataaaaaggtttaagattcaaaaatttgaatcaagacataaaaggatagaaatatctgaaatcaacttttcagattaaaagacacactttatatttctccgaatagaagaaataatcgaagtaataagcaaagaatcgtcatggtgcatttttgaaaatgttaaaattttcaggatggtacattgatcttaccccttgtacaaattgaatccataatgaatctattaagaatacaaatcgttcgttcggacacccaaaaccagatcatctggagtatcttgttttgttaggatatgccaattttggttgtcaacagtcctcaagtcattgcatacaaatagaccaaacaactatttctaggcacatatgttgtaatctggcatacacttatgccaacatccaccaaaactccgaaccaatttttttaaaaaaaaatcatagtcaaatttcttcactaatttttcatcccaaaatataaaccattgttttacgcaccaacagctgtataaacaattttgtttttacaagcgacatttttccatgatgtgaaaattgtcaatgctattggaaacattttttcacattatgagaaaacaccagtggtgtgatggtggagttgtgggtgtatgactttacccattaggatctaaatcatggtgcccacgaatattacacatatgcaggtgggcttttaacagaattttagtgagataagggatgtgcagttggttttcgtttgttagagcctgtgttagctgacgtattcatgggggtgtgagtgcactgttaatgtgtataatgatgtgcatatatgcgtctgcggtataattggggggtgggattgtctttaaagcgtatgttagagggcacattcgtgagatgtgagtatggtgttgcggatatagtgatgtgtgcgcacttctgccatataatcgaaaaaaaatcacattacctgcttgtctcaaactcaaaccgttgactaatctaggagagtaggagtatcttttgcaagaaaaaggtgtccgtgtaactgtatgtcccagtatccatatagtacattgtatgtgtattgtgtcaccatcatccacttggatcacacccacgctacgtctacgtagaggcgcatcaccacgtacgcacgtatagtacgttaggacacacattcctccgtacgtccacgtctcagggcgatcgatcctcaccacaccacctgcagctgcatctgctcgatccatccatcgatcgatcatggcgttgcactcgcgcacataccctcctccattacccacagtacgtggtcgaacactcagctgtgatcccacaacctcaccacgccgccgccctcgtccattattccaccgccgtccgcctgcaggccgagcatcaccggcggtgggctgatcatcagcccctccgccatgctcaccatcagcctcggcatctccagcacgtcgtcctcgtccaccacgccgccgccgccgcccccgtcctcgagctgacgccgactgtcgtcgtcctcctcctggtgtgccatcgcggcggcggcggcggtggccgcggcgcgcacgtcgtcgggggacgcggacgccggggcggggcgcgaccgcgcggcgtcggggaagttgagcgccgcgccgcgcccgcgcagcgccagtgcggcggcgtcgtacgccgcggcggccatctcgggggtggcgtacgtgccgagccatatcctgctcggcttccggagctcccggatctccgacacccacttccccgccctgaaccgcacgccgcggtacaccgggtgccgcgtctccgccctcgcccgcctgatcccgcacgccgccgcgctctgcctcctcccctgccgctgctgcgccgccgccgccgcccgttgctccatgccacaacccaacacaccaatccacacctacgtgcctctcacattgctcaccacactgccacactgatcgatcactcgatcagctcatcaacatgcacgtacttatacgtacactggcctgctctaccaatagaatttcgcaccgtctagtacggatcgtaaaaaaaaacaaactggcttatattagaggaagatgtgtactaaactcgaccgaaacggaggattgcgagggtataaaaacgggcgggagttggtgaaaacattggggacaaatcgggatacgcgtttcttgcttgctcgatcgacgctgggctagggattagctgtgaagcacagggagcaaaaaagagtggctgtttcaggcttacaggacggtcaggccaatggcgtctcgccacattgggggagatctcacatgtcgcaaagccgctttcgcgttagtgcgcgacgaggttagtacgatcctcgcgtccaagtggcggctgatcaagccgtgatctgcaggatgttaatttatttttgacccggtctcgaacaccataattaagggtttaatggaaaaggtgaaagggatcagtcttggcatgatgagtagatgatgaatcgctagattcttttgttttcttgccacctaccatatccagttactagatcacgaagctagctagcttgtaggagccatgcatggtgagagatttttgtttcctctgaaagacaacgacgagaatataatcgctgcaacactccattttcagaggctcatatgctttggatggtgaattagtgataactgatcaccagtctgaataactgatcgccggctgtaccacgatcgatcaaaatatgaaaaacatttttgtgtgcgttgacgagtgtgctagttgttaagcacggccagcttgcagagagaagaaacagcaagtcctaccaacactgcaggagaattcagctgttagcctgtaacttgttagcaacttagcatcagtgctccacgacgatacgatcgaattgctgcactacacgaagctgtggatgcccccacaaggccactagtatgcatgggacctgaaggggtttttggcgatatctccctgaaggcccacatggtgatgaatgcatgcactaccaagctaagctagccccagctgcttgattgattgatgatcgatgctagctagctgcagatccatctgtggttagcttggagtaaagctcaatccaagcattttgtttgccttttggaatttgggggaaaaggacgttcttgaacttatcccccaaatagtatactattctgcgagaatgtcaaaagccagatcatccttttatgagcgttcagcatcttacattctgcaagcttccttgaaagtcgaaagctatctggacgatgggaacacttttggcgtggtcgtgaagttgtacatgcatgagtttgccattagttagtgcgtagatcctgataatcataagaagtatctacgtgtcatttcgcccccttctccccgccgcctcaccgccccaccaccacaatcggctccaacacggacctaccgtacatcactctggtcatccctctaagccggaaacaccttctactttctccaccccgactcaaatactcactgatgtttgctggaactcgtcggagataaatccatagcataaatcatagatacaatttgcaaggttagaaatttacgtggtttcacccccaaaaatgtgtcaagtgatgcgcagcattctgatgaagatattacacacttgaacgtgcttagaaaataatttgttaggttcatggattacccataccaaaatctattgaacatgtgctgaaggattgtacatatcggtgtggtatgcatataagtggtgcgtgcgcgtgttccactcaaccagcaaaatactccatagtttctacaagagcggtggtgattggtgaagctacatgcctactgtagcctcacacaaacattttctcccttaatgtctgacgttgataagtcatcggcgatcccatctaggcgtcagctgttgtatcttgctgccatccgtcgagtggcccgatgccccaagctggagcagcaggtaagttctcctccaatacggcgaaacccctaaatccttgtccaattgccacttgctctctaattctcctaatcctataccctaatcctctggatctgataatggaaacatctgctgaatgaatacttaattttgcggttttccttcttgtttacaatttcagccacattaaaattggtcaagtgctcaaccaagatcaatgaaacatatatgttaccttattttggtgcttacgagatgtttggaggctcagagctaatagatatattgaaaattgaaccttcttttgtattttttttttgaccggggaagggggggggcaaaatgtccacctaaatacattacgtcgaccttcttttgtatgttaaaacatatgttagtttcttatgtagttcgaggaagcctatgagtataaacatgtataaattgattgttatttgttttgtgtattggccttgtgtatgtcttgcatctgtgtgttatcctcattctagtagaatctgtatcaagcggcccatgccatggcccgtgtatagtcatagcagcatgaacgacttttgggctgcctggcccatccagcacggcccatgaaaagaatcacgcccaagccatccgttgtacgttcaaaatgacacttgttactatggggcgaaggcgcaaaagctacacgtttcagggaaactttacttcgagcaattctgaaacaaactagtggcgaagagaaataactgatatttttattcttgtttttatttctaggctttaatggtcttatcagctattcagctgtaacccgtggaaataaagtttttgtgagacaaattttaaatgctaaagataaatactctaggacggtcactcactcactcagttacgcagtctcctttaagtcaggaggaaaaggattggtgtagtatggacctggtggccacttgtaatatgaaaatggaaccgtgccaaatcgattggtcctcttccctatcatgatcagtcaggcccatacgcccactttggtgatgcgatgtgagtatgtgaccacaccgagagataagttatagccatattggctgtactaataaatcaaagcaaaagctaaaatttgaattttcaaattttattttgaaattggttttaagatatttttaatgtactttctttttcagcatcgacttttagaatgttaataacacatatataaaagtttcacctataaattatttttattctctaatattatagcttgctagggaatatgagcaatcgataagaacctcaagaaatggcgaaagagcgtgcctggattaggcctttcatccgacactgcacatgcacactgcacacatcgcgtccaggctttggccgaacatatctagtgttaaacgagtactaataataataaaaagaagagtaattaaacgatgaataaccaattgcagaaacgcaatcgttctagacagccatcgccgccagaatattgaattgttgcggagacatctgtagtcgaagattttgacaggggcaggcgccggccgtatccttcctgtccgtttttttctacacggcaagcaacgacaggttgatggctggcccatcagcttcatccggcaatggacccaggataatggagggttataaaataaacggtttaccacgactaaggttagacgtaacaaaataagtatactatgtcaggatatataagtgttacgtggacgtgcaattttttacgtgtttatgaaaaaaataagtattgtgaatgagcactgatgatgttttagggtgatgtaaacggtttggctgtatttgatacctttgggtgaaaggtgaaacggaaattttggagaaatttcaaaagaagtagaagtttattggaagaataataacggagcctcaaaattctctctcccatatgacagcgcgcgttgggagagccgtgtcgtgcggtgttgaatttccacttgttaacgacgcccgccatcactgactttggccgtctcgcgtgcatgcatccacctttttttttttgttttcagcattgacatcagttgactacacaagtcctgcattgtgcttatccaattaacttgccagccaccattacaaaaaaattgcatcttgtggtcgtggcaagcttaattttagcttgttctagtagatcaagcagtaccataaaagcagttggaaacaatattaacttatcctctctccgtattttaatatatgacgccgttaacattttaatcaacatttgattattcgtcttattcaaaaatgtatgtaattatcatttattttattgttacttgatttatcatcaaatattgtttaagcttgatacaaatatttttatatttaaacaaaaaaatttaaataagacgaatggtcaaacgttggttgaaaagtcaacggcgtcatatattaaaatatagagagagtattattttctggaaacggtcttaatatggtggggaatttttcatattgatgaatttaactatttagtggtgacattagtatgatgctgaatgaaattagaaaaatctaagttctatagatggctagaaacaaaaaacggttggaaacgataccattttcatatttattgtataaaaataatctcggtatatgaacggaaattttcataccgtttccatccttcgcagttgtttcactaaaaaaggtatacaaagtactatactagtagaaagcgacctttactttactctagaagtagaattagtcaggccaatcacgtttgcctaaacaagccactagtagtactagcattcttcccaaaacgtcaatcatactgtagtcagatctgcatatcaacattaaccgccacgttcttatctgatgaagtaaccatcaagaatgattcttcgagcttatcacatctcccatttgcataccactaatagttacagacttacagcaagagaggtatggaaagcaccggcgatactgtccatcgattgagagccgagacagcaacgcaattggctggccactgcatctgcatcagccatcaatggagggaaagctacagaaaggaagctcacagctgcttcgcgccactcgtcagggtcacactcaacagagtgaaaggcacacggaaaacgaaggaaagactggaaagttatgcggcattgctgtccaacagcgaaagccattggttaattagactccagcaattcagggtcacagaataatcatgtgttcaaaatcaaagccagctctgctttggttgtgagaattgcttggatagtagtacaggtaaaggagttgttttaagtgttttgaattaggagaagatattttttggactgcactaatcttgcggaattaacggggttgatgatttaccatatagtatatagttttgatctttgcatcaactatattcacattcacaagtccaagctgcttgaggaaattgttaccctgtaacccaacactagtttgctcatcgtttgctctacagaaaatgaatgaaacaactaaaaataatttatggtaaaacttttaaatcatgttctcagcgatataaaagcaatgctaaaaaatattataataaaagaacttaaaatcaatcaaattttagttgcggcataaatcaacaagcaaacggtgataacaccgcatcacagagtaaccaaccttctagaagcaaagccacccaatatatgcatctatgtgactatgactaagatgccaacaagatgtcatctaatgcaatgtttcctaaagtgcctcaatagtcctaattaatcatctcattccacttgctatcttgtacattgccgtatatatcaatccttatactacacatttctggtaggttttgatcaaaagttaaattaatacaaacaaaggaacttcttgatatggtatgaatatgatttaggcttctgttcagagacatgcattaatatacatcatcatacattaatatgcacacacaacctagagtttaagccctaaatacacacctaaataaatctatacaattgcttgcgtgcatatagttgtacgcaatcgaagtttaaaggatggaatcatgcacatacaactcctgtacataccaatgccgctaaattaggaggcggcgtgcagttaaatagaggacacatgagtattgagcgacaagccgacaacgagcgtgttccaactagatgattgaataggttgttcctttttccttgaaaaacctttgaaaagggtatggtattcctgtaatttgctatacaagaatatagttgattcagtttatgaggaaaatcagaatcgaaaaacttaatataaccaccacgaatgaaaacacatgactcaagtgacacaaacctatgataacgtcaggtgaaacgttcactccacagaaagttattgtcgttgctcccacgttgaataagagccctaacttcaacaagggcatgccgacagaatgacaacattgtccaatccaaaatggatctataggttcacacacccaaaggacttcctaaatgtggtattcacaaaattcccatagtatcatctctagaaggtgaacggtgtccgaaggcagtgacgtaactagcactttcaccctagagacacacacgcgaccaccagaatgccaaaactgctaataaggtcaccgcccatcgcacctcaacagcacgcatggatacgattgagctctaacttcaactaaaaagtgtagttgctttgatgtcagcattatcaacctcatcaactgatgcagcaacttcgatgccacctagactcagcctatcatagaatatcgtatgccagcaccatacactgctacatgacaacatcgaacatctctatgtttatcattacccacgccccaagcgagtcttgccaatgcaagaaaaccctaaaacacaaaaacaactcctctatcataaattcagagaaacatgagtccttcacatgtaagacccaccctcataaactcacacgtcatatgctcgtgtctctctaacattcgttagaaaagcctcatggcctaaaacacagtgcggttaggctggctagcacggagataagcgatcaaagctgtaggttagaccgttagattccgatcagacggcaggatcgactcacaaccaatcgctcccaaatcccaatgactaagggtgtgtttggttcacggtcatgcatggtgtgatatggcgatccattttttattggatgacgatccaattttttgttttatttgtatagatatgatgaccaaattacttgtttggttggagggatatagcatgaatgggaaaaggcaaaagttagtgggacccatttttcatatatatatatatatatatatatatatttcaaaatataataatccgaaatcttgttttaaaagatttagttgtaacaaatataaaggtgtgatcaaatcataaattagataaacggtttaagagaaaaaaaatcatttggagcttacttaatagaaaatcaaaccaaccacagccaatcagaataggacacatcatccagaccaaaactggatggcttcatctagccaaatcggctagatgcactcatccagtatattgaggtaatattccctatttcgagccgccccatccaccttaccctctaaccaaacaccacagaaaatcagacggtcatctcctatcaatactcgttcattcaaccaaacacaccctaaatcaatatggttcgcgtgtttaaccaccatttataacccttcactttcatccgcaatctccgtcaattacacggtgaacaacaccaataaccgggggagccttcaagcccttcaccctcatccgcagtctccgtcaattacactgtgaacaacaccaattaccgaagcctttaaggcagaagcaagaaataaacagtaaacagccaattgtaagcagcaaaccagagccaaaccgctgccgaccagccgctgccgccgtgtgtttataaaaagtcagcaaaaccttcccccaccacgctcgttagctaaaactgtgaaaactctccattttccttgcctctctctctccccacccaatcccaacccaccacctctcctctcgccgccgccgccgccgccgccgcgcgccgttctatggcctacacctcctcctccctccacctccacaagcacctcctcctccccaagaccaacccctcctcctcctactcgcggcctccgcctccgtcgttcgtcgccgcggcggccaagatcaacggcgtcaacggacactcctccaagaagtcccccaacggcaaggcgcagatcaacggcgacggcaagaagggggtcaacgggagcgggaggaagaaggcggcggcgcagcacatcaacgggaatgaccggatccatctgtcggtgagcacgggcggcgccgggggccaggatgggttcgggctcagggtggcgttccagggcgcgccgggcgcgtacagcgagttcgcggcgaagacggcgctccccgggtgcgacaccgtgccctgccgcgcgttcgccgacgcgctggcggcggtcgacggcggcgccgtcgaccgcgcgatactgcccgtcgagtccaccatggagggcaccgcgctgcggaactacgacctcctgctgaggcatgacctcgtcgtggtccaggagatcaacctgttcgtgcactactgcctcctcgccatgcccggtgtccgcgccgccgaggtgcgccgggtgattagccaccccatggcgctcgcgcactgcggccgtgcgctggcgcggctcggcgtggacagggagcccgtggaggacaccgccggcgccgtggagatgctgcggtccaaccggatgctcgacaccgccgccatcgccagcccgcgcgccgccgacctctacggcctcgacgtgctcgcgcacggcctccaggacgagtcatggaacgtcacccgcttcctgctcctctccaagccgccctcgccggtgacgctgcccatggacgccgacgccaagaccagcatggtggtcgcccaccggggcggctccatgatggtggtcctcaaggtcctctccgccttctcctcccgcaacatcaacctgaccaagctggaggtcatcaacaacaacgacggcggcggcggcggcggtggcgccgcggcgggccaccccgtgatgatcctcgacacgagcgcccgcggcgcgccgacgctccgcgcgttcccgcacgtcctctacgtcgactgcgagggcgcctctcacgacccgcgcgtcctcgacgccatcaaggagatcgagagattcgcggtgttcgtccgcgttcttggctgctacgccgccgattccaacgtctacgacctgcaatgaggcggccatcgatcgaacacacagctgcggatccacatcaaatcagctagtcttgcaagatttggatcactgatcagttggattagagctctccattccagcactcacttcagtgagctacagatgctatactttgcttgcttgctgctgatgctgctgctgctgcctgctatgcgatttttgtacagatgcaataagaaatctttaccatttctgctgctggcttaggtatgtgcataggtttttaatcctggtattgatgccttctagctgaaggaaagtgtaagatggcacaggattgatgtaattttggtgtgctagatcttgattgatagtgagtattccttaatccccatttggtcctagatcttcctctgtattcatcccaccacactatgcagtgttctgttgatctaaagattagaccttgggattcatctgatcttggagcacctgaatttgtcactgttactaactgtaatacactgaattttgtacagaagacaatgtaatttacacacctaatgttgtgtacttgttgatctactactctgcttacaaggtgagctctggtattttgtaaattttgtattatcaagtttgagactttgtaaaccactaaaacatgtggattccaactgttaaatatagttgattacctccacaagaaatgcactacttgggtacttaacgcacacgagctgcacgagtctctgcttagtgatatgatatatagtactaattcttttgctaatattagaaaatgatctgggcatctacgactgattttaaaatctgatactgacatgataaccggggaagacaatatttttacaggctccttttcttttggggggggcatctgtcctcaatcaagagccgacaggggaatctgaatccatgtggagctttgtgcggggtggtcacggaatctttcatgtgaattttcagagaatctctaaccttagcattagaaggaaagctccaaccatctgattatgctttagttacacttaaaacagttaaattactggttcatcaacgagcttcttttggcaaggggaatcaaatcaaatcgaggccctacccctgtcactcttccagtggctcaggctcattcaacagagcagggaaaaagatctgaggagtagtaactatcactgataagcgagggccctgataactgagagtcacaagaacactgagagagaactgcaacctcatgctcacatgtgaccgaaataaaaccggtctactcaggctgcaacgaaatgaaaggcacaagcgagcgatagcaaaggctcagatcccgtatcaaaatgtgcgaattttcatcgcatgtgtggcacatggaaccgtacggcggtttggccgcatttggcggtggaaacggacacatcgcgcgctgcaaacccacagaattccagcgaaaacggtgcgtttctcccccgttctttctttttttttgctgaaagcttataagaaattcagagctctgaaacagtggagttctcttctctgccgtggctggtgagaatggcttgattggtggaagctgtgcgtgtgcgatgcatctccacatggcctgtggcccggagactttgggagtcacgatgagcagcgtaccaaccgggttacttgggtggtagtatgtacttggtcattgtggtcacagttctttgctgtcattttaaccttacttacccacctccaactcccattgcaagagaccttgctttgtcacctgccaaattggcaagatctgaattatgtaccatatcttggacaataatgcagggagatagagagagatagagagggtgaccacacggttgaattgttccgagcaatgcttgctctcccatgtagctggagaggaatccgggacctgaactgatcatgcagtgtgtaagccgcatcttgcacgcgtatcatgaacaactgaaacgtcgctgccaggctgccagccgctgaattttctttgaagttagctagatttgatgtttttgatccatacctttcaggaatatatttacatgcaacataatgaatacggcagtggagaaggaaagggaaatttcaccggatcccaatggcgctcatacttcaagtaaaacctgaagcaaagagcgtgtcgcacatgcgaaaaggaatgtgttgcaaatggcattagtgaaacctctatagctagaggttctagaaggaatcgtgttgggactagggagcacatataaattattaattgatgcagggttgcgatgcgatgtggagaagaaaggtgtgatgtaatataagatatactacctccgtcccaaaataagtgtagccgtggatatccgtgcccaacgtttgactcgtccatcttatttgaaaaatttgtgaaaaaattgaaaatatttagtcacacataaagtactatttatgttttatcatataatagcaataaaaatactagtcataaaaaatattcaaataagacgaacggtcgaacgtttgaacgtaaatagtgtaaaactgcatttattttgggacggagggagtatcaagtcgtggacggagcacatcagtggctcacatgcaaccggtgattcggcgtgggttgttaggtcgtagtcgcgggggtggcctttacgccatgaacaaatactgggagtgggagagatagacgcatataggatcgcttggtttgcctcgacgggaagtaatttgctaaactcggtttcagctaacaagcaagacaacagggcacatggccgtatggtgctagctagtaccatgcttattccttctctgttccaaaagctagcttattcatcgtacgtggcatgcatgatggggtctcatcagtacctgtcattatagatgctgtgctggtgtcggtttagaccagagagagcaaatgatccaaggcgaaaaagatcttagggtagctctggtcgcgtcgtgtacggtccagatgcggcggggccgtagtcgtgcgcgacgcggcacgcacgctgattacgctcgtttccgcgtgaaattgcaccggaaaactgcccgcccgattcggcccatctccccagtcccaacccaacccaacccaccccaccccacccccggtcgcgacacgagccagcgcgagagaggccgcctgcctcgcgtcgcaccgaccgccgaatggtggccgggccggcccacgcgacgtagcggttggcgccacggggcctccaacattgggcaaacaaggccgcgcgctgcggtttctggcgtcccccagctgcttgctcgcgcttcgcgtccctgttccctgcctccctgccgaggctggcagcgtacagtatgtttgtgtgggaaaaagtacaccgaaggtccctgagcttatcataggataaaaaacattctcgaacagtaaaaccagatatgcggggtcccttaactacataaaaccggtcacccgaggtccttcggtggttttgactccggttttagtctatgtggcggctgagtcagcgtagtacccacatgtcagcgtgccacgtcaactttccctttctcctcttctctctcccttcctccctctctgctctctctctctcgcaggccgggccaagggtagggagcagacgcccaggcggcgagcggggctgagtggcggcgccgcgacggcggccggcggccgcgtcggccgcgcacacctagcggatcctcgcttcgagcctcttgacttgcaggcaaacggtaagaagagcaccaccatcagccagaactagcggggacggcgggatctgcgaggacgccagattggtggggacgcgatgccacaccgactccaccttgatggtgtcgatgccgcaggcaagctcccccatggcgcccatgaactgcgccgcccacggctcgttactcgcaatcgatctcgcctacacttcccatgttatctgcatcgatcaatctgaccttgtgactgcatgcatttctagctcccagctacctgtgtcaaacattccatttgcaagataatagcatgccagagccagatgataagaacaaattaaccgatacttgaagaactgagactaatcatcgcgtgcaagtgcaactgggcctctttaatctacccatgacaatactgtcagccaggttcaactagtgctcgggtcctcctccgctcaggccccgtcgttcactgagctgctcatcgctgggtgggggcgtcggcgggcggtgacgccattggcaacctcgagcagagtccagccttcccaatctctgctcagaaggatctgcgtgctcgagctcttcagcgcacaccgcgtctagtcgctccaccacgtccgcgaggaagaggcggcgcccctagttcgcgtcgtcgccgacataaggtcaccgctggggccatcagttgcaggaggaggcggcgtcttctccggctccgtcgcggccggggaacccatcgccttctccgactccaccgtggtgttgcgcagggccggtcttatgatttcgtgggccctatgcgaactcatcacgatggcccctataagctatatataaaattttatgatatatatagacgctaattttacttgcaaaatgaaaacaaacatatccatatattaaatttaacatatctgttaattatcgagaaataaagtcaaccaaaacaacaatatatttataccttggaactaatatcattatcttaatgaagaaaagaacccaatcatatccattgcttctcatgaaaagatacttcttcgggcatttctgatgcaaaatcatcaataacggtattaagatcaatagtgtctaagattgggcgacgaggtgacgacgctccaactcctctcgtttcggcgtttttgcttctaggtaggccatagacaggtactagactactagtattaggtgttggtccccccactatcatgggccccccaccatcatgggcccccggcggtcacctcggctgcatagggccagggccggccctggtgttgcgtaccgtgaggccataggcgatttgggaggaggggttgtcgggggcggtggatgtgtcgccagtggtggatgcggctccgccgccgtcccgcccgccacctcctcgcactgcggttgctgctcccgctcccttctcatctctacggccgatgacctcctcagcctcctcaacgacaatgacgacgatgacaacccgttccccgccgctgctaacgccatcgccgccgccgaccccggccgcgcgcgccgccttgggcgccctagcgccggcatccccatgccctgcgagagcagagagagagagggagggaggaagcagagaaacagagaaagaaaagaggtgaaaggggaagttgacgtggcacgctgacatgtggggcccacgtgggtcccacgctgactcagctgccacatagaccaaaaccggggtcaaaactaccgaaggatcttcggtgaccgattttatatagttaagggacctcgtatatctggttttgcggtttgaggacgttttttttatccccatgataagttcagggatcttcggtgtacttcttccttatgtgtgtgactactcatgctattcacgagattttcgtgcggattccataggaaacggttcaatttctatgcgtaaagagaagatttttctcacgtttcaaaccggggctttcgtcttttttgcacaagaggagtaccagtctggagtgtcggagccaaaaagatttttaagctcggataaattttaatataactaatatttactatagaaatttattcattattgatttactcatccatatcaaaatttattggagttttcgctggcgggccgggtggtgactccgccccctgactacttaatttgaggtaaaaagtttctatcttagtctaatacatgaaaaatgaaaattaataacacctgaaagtctcgagcaaaagatcaagtatcagtatataattggaagatttagttctaacaaattctaaaaggaaaaattatgaattacccctcgaactatcgcggtcgtctgaaatacccccctgaaccacaaaaccggacattcttcacctcgaactatgtaaaccggacgaattacccccctcgacccaacccgcggtggttttggtctacgtggcgtacgcgtggctgtttaatcagcattttatttattaataaaatgtgggacccacatatcaaattcctatccaactattcccctctctctcttatctcattctctctcattcacgcgcacggaggcatgtgggcaacagtgagcggcggcagggtgcagcggaggaggcgaggcgaggcggcggtggtggcggaggaggaggaggcgagcggcgggggatgaggcggcaagcggcggcggggtgcagtggaggaggcgaggggcggcggtgtgcggcggcggagatgagcggcggctaggtatggcgggggagaccagtggcggcggggt

SEQ ID NO: 66107 - DNA, 5718 bp, Oryza sativa
  unsure (1)..(5718): unsure at all n locations
ttcctgcagcccaaagagcacaatttgaaaagagagtttagagttgttcctataaatgcatttctctccaagtttacaattgagggggaagaaactctagtttggcttgcttattctacctttacaaccatgattcaattgcatcttaatcagatttaatcttaatagctaaaattacttgcattgctcaatcctattaatgtgttaattcatctttgtccctgcccaaataaatgtcacgaatgccacatccgtcgtggtaaaagaaagcaatatgtcccaaacaaatgtataccaaaatggcttggagcgagtttcccccttcccccaaagccccaaaccgctattgaatggcttaggcatactatatccgccacattgccatatccgggaaagtccaaaaatatcttacgaagtacaaaatctttcttatatccattagtgccaaccgagcaagagggtggggaagggcataagaccccatggttttgaaatttaataaatatcacaaattctacttccattggtgaaagtaagcaagaggtaagctatggcttgtagcgagccggtcctctatgctctatgaagtggtttgggttattaggtatcctacatccatcaacacttataaacatagggaagtttaaatacaacctttttatacacattagtgcctaaggggaggaagaactgaagaaggtagacatggatacgaaaacccctggttttgaaatttcataaactaaatttatttaaaacattgtcatttacccaccagtaaattttacaatttctagctccttcaatattaacataagattgaagaatccatctaattaggatacaaatattaataaaccaaagtcattctagtaaaaaaaactacattataaatcacttatctcctcttgtggcttaacctgattaacaaatagaccaatccctcctcaacctccgtctcctcgaatgatcaaagagcacgtggccactatatgagcaaaccaattgtcctgagctgacaagagtccaaggcttgaattgagctagtttctccacccccacgagccacggatccatcggctcaggttccagtcccaccgggggtagagaaagcaaggcaccctcttcgtcctcctctcacaccttccctcttcacacatcacgcgttgtctcctcctccccttccccttcctcaaaatctcctcaacacgccgccttagcctcagccccagctcctcagccctgcgcatgcttcgatcttggtgaattcagggagctcgtgaggttacaattaaggggaataaacactagtttggcttgctcattcaacactttgcagcagggtccaattgcatctaaattatctgcagtggtcaattctactcattaattcatttatgtccctgcctgaatgaatatcacaaataccatatccatcggtgaaagaaaacatgcggacccaaacaaatataaacaatggcttgaagcgagccggctctcccatacgccacaaagcggctcgatatcctatatctgcaacatcgctacttttaggaatgttcgtaaatatcttatacatgctagtgccaatgggagtatgatggtgtgttggaataggggaaccagccccatgattttgaaattcaacagactaaatttgttgaaactcatgagatataaatgttaccatttctagctcctcaattattaacaagcgaataaagaatccattaataataataataataaccatattataaatcaattatcccctattttaacttaacccgattaacaaatcaacccatatgcttcccactctccatcgactcgacttgaatgctcgtagagcacgcaaccacactgtgtatgaacaaaccaccagcgcgcaaagccgagaagagcccatgggtcggcgatcgagccggctcccccgcccctaacgaaagccgcggacnncggctcngggncnttncgnggncnttncggggnncttnnccgngnngnaatttccccnaanaaaattttcccncccaccggtgtagaaaaggcaaaggcaccctcgttctcctttcacacctctccccccctcttcttctctctctccacatcacaagtcgccttcctcctccgcccccgaaatcccctcgcgaaccagagaaacctgaggcaccaccatcaccaccaccgcctccgcctccgcctccgcctcctgcgcgcgcggcgaattcgggggaccctcgcgctcgcgtggggtgtgggtggggggagatccgggcgtcgccgtcgccgggggggggagggtgctcggattcagccagcggcgggtgggggggcccgcctctttcttcttgggggggcgcggaggagaccccgcccgtcctggattccgtggccgcggcgccgattcgggcgcgggagccccagcacggtgagattttcccccgctgccttgctgcactgtgagaattgccgtatctatactgtactagtttgttgttgttgttgttgttgatgatgtggctgctcgctgttgcggaaacagtggaatggatgggggtttgggatggttggggtttgacgagctgggcgggttgaggcgggaggagggtttgcttagggtggaatctgattggccgcgatcggcacgggtgttttggctgtatcctatagcgtgaaaaagataggaaaattactggttgtatcactttttgctgggtcaggtttggatagaattcaatcgtgttttccctccatgtcttttatccgttgaaatggtgccatatgaaatgtcaggattagttataaattctggttgcacactttgtggacgatttctgttatttgagtgggttatttagcgattatgtgtccgcgaatataatctgtactgacgtaagagcagtgaattttttttatcactcatcacagtgtgtttttagctggatgataactgagagttttgttcctgttattctgagttcagcacccgattattcataagtccaaatgatattttgttgcttgtgtatttgtctaaaactgtgcttgtggcgtccagccagtcaattcttgtgagtattacgcatttttagtgctatatttggcctgatatatatactatcttgagtaggtattatggtgatgaagatggaggctgatgaggatggtgccaatggcggaactggtgggacatggactgacgaggaccgagcgctcaccgccagtgtgcttggaacggatgcttttgcttacttgacaaaaggaggtggtgccatatccgagggccttgttgctgcatctttgccagtggacttgcaaaatagactccaggagcttgtcgaatcagatcgtcctggtgctggttggaactatgccatattctggcagctgtcgcgcacaaagtccggtgaccttgtccttggatggggggatggctcttgccgtgagcctcatgatggtgagatgggacctgctgcttctgcaggtagtgacgaggccaaacagaggatgcgcaagcgtgtgctgcagcgattgcactcagcattcggaggtgttgacgaggaggattatgccccaggcattgatcaggtgacagacacagagatgttttttctagcatctatgtactttgcatttccacgccgtgctggtggccctggtcaagtatttgcagcaggcgtgcccctgtggattcccaacactgaacgtaacgtatttcctgccaattactgttaccggggataccttgcaaatgctgcaggatttagaactattgtgctagttccatttgagaccggtgtacttgaactgggttcgatgcaacaggtagcggagagttctgacactctccagaccataagatctgtgtttgctggggcaattggcaataaagctggagttcagagacacgaggggagtggccctacagataagtcaccaggtttggcaaagatttttgggaaggaccttaaccttggccggccttcagcaggcccaggaactggcgtgtcagaggcagatgaaaggtcgtgggaacaaaggactggtggtgggagctcattgctccccaatgtccaaagaggtttgcagaatttcacttggagtcaggctcggggcctgaattctcatcagcagaagtttggcaacggtatattgattgtgagcaatgaagccacaccgcgcaacaatggaggagttgacagctctactgcaacacagtttcagcttcagaaagcaccaccacttcagaaactaccacagctccagaaatcacatcagctagtaaagccacagcaactagtgagtcagcaacagttgcagcctcaagctcccaggcaaatagatttcagtgctgggaccagttccaaacctggtgttttgactaaaaaaccagctggtattgatggggatggtgcagaggtggatggcttgtgtaaagacgaaggtccgccacctgcattagaagaccggcggcctagaaagaggggaagaaagcctgcaaacgggagggaagagccactaaatcatgttgaggccgagcgccagaggagggagaagctcaaccagcgattctatgcactgagagccgttgtacccaatatatcaaaaatggacaaggcatccctccttggtgacgccataacatacatcactgacctacagaagaagctcaaagagatggaggtagagcgagaaaggcttatcgagtctggaatgatcgatccgagggatcggacgcctcgacctgaggtggacattcaggtggttcaggatgaggttctagtccgagtgatgagccccatggaaagccaccctgtcagggccatcttccaagctttcgaagaggcagaagtccatgcaggggagtcgaagatcacaagcaacaacggcacggccgtgcattctttcatcatcaagtgccctggcgccgaacagcaaacgagggagaaggtgattgccgccatgtctcgcgtgatgaactcagggtagaatcagttggggagtgggcgccaccggtagaggcagctttacttcgttcgctggttgcagacaagcagcaagcagtcggttggacggacacccatccacccacctttcagcgctgttgatagaagaagtttgtaggcagagaaagaaagctcagattctgacttagcgatccaaggggaagacaaagctctcaagttaaaactgccattgttgtatggtaggcttttgtggtcggtgtagtttttctctttttgttgtttattggggagaataccatgttcttagtttattgcttgtggcagaaccataaacagtacatctcgtcaaatgcatgagttgggaaagaagtcacctgcttttctgctaattctgtgtttttgtttgtatctcaagtgagttggtgtttatacttcggcatgttactcggggaagctgggctacatgggccagtaggcacatctgtgatctgtgttctttcaatctagtgaccttttggggaggtgactctcatccatttccatatcaggtttttgtcggttcttattttcttagtgtgtgtgagaggaatgaaaacgagaaaattgaaaagacacgtaagaggtgagatattagtcattattaattaagtattaattattttaaattttaaacatatattaacatgatttttaagtagttttatagttttttttaaagagataatccataaaatgccattgacaagcg

SEQ ID NO: 66108 - DNA, 17342 bp, Oryza sativa
ttaatgcttaatctaatcttaatgatgctagtttatggacatcacaacagttgtttaagtccatgtatgtactatgctcactgacccatgacactagtcctagctcaactaaatggactagttcagttgtcacctattatagctgaaggcatcaaagtagcagcatctgggaaacaattttgctcttctaatggtattctacaagaagacaaaaatgggaagatattgactaacaagcacttagcattagattgtaagaaacaaagattattttggcactaagctcactgtttaattgctagtagttgacagtgccatctcacagggcattggaccatccaaagtagtagatagaattgtataatatacatgacttgacaatctgaataatacaaggtgcggtgtacattttagagggaacacagtattttcagaataactgtgaatgatttactgtatgttagcttcaccaactgtccatgtaatcttgagaaaagatcacaatgtacagcatctaggttaattactagtttaatgacttcttagcaactatgagttagattgacttcaagtcttggcaggaaagatgtcagtgttatcaaactttttctaagctttgaggcaaagcataccctagacaatctactggcttcttctaagccatgaatagacaggcaataacattaacaatttgagcctaatagtgaagagaagaggccctatatatataggattggaagagaatatgccgcaagttgttgcacctatcttgaccatatttcatagcaaatcatgctccactctgcagaacagaaaatattttctcctcagctccggtgcaccgtgaattttcgcatgatgcttccccaattcatcctaatctgttgctatatatcttagactgcatatctcatatatagttatgataacaaagatcacattcttgattcaaagcagccaagcacttagcctcaactgccattaaactaatcttgctcgcaatcccgacagaataacatggcaagctttcatactgtcgatcgattctcccatccaatgaactctggtttgtgatgcttcttcggtgatgcgttcatgtgagcattaagcaaagtgtttggcgtggtacgagataattatatggcctaaaagctggctagtggaaaggacttagaaaattaaagaagcattagcaaggggttaggctctagtatggaaggcaggcatttgcatctctgaccattaaaggacggcttaaggccattgatatggatccacttgtcggctcacagttgcatcctctgcctgtatttttcatcactggaatgttatttcttcgcgctgcgagaataaagcgattttcgcctttcctccgcgcctccttcttccctgtttctgctaatatatttttatgtccttgattcctgatgttttgagctcaagtttatcataatcatcatccgtagaccccctgaagtggatgctgataagcatggaaaaatccattggctgctgagacacactgcaatcctgttaattgccactgccagcaatctgaatgttggatccaacactgtctgcacatacaagcattgcacttggcctcagctctcattccctcctggcctatctcctgcttgattgccaggggccatacatatcaaaatggctcatcacctggggttctttctgtgacaccaacttctgctgatgacccctttttatgccggttaccgcacccgaagatcggcgacggagacggcacagggagataccctgctgaaatttcagtgtcaagaattagatgattctatcatagatcagtagatcacactgttatcacactgttactgcatgtgcatgagcacgagtgcagattagggagtgaaagctttctgtccaggatcttggaatgcactgcagcctgttggagtgaaatgggccaacagcatgtgcattccagcgttaggtgatagaattgacctgatgcgatgcagagaaatgacgcgggaaaaataaaaaggatccagacaattatctgatgcagtgatgcagccgctgaattggtgcagaggggtttatgcagctggggacatggtttgctttctgcaatgtgcgttgtctatctagttttggccttctgaaatgaccatgggggactgactggtgatgaagagaaaaagaaactgaagaatttctgccctgtccatgcatgggctttttcatggagagatttgagtccagatgttgtaagatgcaccatggataagtttgctgcaaaaatctcaaatgtctcagattacccaggacaggatggttactgcgtcattgcacaagatttgatggcattggagtctcagactctcagtggtggctctgacagacatttgggaaacagctcaacacaggttcagcatatgggtgtagtttgtacagttcaattgatgttcagatgattggaatgcactgttgaaaacaaaatgtccaacgccacaacgtccaagaagagtacgagagatgtgagtgaaaaatcagcaaagctccataggctaagatgaggatgatggaagcaatcaatcacatgaactaacaaattcaaaattatgaagtctatcaagaccaactgggattcatttttccaaagatgtttcagatattaacaggaggtaacagttgccgctgagtacctgttccctttgcctctacttcttggcagacatctcacttcccaaatttctattgcatcatgcataaggtgaaactgcagcataaatagtatccatgcatcctgacaaaaaacaaagggggcaatgggttcatcagaaaattcaatataacaacttatcactggcaaaaacaagacacccagtttccattctgcagaaatgtttgcataattctcatcatagagagaccaatagaaatgaaaagagagagaaatttcgtgaagtagagaagcttcgttgttagcctacttaccgggccttaccggccaatgcagctgaatcccctgcacacgggcgagccaggcaacgaagaggacgcggcggcgacctcgccggcgaacgggagtcggcagggggagcgccagcctccgcatctccgtctcacatcctggcctcggggaagcatcgcatcgccatgccatcgccgctgacggaggaaaaaagcagctggtggtgggacgccgggagctgcgggcgcgagcagcactgcggtgcgcccgcgccgccgcggtgtgcccgacatgccggtggtgtgcggccgcgagattcgggtggccctcgccggcgccgccgtcggggcctcgggcggccctgtgcctgtgaatgagtaggtgggccaaattcattttgtgggcccaattcattggtgagatatcgataggccaaattcagttgtgggccgaatttaccgacgagtgttaagtgggccaaattctggggtgggttgaatacgtcgacgagatagcatggcccaaattgatctgtggtctcaaattgttgaggggatttacttgggctgaattcctttgtggcctaaaaccgtttgatgggaatggaatatgatcacttgactccctcaactgaccaccgaatctaaatcgtatccctcaaccgcaataccagaaatcttgacccccgaacttacaaaaccggtgcaatttgactccctcggtggttttggagagtggtttcgctgacgtggcgcacacgtggcagtgttgacctagtctttgtaccacgtggcattgccgtggcgctgatgtggaattaaaataaaaaaaatatgcgggcccatttgtcattcacaaaaaaaaaattatgggacccacttgtcccacatgtcatcctcccttatcccttcttcctcctccctctcctcccttctctatctctccctctttcgcttcatgcgagagcggcgtccggatcggcagcggcgacggcgggcgatggacggagcggcgacggcggaccgagcggcgacggcgtatagtggggatcaaaccaccccacaaactttggcgagattcggaacacggcggaggagttcgccgtcgccgagatgccgcagccgccgccgtcggtgcgcacgaggagcgtcacctccgtcgcgctcccgacgcatggagatggcggcggctgccgcctcgtgccgctctccccattcgacgcgtactgggtcgcgctgctgcccgtccaccacgtcttcctcttcccgtccccgccgccgccgccaccaccaccgttcgaagacgtcgtccgcgcgctcagggactccctcgacgcctgaagctactccctcgtcggtgtgctggtctactcgccggaggaggaggaggaggaggaggggtcgctgtccatcgtcattgtggccaccgggatgcggcactcctccctcctcggtgtgtcccaccccttcagctcctcctccatcgccgccgcctcctcgccgtgctccatctccacctccattaaacttctctcccccggcctctcgacgcctgaagctattgccgctgccgcttcaactcgccgtgaaccctcgctggatttggaagaggaggagatggccaaggacggggaggggggaagaagggataagggaggatgacatgtgggaccagtgggtcccacatttttttttgtgaataacaaatgggcccgcatatttttttttattttaattccacatcagcgccacgtcaatgccacgtggtacaaagactaggtcaacactgccacgtgtgcaccacgtcagtgaaaccaccctccaaaaccaccgagggagtcaaattgcaccagttttgtaagttcgggggtcaagatttctggtattacgcttgagggatacgatttagattcggtggtcagttgagggagtcaaagtgatcttattccgatgggaattacgtaggccgaatagagaagtgggccggattggttgatgggaattatgtgggccaaatgttctaacgagaattcagtaggacaaattcagtggtgggccgagtcattggatagagggtcaaattaagtaagtgggcctaattccatgatagaatttagtgggctgtattcactcgtgggcagaatatgtcgacgaaaattacctgggcctatttcattgtcatgaaataattgggctgaatttgtctgtggtagggccgaatgagtttacgagaaatcagtaggcaaacctaagtagtgggtcgactttgtggaataagttcacttcatgaccctcaactgtgattgaaatctaatccataaccctaaaccacaaaaccagatatctcgacccccaaactcctaaaaccggtgtaattcgactccctgcgcggttttgggaggcggttttgctgacgtggcgccacgtagcgcctacgtggcaatattgaccgaatcttcgatccacgtggcgttgacgtggcacttacatggcattacaattgtgggacccgtttgtcattcacacacataaaaaaaattgtgggtcccactgacatgtggaccccacatgtcatcctccttccttcttcctcctccctctctcccttctctctctccccccttcttcccctacgtctcccacaggcggcgatgggcgatggtgccgggcgacggggaggccaaacggcggcggccacccggctagagcagcggcggcgctagaggcaggtcgagcggaggcgacggcgtcgggcgacggggcggcgcaaacgacggaggcctccaggcgccgtgcaacagcctcgacctcgacgccaacctgctccgcggcgacatccagattgagccggcctctagcgccctcgcgcgccccaggccgtccgcgccaccctccgaggccgacacgccgcgcgcctcatgggcggaggctgctcggctcaagcggaggcgacggcgccgggcgacggggcagcccaaacggcagcggccgcccggctcgagcggcggtggcgctagaggaggatcgagcggtggcgacagcgatgggcgccagggaggcccgagcggaggcggcggcgacgacggcgggcgggccttcctccgtgccgtcctctccttgttagctgccggcgcccgaagctccgccttcaccgccccccggccgcccgctctcgctgtccccgcgtgccaccggccgaaggggaagaaggggagagaaagagagaagggagagagggaggaaggaggagtacggcggcggcggctgctgcacggttcgccgctcctgccctcgcccgtcctgtcgtcgtcgctccggccctcacttgcgcgccgccgccgctcgttctcgtcgcccgccgcccactgaaggggaagaagggaagagaaagagagagaagggagagagggaggaggaagaagggctgacatgtggaccccacatgtcagtgggcccacatttcttttttgtgtgaatgactaatgggccccacgcatatttttatttctaccgccacgtaggtgccacgtcaacgccacgtggaacaaagactcggtcaatattgccacgtaggtgcgacgtggcgccacgtcagcaaaaccgcctcccaaaaccgcccagagagtcaaattgcaccggttttaggagtttgggggtcgagatatctggttttgtggtttagagtcatgtgcaccggttttaggagtttgggggtcgagatatctggttttgtggtttagagtcatggattagatttcgatcacagttgagggtcacaaagtgaacttattcccgaatttgttgaagggaaataggacaaactgagggacctgaattgaacatattccgggataaactcattggtgaaacattggtgggcctaaatcactcgtaggccgaattcatttgtacgccgatgtcgttgacaggaattaggcggacctaattgattcctggccttcgtggtctcaattggtttatggtaaaagatgggttgaattcgttgacatgaattgattgggttgaattcgttcgtggtcgttggtggcccgaatttgttgacatgaactaatcgggttgaattcgttcgagggcctctgttccagctacaatactcctattttgagctttttttatcatcatcagtaagctcatgataaggcatggagtaatccggtggctgctgaaacacattgaaatcctgttaattgccagcaatctgaatgttggatccaacaccggttacacatacgagcattgcacctggcctcaagccctcaactctcattccttcctaacctatctgctggagccataaatatcaaatagttcttcatctggagatcttgaaactgaattatcaaattgtttagatgggagaaataaatcttcatggatgtaacactttcaacagaacagagaccacttgctttgtattgcgtatggtaatgacagtaggattcagatatatctgggtctgtcctgaacaacataggggggaaacaagatcaatgaggcaaaatttcaacatttgctttgtatagtaaatgaacgaaaaaattacactactgggtttacagatgtcctcaaccaaaccaacaaattcaaacttatgaagtctaggcaagaccattgggcttcatttttcaaagatgtcatatgacagggaagtccctaacagttgccgctgagtgcctgtaaggctaacatttgcctttactttgtaatcctggcagataacatggtcatcactttccaatttccattgcgtcatgcataaggagaaactactgcataaataatctccacactttttttgtcttgaaacctagcaccctgcatcatgacaaaaaatggcaagggatcatcagaaacaattcaatataatcgctgagcactttcaataaacttttccattttgaactgattaatacccttaattcatgcttctctcaaaatcagaaacatttgcacatttctcactcgcagaaaaacattaatcaaataaggatccatttttcctcctcaaagtcataatattagcactgacatcaacaggaaaaggaaacaaagattgcacacttttgcatgctcgcaagcatcgttatagggggatatgtacacacatggcacttatgacccaaaatgaagaagaagaatgtgagcacaaaccattactattttgtttggaatacctgcccgtacatgcaaactgtaatgtaaagggtaaaaatcaatatctgctcaatagatcgattcagcctgatcaaatataaacaaacctattgattatattttagagtataaagattataaacagcttttacacagggagagggactatgggatagcatattttcttttcatctagttagctcactgaatcgtgggttgcacaaactggaaactccacatgaagtagttaacatagccattctaccaaatgagctctgctcgttttcagaagctgcattgtcattatgaagagggggtctgcttctacccttgagttggctatatatcatatatatgatacatgaacaaggaaagcagtaaagatttagcaggcgttaaagcaccatttttttttatcactgaaaagtaaggcaccttacagtactagatctaagaaagagccaaaacccaaagaactttacaagtgctcctctagaactggtccatgactttgggtcagccaattagggtattttacttttgtgtgtgtgcatgggagggtgctgggtgatatctagctccatttgtggggtttattgagtagctctaattgttagtatggcgtgcggtagtcaagcgacaaccacagacaatgtggagggctgccacactatcatgggcataacagatgaggggattcaatctcccaagcttctgcaacaaaactcaaatgcaaattcttcccatggcttctagttgaaaacaagattctaacagtggataacttggtgattcgaagatggtattatcaacaaaattgtgtccttttcagtacacaccaagaaaccgtagtacacatatattgcaaattgcaatgtccctcagtccctccacgatggaagtctagttcttagccctgatttgggcattttgagatcatccatcaagtggacccgatccacttaacaaatagcaagtgacccaactaatgaccatagacatgcagagggaacttaaggggatcatcatctacatcatgtggaacatgtggaaggaactcaacagacagatcttccaacacatatcagccactgcccaggacattgccagcatacaagaggaatggaaggcatcgagcaacagcatatgctgtgctccatcagaaggacaaacgaacttgttctctgtatttctgctgttttgtacctcacccctcttacgagttagctcaaggagggcctcttggcagtggagttgtaccctgcatcactgtatttttcctcacctcaataattgattggcagaggtcctgcctttctgttccatcagaaaaggaggagcacataaaaatatacgtacaataaaagatctgaaatttgttcggtgccacttctagagaaaaaaaaattgtgtcttctgatttgagttgctaatactaaattgtaaatagaaaaaaaaattgttcaattctcttttcaactgtgttcccctaacacgaaattctggatcttccatcagcagatggtatctgcacaatcaaactgccgattacgaaaaggaagctgagaatggtgcgagaatatagggactacaatattcctgattgtgctagttaagaaatctctcaaggaaaaacagaggcttgtgacaatcatagatcacctgcagtttatgatattaatggcaacaataagacaaactaaattagtatgagtgattcctagatattggggctggtcagatccagcatctaatgcttaaaagtaggaatcatcagcctagtttccaaatatcctatttaaccttcagcctcaaattaaccagcattttttgctcttctaccatatccagtgtcatcgtatccagccatgagaatgccatcaaaagcacagatcttggtcaggtctgtacccagatcaaaagcacagagcttgtggacaacatccagatgaatggttgacgtttagttagagattcccttttccagtcgggccatcatcattttcgcagcttacgggggcacggtgacagcaggacagatgcactcaacctttttgttctagttcactcaaagaacttgggcacaatatccggtttagccatattgtcatgattgcagtggattatagggtacgaggatcccaggaagcacactcaatttgaatcagtcaatgaatcagaattttagaagtgtttgtaaaatggtcataactcacaacttccttcagaatcacaatcctatgcatattatatgaaggattgaatgtaaaatcaatttgtcttaatttaaataaaattgattagttcaactaattttcttttttaaaaatcttgttttgttgcttggagttataacatgttatactgatcatattggctgcaaaagatgagtaagatttgcaatgttaaattgaaataattggaggaaagttgaattcagtactgtaggcttgtgtaaaaatgccttttgaaaattaaattttgaacatggagagttatacaaagatatttgaaaattaattaatgttccgcagactaggcagtaggcacccatattaaaaattgtctgattcatgtgtatgatactatgatggatatgaaatgtatgatgcatttggtatgtttattgtaaatgagttttgaactaagttcagagatcagactgaaactagctcaaattagtttaattaagatgaattcaaattagtttgatatctcaaacacagggtttgaataaagggagatatgtaacattcttttgcaaatcccatgctgcatagaattaaggcaggacaaggttcaccaactactggatcagccattgccactttctcctctgacttgcacatcatcctttcaggtaatctccatctaaaccctgaccctccagatcagattatcgtgcttgttacttacttgaaggtaacatttcccagttacagactacaaatgctattcaactacttgaatgcaatgagcgatcgtgttaagaagttgaatgccactgaaacaaccatgatgttccagttcctttactcttcatccaaccaaatgggtgtaattaacaccaacaactaacccattcagtggtaggaaactaggaattatgaagtttggtcggtctgtagtctgcaattctacctcacaaccgttgttgttagagtactaactatgttttctgcctttccaccgccgaatcaaaaatttagacaattgaagtgaacgcgagatcaattccgtgaagtagagaagttgtaattacctttttacctatttaccggccaatgcagctgaatcccttgcacactgcgagccaggcagcgaagaggacgaagaggagcacgagatccgcgaggacgatgagccacagcttccgcctccacgtccacccggcgccgccgctgcgggcgcggcgctccctcttgggcgtcctccgcgcgagctcaccttccctccgctccgcctcctcggcctcggcctccgctgcggccacctccccggcctcccgcgcgagcgcctcctcgtcggggaacggcaggcgcagcgccagccgcggcatctcgtcccgcatccggttcccgggtaggcatcggagccgccggaggaagagcagcaggtgcgacgagggcagctgcggggcccgcgagaccgccgcgagcacgagcggcggcgcgaggagcaccgcgtgcgcccgccccgacgccgtgtgggtgacgtgccggtggtgcgcgggcgccccggcgacgagcgcggccgcgaccgccggggcgtcgtcctcggcggcgccgccgtcgtggggcgggggggcgtgggcgaggtcggcgacgagggcgctgtcccggtaggcgcaggcgtagagcagcgggtgcgaggccgggagcatccgaggcagcgtcgtggtggtcgtcgtcgtcggcggcggcggcggcggcgagagagcgagagattcacgaggatttcgggggggaagagaagaggaggtggcggtggctggcggtgtcgttggtacagcaacggaatggagacgaagggagccagactggacacactggactagttctctattactagttcacatttgagtttttaggaaaaaaagaaagataatgaaatgtgtatatttttttaaaaaaattgatttcctttaacttttttcactcttttttttattttcttattttttaagtttactaaaaagcaaatgatctaatgcggatttacggaataaaactaatagtgattatctgataaattagcagacggaaaaataactatggtgttccattaattattcgtacctgatcggctataacccctagaaacaaaagttttcattgggcgaattttaaacgcttatgtgacagagattataaacaagtactagcatacacatctcaattaaagaaaaataacgttcctgaatttagtagtttagctttggtggcatggcatgaactgttggttatgtaggagtattaggttgtagtttgttgagttgaccttactcactcactttgtgatccatcaacttgaaaatttgaaacccttttggtgttttaatgtggtacatgatcgagatttgacatttttcataatcttctgctaatgtttgtttttcttttggctagggaccgtttcagctgcaagcttgcaacacatatccatactaaataattatgtcggcctaatagattactagatccacgaaggaaaaaatagaaattaattcaaattcataacgggcatccatgtgggagcagttggcgtttggatctcaacgctctcccttccactagtactagtccttgacagcgtgtttagattgacctgctcaaattatttactatatttatttatttaattttattattcactataacactatcagatgtaacagatgtagtacagagctgggatggttgactggttaagatagattactaattttgaacaattaagacgaaactattagcatttgttccaataattaatcaaaaaagatttacaaaaaatacactgctatacaatactattacaagcactatataccatttcaattctcatttataaaccactaatagagtgtagtttaaactcacaattatacgagtatattatggataaatatacatgggcgcggattaaacgctagaaggattcgcggcggtggagcacaatcagtggcagatggggcacagcatgaggccgttctcgttgcacttggcgcaccgctcgacgtcggcggcggcggcggtggcgccggcggcgaccaccttgcagctgccgccgcactcccagcacgggacgaaccgcgcgccgccgcagccctcgcagccgcggccgtccttggcggcgcaggcctcgccgcgcgccctggcccagcgcatcatctcgcgcagcttgccgctctcggcgagctcggcgcacgcgtcggcgccgccgaggtagcggcccatgacgaagaggcgcggcggcgcgtcgccggcgccggctagcccgcggagctcgcgcaggtactcgccgtggagcgacacgtcgcgctcgtccacgacgacgggggatccgcccgccgccgacacggcctcggcgcacgcctccaccgccttccgcgcgcgctcgcagtcctcgaacgtgcgccgcacgccgcggagcgtcgtggtgtacagcaccaccccgccgccggatgcccccgggggccgccgctcggggtacccctcgaacgggtccctccgccgccacctcgccgccgcggcggcggcaccgccgtcgttccccttgttctcgcggtcgcgcatcaggaaagggttgtccttaacgacgcgccgcccggtgagctccggcggcggaggcctcctgtcaacctcctcgttagcgccacgcgcggacggcgccgccgccgccttcttggcagctgcctcgatcgccttcaccggctcaggcagcaccgtcgtcgtcgtcgtcggtggctgcggcggcggcgcaggctgcttcttcttcttcttcttggtcttcttcttggcgttctccgtcgtcgtggtgttggagctgagcgcaggcttgatgtcctccagggccttgctgacctccgaccacgacgccggcgcgaggtcgtagccgtcgagcttgtcgagcagcgggagcggcatcacggtggtggtcggcttcttgccttcctcctcctcctcctcctcctcctcttcttcatcctcctcctcctcctcctcgtcgttcttcttgccggtggcgatgagccagggctcctcgatggcgctgatgtcgaacagcgagacgctcgtcggcggcgggcggtagacgtcggccaccgtgacgtccttggagcccgcgcaccccatggctaagctcagctcagctcagcttggagctaagtgagagctagtgatggcgtctcactctcactctctctctctctctctctctctcttgtgttcaagttgtggagggaaaggcaaattaaggatggtttttgagtggctgagtagcgataagatgatcaagtgagagctgcacggctcatgccgggttaacgtcaatgctctccttggcgagttttgcttctgcacctctgcgccactggaattagatttcatttcatatttgaattcctctcgttctcgaaaaatcagtggtagtggttaagccaaaaaaaaaaaaagagcgtgcatttgaccaaacaggatatcaatcttagccacagtggcaggactaaattgcatctaatcagccaaatcacggtgaaaaccgaagaatcgtacaccctgcattccaaagaaaatctaatcctgactattctatatttctatatattgagatcatctattgtaaatatttacagtgactttaggctcactaacatgtgagcacgtaacaaagagggtccatatgtcaataactgaaagtcatgtgatttaagttaaaggatcacaatccgtacatgtatatgtttagaatcattgctagaattggattttccttttaggatgaaagaagtatggactaagctagagcctatagtggcacaaacaaccaaacacccaatgtattttttggaagggcttacaagatatgatgttgtcttgtactgttattgtttcgcttacaatgattacaagttgtttgtaacgacttatcaataatcaaagaataatttgtaaataaaacttatatatacatgtgtgtttagcaatctaaacacaaatgtcggaaaaaataaactacgttgaaattgtttgtaacaaactatcgataattaaagaataatttgtaaataaaacttgtatatatgtgtgagtgtttagcaatctaaacacaaacgttggaaaataaactatgttgaaaaatcccaaaatttttagaatttaaattttggctacaacttacataagctaaaagctcaaaaggtaaacgatgggataattggctataatactacgtacttgtggaacatctcaaatactccctccgcattttaatgtatgacgccgttgactttttgaccaacgtttgactttttgtcttattcaaaaaatttatgtaattataatttattttattgagacttgatttatatcaaatgttctttaagcattgacataagtatttttatatttgtataaaatttttaaataagacgagtggtcaaacgtttattaaaaagtcaacggtgtcatacattaaaatacggagagagtagttcatagtccttttctctctctcaaaaaaaaaggttcatagtcattggataaaggtgtctctggtaaccatctgaaccataaagcaaaatcatattccaaagccggaactagatacgttgattaactcaatactccatccttctctatatataagaaattttgattggatatgacacattctaatacaataaatctggacatgaagcctatctagattcattatactaggatgtgtcacatccaataaaatttattatatttagagacggatggagtagttagttagagtgcaaacaactggttattactgcataactaaggataagaacagggagatcacagatcagagacctttacatcctgaatgcccgaaagataacaggggcaagaaacgtgattcacagctagttgcagactcacgatatcgaagtatcgtcacagtgcatctcagctgtgaaactgcagaagtaaaaaaaaaaaaagcagcattaaattcacggaaaacccatgaactgatgcagtacaggttgtttgacagcgaagtagaaacctgaggctgaaagttaacaggatagtcccaactcccaactggtaaaactatgttgctagttcgtccttcctttcctgagaattatcagggtttacaaaactacggttatcacgtgcaataacattttcagtttttaaaaccataatatacctcacagtaaccttacagtttacatgataaccacacggttaccgtcaaaccttagagtggcgataacggtttagtaaacctttaccactactcgtattttaccaacacaagctgctgcattcagaatttcagacgtcactgtgcaggtgggcccaccttactaatgacgtttcttggcatgtcatgagagtatgagaccccatgtagtcaactggaaacagttgggcgtaaactgtaactagccaacgtagtttcatctttggctgcattgtgcatgtcattttcgtgcagttctttgccacaagctctttctgcaacaatgcttgacaattctgtagtatgcatagctggaagctggatcaccagaataaatggggttgcttgaggccaatgtacatgtagtgtgtacagaagagtacagatattattgtccaaaatctgcaaacatcagcctaaatattttttgaggtgctgtttctactgccttgaaggccatccaaacatggcatggtttgattgttgatttacttttaaagaaatgagagtatatatacgtaaaacagacagatgaagttttatggaaaagatacttagactgtgttcgcatgagctcgatgggaacttattccctccgcacggaaaacagaacggtccattagcccatgattaaatggagtagctaattttttaaaaaaaatagattaatttgattttttaaaacaactttcgtatagaaactttttttaaaaaaacacaccgtttagtagtttaaaaggcgtgcgcgcggaacacgagggaaa

SEQ ID NO: 66109 - DNA, 16877 bp, Oryza sativa
atttcaactattaaatttgagtcatatcttagtataattcaataaacagagaaacaacgagactatagtgaaaacatacaaatcatcaaccttcaccaagaccactttaggaaatcagaaatacaatactacacataaacagaggatgaagatccattagtgccaaggtgggccttgatttcagtttataagatgtattctcaatctcagaccaaaacatacataataaaaaatcgccaaaacactctcacaaagttatatcatatacattaacgaccattgtactgaacaatttcaggattgttaataacaagaagaagcaaggttatacttatcaccaggaagtagaacacttgcgatttgccattagaaaaagaagttgacaacatagaaaatatctgtgaattttaatctagctatgagaattcctacaaggcagtttgaacaccacatgagtagctatccatgttaaccaaaaatggacaggtagaagaacacctcaatacctccaagtgtgctagtttattcctcatagtgcataaggacctcccggctgactgaaaatctaacttaggcctcaagtgtgctcatgtacaacaggcaaagtccatattaatgccttctatcctaccaatatgcatggaagctatatgtatataacaaattatgcaccaacactacaaacaattcatctatcaaatgtgatacgagaaaaccgatgccaattatatctgcaaaaaaagaaagtgagtagggcaaaatcatgtgcacaagacatacttttaaagtcgtgacgttcattggggtccatgttttagtttgcaaattccaatagctctgcatccatgaaactgctgcaaataagagcatggtcgcttaatttttcaactttgccagaaaatgaaaaaaaatcatggtaaatgactactaagcaaagaattgtgatctctaatgcattacacgagaataatatttgacaataacactattgattgtagggagtactaactttttgaattcactcctagcaataatatttgacatcaggagtattaacttattactcccaatatcaaatactgttgattggaggaagtagtctttttaccaagctctctaccaaatagctttagccttagtggcactaaaataggagaatcattcattgataaaaacactaaaaaacggttgcagtttaggttaactacaacaaccatttacctgctcctcacaagcaattcagagtgttccactcacaacattttagagatagcaacaatagcattagagatggtactgctttaagtggataatcatttagagatgatactgcttttagatataggaacaatagaattgagcatatagtgaaattttcggagtgcaataagaatctaaagaagcaaattgctaatgttaagtggtcaacattgagacattcaaggtaatttatcagatggatggcatgtactgctgcaacaatgatcacacaacgagcaaacaaaacctgtcaaaaaaattcgtgtcaactaaatttcatatgcagatccaaatttgaaacctttttgtagtaaaaaagttggttttaacaaccccctccctccctccctccctcccattttagttatgttgcattgttgcatattacatgatatgacctttaaatttccttgagggctttgacacttgtaggtcggtttttttctagggatgaaaatggccacggaaattccctgccgactgagtgtcgtttcatatcattggtacctttttgaccgttgtcctttttagctacatataaacaatagtttaattgataaatatggcctgttaccaactgaccgagggccatttccgtagagacagtaccgattccggctgttttgatcccttgttttttctacccggttttgacaccctattgttggtgtaataatctttgtaaccactctcctaaaatattaatgaaatttagttggccttgtccttcatctaacccagctaatattaattttttttctacattgtggatgatagctctgtccatgtcccatggaggaaagccgaccacctgaagcaggtgcagttgagctcctatttctcagtcaccacaggtgggagatgtttagtgaacttgtgattttctttatgtcggcagaagcagaaacagacaactaaatgatcatccatggcggttttaacgtctccatcaagagattctagtgggctagcagatgtctactggtaatatggtacaagcatttatgccaaaaaaaggatgataatataagcatatggaatatgtgataagataatgcctgaaacatgttctgtgatacctgcacaagattggccctgtgatcaaccatattagacctcgactctaaaactttgatcagcagaatccgaacaaaccgatatctctgatgccttgtcaaggccattcgacttgtatggagcgacatgatttgaggctttgagtggaggggtagatcaattcattatgtattcattagtacctgcaaatttatggtattagcactcagctatagctacaattggaaaagtccattatagtaactttctatatttacatgtggagtgtattagcacatcagaaaggtttatgaaatgcttaactgtatccaaaacctcagcttgagtaaacttctaaaataccctttcaaaaaaccagaaagcctctctaactgctattgctgatcctacagttttttgtttttcttcagttccttgggatgccatctatcctttcatgatctcattccaaacatgtgaatccatgcacccctgcctaaatttttcatcagtgagtaatgaaaacaacgctaaatataacaaataggacattccaagatagatgagttatagcctaattaggtttcaaaaacattcttaaaataagtaggcaaaagttctcgcatgccaacagatatttttgcccaactaccactgaaatgatccgactttttttttagaacttgaaatgacagacttggtagcatatgtccatctgatctcctctataaactaaacaatacatggcgggagaagagtagaaaaggaaggctaactaatctaaatatgtggttttcctttactgcttgagaacagtcattagtatctctcacattatggaggaattaaaaaaatgtgttgaggcctaacagtgaatgatcctagataataatcagacaactccacaaaaggagagacgttatgtgttttattagtactatattgcaaaattcgtaacccgttcaaaaatatttaacataacccaatgagagaatggacaattagaaaaactaagaacaggatgtggctaacaacatgacatcggttggtaaaaaggtcaagctttttaataggagtgggacggaaggaatggattatatttggctgcgaaatcaatcatgttgatacactgaaaatctagaatagattagaggaagaagatgctgacagggaggagctgcaagaaaaaattaccatgaaactgatccttgccgatctggctatccctacgcaggctgaacatgtcatcgacattaaccgcctcgcagtcggcgtggactcgcggcagccgcaactgtcatcgtccattggtcacagggacagcacggcccctccatggcgcccgcagtcccctacggcggtccaagcctgcagtacaggctggtcgccctcgccggcggaggaggctggatgaccctgctgatgatggccagtcaaagcatgtggccccagtggaggttgagccgcagcaggaccgtcctacccccgatgagaaaagcaaacgtgcttaggaataaaattaacagaaggacaaaaaagctttacctgcagctccttgaaggtgatgttcatgtttagccggttttgcagtaagctcactatttcaccagcacgtcgttggggcggttgggctgagacaaaacacaaaaaacatgcacagttcatgtcaagaaagttgcatatttggagcatattctgcgagaaagtaaaaatgggatcacggaggacatggtcggggtccttccaagaagttcctgatggccataatcttgctctccagcccaagctgctcggtgtcaagctcgtcggctagctcctgtgtgccaccggcttccacgtcactctgcaactctactcctctagagaaagccggagccgcctggcgacgtacggtcctcctcttctcgacgcaaccactgccttccttggcgccggctccgtcaccaccgccgtttcttcgatggcagccgcaacggagggtggagcaccgaccgtcggcgacggcggcgaagcacgcagcaggggcggcgggctcgtcagcaacggggcgaggcggtggcggaagtggcggcgctcggcgacgacgacggtggtgacggaggcggagatgctgcccggcgcacgggggatgtcagatccccgtcccccgaccacatgggggccagatccggacgctggtggccagagacggcggtcggcagggacggagggaggcgaaggtggaagtggcggcgcgaggcgacgacgctagtggaggcggagatgggtgcgctcgccgacggcgacgatgcgatggggaggctgaggcgctgggagacgacggggcgacagcggcggcgacgacgcaatggggaggctgaggcgctgggagacgacgaagcgacggcggcggcgatgaggtggacgcggcggcgcgaggggaaggcagaggcgtaggcggaggcggaggcggaggtggtcgcgcgggacggaggcggcggcgcgagggggaggcggaggcggaggcaggagagcgagaggatggggacgagtgggaggaggcgagacggaaggcggcggctagggtttgggggtgggtgggctagtggggatcattatgcaaaaaatcccctcgactttaagattgtacagcgcggtcccgattcgcgttttttctctcccacgcacggaatatccggctactacaagggccttcacgtaaaacatcggctcataggaactgtttgctaaggacccatattgaattatatataaatcggagggatttttcgcaaaatttccaccgcgcgcctcaatcccagccgcccacgcctgatcggacggcgggaggaaaaaggggcgacgtggcccgcaccaacatcgccccagcccgcgccccttaataatatgcgattcgccactttccatatataaaccatatagcaaaatcattcatgaggtctatccactgggcattataatttttgtttttcatatttgtatcaatgaactgcacaaacaaatttatattccctccagtataacaataattgtccttttttaatcattttccatggtattattggtcatactttgacaataactttataacaaataagtttgagacgattgtaacaaacttcatacttgttaattatcattccagggtttttgtttggcaaaatttggtaccacacattgaaaatttgtggtttttgcatgtagacatcacaaaaatatagaacggtctgagtacatcctaaaaatatggtaatctgctgaaggacggtctgtcaattattttattatttttagcctatacaagaagagaaatgtttcgaaaagacaagattaccctgccacccgtgaagaccacccggtctggtctgtttcaaccattcgatcgattcccatctcctaacctctctctgggcctcacaccccaagtccccgatcctaggcagtggtaagggcttcaacaattgcgagctgatggtagctcttatctaagagctaactcttcacatacattaaaataaatgcactaaatgtatatgcatgagaaagagagaggagaagaaaataaatacaaagttagagcccatctactatacatactaactctaatatgatcttatagctaatatttggctctactgttaaacttgctctaattgcttgggagggcatgtcatcacctattgcacgcaatggcttgtcgagacccctcatcttttaataatgtgtgcacaatgcatgactagtgacaacataatagtggcccgctgttggtatttattatagtcttaaataaatccgcaagaacatggatactgaagtagcacttcactttagagtattccaagggtatcaaatcacagggaacatgtgtgtataatctaagaacaagattcaaccaaggacaacaactaattgggatgcttaggaaagagcggattcctatgggttaattaagttaagttaaaactctataaattgtttcgaacactggcttactcctgatcttccaaggagactccggcctacagctctatgatgtaccgaacgtggagaattacaaaggacagatatggctgttaccacctgccatcaacttctacaacccgtggagcacacaacaaacaaacgtaaactccagccttaacaccatgtctacgctattgattattaccccaatctcgatgtcacacttacataagattaaggtactctaagtacagcgatgaacctggaatgatgagaatatatcttaattacttaaataagaaaagttaattccaaaggagatcacaaatacttatgtaaaagaagcatccaacgaggtacaagatcagagagagagagagagagagagagagagagctgacatcttcggcactcctctagaattccttggaagaatgtcgacatccctagcactccttcggagagaagtccgacatttggggcacgcatgcacgcttttcaaactgctaagcggtgttgcttttgcaaaaattttctatataaaagttgttttaaaaaatcatgttaatctttttttaaaaaaatagctaatacttaattaatcatgcaataatacgtgcttcattttccgtgctagggaggagggattcccaacccctcctcccgaacacaccctttgactgtgttcttcccccatttttcccaactcacctctctcgttttctgcgtgcacgtttcccaaactactaaacggtgtgcattttgaaaaaaaaatctataggaaagttgttttaaaaatcatattaatccatttttcaagtttattttagataatacttaataaattatgcactaatcaccgctctgttttgcatgttgggagtgagggttcccaacgctcactcccgaactcagcctaaatgtgtaagtgagttgcactccacttgttgtgtaattttagagtgtagtgagctccttcttttatagcctccttaagtcggttggaaggtcggtaactgccggtaatcaagcataaccacctttggggcttcaggatcttgctccacgcgtcggcagatggcaaggggaggcaaaggtggttcagcataccttgggttcggccaaccccattggcccacctcccagccaatccttcagctgggaggctgcctggtgggccccctacaagttgtaccttgtatgggctcaattgtaggcgattatgattgacatgtagggcctccaatccgtgtactcacgtctgattgtctagatatgtattttgtcgcatggcgggttattttcgtccataatgcacccacgtacaaatattcaccaagacttgtggaaatggttagtaataagcactacctctaagtttagtattctactttgtattctttcatttgcatttgtgcatgaattgatggttggaattggtacttaaggaccgtcaacaacaccatcacattgagcatttacttgtccctgagtaaagattattgattacatcagagcaatgaatccctttgtaatgatactggtataataattatttcaagtcatacctatacttgtgaatcttaaattgtctaccgtgtcatcttgggtgattgacgaatggaacgaccatgattcaagttacctccacttctcctgatgagtgccatgggttttttcctttttctcataaaaacataactttaatcctcaattgattctcttgaatcactcaatgtgtatgattattcaccgagtcatagtgttgacggtcattaagtgcaaacttttaccatcaactcctgcataaaagaaataaaatataatttcaaaacttagtggaaggggtttataactaaccatttccactagctttggtaaatatatgtatgcaggtgattttcggtagaaaacacacccaccaagtgatagaaggaacctccggacaatcagacatgattacatggattggaagcctcacatgtcaatcaaaactacctacaattgagcctaaccaaggtataacatgtagggggggggggcaccaggcaacctcccagccgaaggagaggccgagaggtgggccaaaaggttggccgaactataaggtcgcccgaacggaccttggctcctctcaccatctgcttccacgtgtatgctcttgatgactccccaatggcggttatgaaggtttcatcggcagttatcaccgatgtaaagcattgtaattatgagctacaaaaggaaaaggtcttcgcactctcaaattgcacaacaaagtagagtacaactcactttcatatcatggtagctactttagtatgtgggattaggaagagagtgagagaaagctccggaaggtgtgtcccaaatatcggagttttctccgagaattcttccatcagagtgccggagaagcgcatgagttgctggctttcttctctcgcttgtacctcggtggatgcttcttttaaaaagtaagtattcaagtttccttatggtatttaattagtttatttaagtgagatatattctcatcggtgcgggatcgtcgcttagtatttatacttaatgctctagtactaagactctggataaacaagatagttcttggcgaggctagagtagtaatcgataacgtaggtgtggtgtctaggttagaggttaccttcgtttgttgtgtgctacacggaaagtagggtagacgacaggtggtgataaccctgcccgtcctttgtatcccttcatattcgggtacattataaagctcaaggctggactcaacctggcagactaagggagggctggttcctgatgcattcgataaagttttgcctttaatttaagttagctaaatacgtccataggaatcctctctagcctatcactcatcatgttgtcctttgatagaattctgttcgtaaaagtatatgcacgttccttatatttataccctggaatactctgtttggtttgggctttcttccaaaagccggggtaatatatgatcttttatcgaaaaaaaatgatggagatcacttggcttttttggatgtttatcacttggctcaagcacttccccaaaactatgtcaaaatagtggtgtctgatcacatgttagttgaagtaaactacaatccgttgctagagccaaaaattggggtcaatcgtgatgatgaggaaaagggttaaataatggctgtcaccatggtttttaagaaccagcagatatgtatacacactcaatctgcgcagttttgatagggtaatggggtgaggatagctatattctcagcctctctcagagcatctccaataatgctccaaagttgaagatgatagctaggaatttccgatatttcaaaatagcagatgccgttgtttcctttaccacatgtttgaataaagaaataaaaaaagctcaagaagtatggatatctttcccacgaaaggatatatatatatggaccaaaccatcaagcagtacatatgcaggcacacatatttggggacattcataggcgtattaatggtcttgacacttcagcgtgtgaagatagggccgtggggtggaactggaggccatgcttgggatgaaggaggccatggtgccagtgctggcagttacaccggagtacgccgaatgagtatagggtcttcctggtgtgtcagctcgatgttgtttgaatacgacgacaatggcaaacgtgtgaaaggtaccctgcatggagagagagacaatggaatacccgaggtatgtagcaagcaatacttgatagatttgtgatcttaggatttaggaagtgattttccaagtgaaaacaatttctccactccttataggatctactctatcttattagaaacttatatttattactgccatgtctacccaaaatctaaatatttttgttgaaaattgattaggcgccaccaacatctgacgtcatcctattcgtcgccctctctgggtggcttttagttaaccggtacctataaattataggtacaagtttttctaaaaaaaaccgacacatatagtatttgtgttgattttcctctacaaccagcatatatagttacccaaaggtgacgtttctgtaacttttttcatcctgtggaggtagggaaaggttcatatgtgccggttttaaatgaacggacacctatgagggttttgcagtaatgatgcgctaagggttcagtactgtagctgtagagaaagaaactattaacttaattaccttcagtggaaaggtgggtaaattttacaattaatataccatttaaagaaatgcccacgcaaatgaatggttggattttactcacaccagtgccccttgtcacttgtaccgtgtatcgtaaaacaactcctggtaacgacgatgggcacagatcatgaccaatttattaaagcccaaggcctctgcttcttgcttctgacaatctcataaaggttttcatgagcggtgaaccggtgactagttcatttaatcatgatctaatagaactcatcaactagttgtattatagaatcagtagggactcttctttaatcgtggagttgtattaatttttccactgttttagttatgtaaaaacacagacaaatactcagtcgtcgattgaacggtttaatttgggagaaaattaaaacaaacagcttgcagagagatgctttgtactaattaatcactgactgacaaataacctgatgcatggacgcacacaggaggagctcgacttccatggggaggtgttgacgcacatgtgcggctaccatgacaaccacctcatccggtggttgcagttcaggagcaaccggaacaggacgttcggaccatacggcaatcttctagaagaccaggctggatggacgcggttcgaggtctccatggagcactcggggtccatcgtcggcttctgcggccggagtgacgacttcgtggacgccatcggcgtctacgtcgccgtctggaatcccgagaggttctatgatagcatgcgcaggcagggcgtccgcgtttaccgggcgtcgcctctgcgcatggacctgcgtcaaatagaagaagagaaaaagaaggaagaagtggaacgtgggcgcctacagaaggagctcgaggaggggcgagaaagtcttcggaacatacgattgaagcttgatatgccgccggatcagagaaaacgcctgatacgacgcgacctgcgagtggagcatcaagaaatcgaacgtcagttacaagagatgcagcaactggaacgcgagcgtcagcaactggagcaacaagaaatcgaacgtcagttaccctcgcgtcagcaactggagcaacaagaaatcaaacgtcagttacaagacaggaacgcgagcgtcagctacaccggtggagaaactttgtaaccggtggagaaactttgtaaccccctttagtcccggtttccaaaccgggactaccaatccgggactaaagatcgctatctttagtcccgggtgaaataaccgggggtaaagatcgatctttagtcccggttggtgttaccaaccgggactaaagatcgagctgacccatttttttttttacatggccctgttgctgcatggtttatatatatatatatatatatatatatatatatatatatatatatgcatatatatgtatcaatacatatatatgcatacatatatatatgcatatatatatattatattatattatatgtatatacatgcataatatatatgtatttatacatatatatgttatgcaaatgcatatatatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatacgaataaactatatgaatgtatgaaattgattagtaattaaacaagaaatcgctacgtaatgaaattttgaatttatttatacgtacattgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcaggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacaccgcttgtcgcccagggaggatgatgtaccgcctgcgccatagaataatggcatggcatgtgtctcgtagatgcgtctcaccgtcttctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattattttttagtaatcaacatatataagcagcaactagcggaatggctaaatcttacctttattgataagttcttcaaaggaatatgcagctcacatggtgtccgctgagtgatgtcatcaacgggacaggtcgattcatcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcatagctcgatacccggaactctagctctgcaatcttcgcctcggtatctctcttgctcctcatccgactcctgtacgtgtggatgtcctccttgaaaccaatcttccaaggaatcacccctttcccccgtgttcatcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaaccgtgctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccctactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactagtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccatacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttgtattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaacttaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattatgtcacttgcctactccaattccttctagggctagctcttccactcaggcttgacggacgactccgacaacacgtcttttctgcaagatacaaaaagatgtattaggataaatgcgaagtaacatatatatatatatatatatatat

SEQ ID NO: 66110 - DNA, 22070 bp, Oryza sativa
atagcattttatccttccagcatattcttgtgcaatctcatcaacaattcggtggaccattctgcagggtccacaccatgaggcccaaaactcaataagcacaggtatatcactgcagatcacatattcattccaagaacatgccgtaattgttttggctgtacaaacaaacaaaacagagttgtaagataactcctctatatttgaacgtaaaactaaacaacaaatgatgttatatgtcacaacagttgctacactcaagtaactacaaaagatgctaaatataaccctgacactatccgcttgctgagagtaacagttgctatccagcagccctatgctcatgtaacaaagttaggaaaattgaacatcttaaaatgtgttgtagctactagtatttacggaggtgaatatgagccgagttaattggtttgcctcaatggtgcagtttgcaggaacagaagcagcggccaatatcctggaaatgaacaactgaacggtagagctgccgaaaactaagagcagccaaagaaagaataattgaagaattgaagtttagtgatatttcactacagctccaggattttttttcgaacgaaccggcactacagctccaggatcaatcatactttactagtaacgtgtttatttcaagctttcgacatgtatcaaggtttcaacttttctgtggtactgaactggctgacccatttcttgtacggttacactacccgaaaaaatggtatacccctacattgcattctctagcaagtaaaattaagctgcttccttacggcttctcccttgaagagtgcatccatcataccactgttcaactacattagactactacatggaactggaagcaatgaacatgagaattgtcactaatttgtcaaccacacaacacaccaaagggggcaagggcagttactacacgacaccctaaaggcagcagaaatttttggcacaagcaaacggttagcttcagggggagggggggggggtggatcatcatcaaccagcgaggaggcacactccctttacctccgcgaggagaatacgcgcagctcaccgtgcggatccggtgcgccgcccagcggcgccggcagcccggccaccggcgtgcggcggaggaggaggcgccgtacccggccctccgtcggccgggcgccgcgagcgccacgccgcggtagaggctccgcggcggcggcggcgcggggcaagcggtggcggtggcggccatggttgttggtgttggttttgggtggagactcgtgcgtgcgtgcgtggcggaggatgcgcggtaggtaggaaaatttacgaggcaaatccgcacgcgacgcgagcgagcgagcctagcgcttatgatgatgaggacgacgctgacttggaggtgattttggagtgtgatgcaattcactcaaaccttattatttcctccgtttttattatatttatcaatagttttaactttttttacaaaaaaaatatattaaagttaatcgattttataaaaatatatgatagtgatttgaccacaaagcaaatatgttatccaaatttacattgtttaatgaaactaatttggtctatcttaacaaagtttgactaagataaaagttaaaaagcgatatattgcatccctgtgtacaacaatgttcaactaggccttcacataacaattccattggaccatgtgtacctcatcattctcatccttcaaagaccaaaccggatgggcaaaaactcatctcgccctgcaatcccctgcatgactgaagatctgaaagttggtagggcaagaatgtctgaatctcctacattcttcagggaacaaggttctcgcagcaagcaacgcctccatatccaagaatctcacttacgtttgcacggtagaaatgatgaaaaaccaggagcttttcgcaaaaccttgatttgttcgtctcgagctgcccatgctgctgcgtcccggtgtatcgtaccatcagattcagagagagcacacttggtttcttgtctccctgatcaagactcatgaaatggaatggacacatgacgaacaccagagaacaaaaccgcataggcaacagctacaaagtcagagagaaaacactggaggatgccgtcctggaagatcttcatgttctgcacctgcagaaaatggttgtgctcatataaaacttttgcgacaaaatctgtaaaatggaaaaatgcatgtggtcatcggttcacatacacatctatatttgagtgcagaaagattatttttaaaacccattttttataaaactgagctcttcgtacaaaagtcaaccttcactaaaaaaaccaagtggagtaatttttttatgggataaaaaggcttagcgcccagcttttctgggaagctcaacgggattttttaaaaatatccggcatttgacacttgaaacaagacaataagatgacaccagctttgccacctcatcatcaaactacctatcagcacccaaaaaaaaagaaaactccatcatcaatatgtgactatgtgagcagtgttagatgctacaccaccagatgacaaaaaaaatccattcaaatgttttgtttggtagttcagactctctgaaaaagaaaaaaaactactccacaaaactgatgtttttcctattggattaacaactaactggagatcacccaacgttagaaataaagggctcgtatcctttaccataatgacatttttatcataggcattgacatataaagcaatatgaggatggaacctacatgccactgactgtaatgttagtgcaatatgcgatgtttagttcccaaacaaaaacttttcaccctgtcacatcgaatgtttggacacatacatagaatattaaatatagacaaaaaaaactaattacacagattgcgtgtaaattgcaagacgaatcttttaagtctaattacgccatgatttgacaatgtgatgcttcagtaaacatttagggcaaccacaatgtggggtcttaagcctctaaagtggtccttatacattgtgaaagtagtccatatagtagtctttagtatgaactacccatatgcataatgcctacccataagaataaaataggaattgtcagggttatggataccacatacctaatagtagttgactaaatctcggcagggcccaccacatatcatgtcctatacggaaacaacctgcggatgtaggaggagttccggataaggaaagacaaccggagttctacgtggaaacgataaggactactcggattgtatccatattggtttccctaattctacttggacaaagggactcctatgagtataaatacaaggccccctaggaggagaggggggacagacaatcaatacccaacacaatcgacatagaagccacaacatacaagccaacatactccaagacaagacgccggattttgacttcagggataggcatggctattcccctacggtgtctccggataccgtcaggagagacgaaagcgctatctctgatctcgccggacacggattcgaggagcaaggctaccctgttgtcgactacgagtcagaccttcagaccgccatgtcgacaacagttagataggctaccccacatattgtactggtgtgattatggtgaataaaaagcaacatcggcttagggctacctgaccgctcagggacccaaacctgtataaaaatcttcgtctccatctcttttacctcagtctcacatgacatacaacacatgacatacaattgagtgggacccaggctaatgccttctcttaccatatacattatagcaaacagtataactaatgccgggtcccaccttattacctaagtagacattatacattgagcatgcccttactaataacgatttacaggcgaaatttataatttattttgttattagactatgtttaatatgtgtcccgtatattcgatgttatatgcagaaactttacatccctatgactaaacagggccgcccatgattgtaaagcatcgtaattcgtaaatgaagtgaattggatcgagtgacccaggtgggccccacgcggcagcgacccaggctccagtctctactccacgtcgacggctcgttgacccccaccggctcgtgcgttggcggttttgtcggtttccccctctctctccctctccctctccccctcgccgcgctcgcctcgcgtacgtacgtacgtcacgtcacgtagccgcctgcctcgcctcgccccgcgccgcgtcgccaactcccccacatgccgccgcgccgccgcgctcccgagcaccacccacccgccacgcccgcgcccacgcgccaccagctacgaggcggaggcgtccccagtgtagcaccaccactatggcggcgcggcggaggcacgtggcggcgggggcgggggcggcggcgccggctgcgggggagtgggcggcggtgacagccggtggcggggctgcgtgggcgttgtcgccggtggaggaggtcgggacgaagcaggagctgatgcggcggacggggctgccgccgcgggacctccgcgcgctcgacccggcgctgtcgtcggcggcgtcggcgtcgtcgtgccgcccgtccgccatcacggggcgggaccgcgccgtcgtcgtcaacctggaccgcgcccgtgccgtcatcaccgcgtccgaggtgctcgtcccgtccccgcgcgaccccgccgtcgcgccgctcgtccgggagctccgcgcccgcctcgccctcgccgcctccccaacccccgcgccgtcgccgtcgccgccgcaggtgacacatgcatgccccccaccctaccttccttcttgcattgcatcgtacgtcttcttcttaagcaaaagctctgatctctcactccttttcttttcttttttgaaagcatggcatggcggtggggatggacgggagcatctcgccatcgcaggcgagccgcggcggcgaggaggccgccggcaacggcaaggatggagaagctctgggaggaggtgacaaggctctgccgttcgagttcagggcgctcgaggtgtgcctcgagttcgcctgcaagtctctcgaacatgaggtgtgtgttcttctaccttgtctccatgctttttacctgcagtgctatctccatctccaattctccattcagaattggatggaaatgcaaccaatacctgatctttaagtgcagtgtagctatgcataacatgcattaaaaaaaaagagatttgaagagagatacatccctccaaacatttttcaagaagaaattataagcgtattgaaaattaaacacggaaccttggagttataaccacttactcattgctactgcactatcaattgcatctcaacatgcaatttgcttgggttgaatttaccatgaatagtgagtggctcaccaaactatgcaaaaagttatgcattgttgtatatttgtattaggtttgacattgtaattgtagacatatgttcaattcctatccacattgatttttctaggtatgtcatatgatcttttaacactcaactagacgtccactatcagtatcttgcacatgtatatgtctttccttgctttggtttatatcaccttcagaaggggaaaaaaagaagtggatttgtaccttgctacatttcgacaattctttagcggcatcccttctaatccaaccttttttattatatgaaaatgacttttgttcttctgccctgcaaacatgcttctccgattttcatggttgttgagatgatgctaagtatccatgccgtgccggtaacattcagtcatgtgtctcacccttttttacttcctgatagcactataacaatgtgaagacaaaattcatttctcgagcacattaaaacggtagtgtgtttagcaacttagcattcaggcaattctgcactgaaattgcagttcctaagaaaaatttgcttgatacatgattgcatcagacttgcacattggagaaagaggcatacccagctttagatgaactcacctccaaagtcagcaccctcaatcttgagcgtgtgaggcaaatcaagagccgactcgtcgcaatatctggcaaagttcaaaaggtcagcttcagtatatataccacaagcatatgtgaaactgaaattacttcctccgtttcacaatgtaagactttctagcattgctaatattcattaagatgttaataaatatagacatattaaattcattaacatctatatatatgtgggtaatgctagaaagtcttacattgtgaaacggagggagtaacatttatgtataccatggatcagatagtccattaggagtaattctgaagtgtttaagtaacattgccatgtgtatctcgtctgacaggtcagggatgaactggaacacttgctggatgacgacatggacatggcagcattgcacctaacggagaagctcgcttaccagtcatcaagattcgacatcgataaagaagcaagcgagctcgaagatcacaggtaagaaatttttttcttccataggttgatgacacaagtcgatatgcttcatccaaccgttgtcaacatgctacagatgtgtcgtctgaatgtctgaagctctgaatgcagcagcagggatgaagaaggagtcgagggaggcggcggcggcgacggcgacgacgagacgatcgccggcggcggcagcttcagccccaacaccgacgagctggagatcctgctggagtcctacttcgtgcagatcgatggcaccctcaacagcctctccaccgtgagtagttcctctcgccgatgaacgtcaatcatatctggacgtccacccatttattgtatgtcaactaaattattataatttttttttaaaaaaattaataagataaatcaatatataatatatcattccacgaatatataagctatcaattgtaacaaaagtgacaaataaaactcaaattagcagttaaatttgtttttttttacaacttatagaagtagaatttacttctataatttaaacttatatgtttgtgaagtgatatattatttattaaactatatgttaatttttttataaacatttagtggacatgtaataaacgggtggacgtcccctagagtgattagaatccatctcgatttttttataaccactaaatgacctgcattaaacgggtagacatccgctcgagtcattaaaacagattcccctctctcgccattgctaacgaaggtgaaattaaccatctgaatttatctctctctctctcacggatgaaactgaagctgagggagtacgtggaggacacggaggactacatcaacatgatgctggacgagaagcagaaccagctgctgcagatggggatcctgctgtcgacggggacgctggtgtccagctgcgccatcgccgtcacgggggtcttcggcatcaacgtccacatctccctctacgactcccccgcctcctccgccgccttcccgtgcgccgccgccggcatcgtcgccggcagcctcgcgctctacctcgccgccctcctctgctacaagcgcgccggcatcctccagtgacgttattactagtactacatgtaaaagaaacattgtttttagtattaactgtgaccatgagtgattaagaacgagtaattatgcgtgtgatagtgtgattacggtgttctaggcctctttgtttatatttattattactacctctatcccataatataacccataaaaaatgcatggtcaaacttaacacggtcactaatactaatttttgtcttataatttctcatatattataataaggattatagtaataaaattataaccatatgaaagtaaatttaaatatcaattcaatgatataatttttagcaagtaaaattcaattcatactatacacaaaatattttgaagataaaatctcaaaatgtgaacacctaggatggagggagtagttttttttttaagtttactacttcctccgtcccaaaatataagaactttcggttagatgagacacatcctagtatgacgaatctggacgaacgcatgtccagattcatcgtgctgtactatgatgtgtctcatccaaccaaaacttcttatattttgggataaagggaatatgatttataagccgacgaatttaaaaccatgtggaatgacatctctatatttgactatcttacgctattttttttcaaactactactccctccgtaccaaaagaaaacttaacttatggagtttgaattttgtcccacaaaaaaccaacttctaccatactacctacccttagcaatgctttattacttcgataccatttacctattttaatgatgtggggtattttgatcatcttcactctttactactgttgcattgggatgttagggttggattttacatgggatagagaaagtaacttttagaaagtaatataaaaatgatttatggctttaaataagaaaatgctgtttatctgtttagatgacttttcggttcataataaaccgatttataagtctaagtctatacaaagagtattcagggttggtttggtttatggcttaaataggcattaccaaattttgtcagtgccaaattttgacaagttttggcatgattaattttggtaaggcaaagttgtgtttggattgaagccaaaatatgctaagtttactattgaaatggcctattttcttaggcatgtcaaatttcgggttcaaaccaaatagacactaacactattgaaattgtcaaatattgataagtctaatttagacctcaaaccaaaccaacccttggtgtacaggagcttaatgatgaacactctcactgacaaccctggcccagacgtgtgtgccccaactgtcagtgtgtcaccaacaacccagcatctacggccccacgtgtacattccatttttctcctgagcgcagcgatgacgacgaccaggagctgaggagcagcaaaaaagaaaaaaaaatcgattagttcacgcaaaacccaaaaacgaaaaaaaaaaaatcttcattgagtgttaactacggaaaatatctgacgaattcgtcgcgaaatttcgtcctctttttttcgtcagaaacgaactaagcagcggggatctcgggatagcgaatccccagattcggactcgatctcgctcccctccgatggtccgtctcccggctgccggcggcgacggcgacggcggcggcgacggcggcggcgtcctcaacctgacctaggtacgaacaagtctcgagctctctctctctcttttttcccccttacgcatccagtatagtttgcgtgatctgatcgtggcgcatctgttcttggcgatggatggatggattgggagcagaaggaagaaggtgtgaatctctgctttctcgcgcgatccggcggcggcgggatgcagtaccaccagggcggcagccgcatgccgccgttcgcgcgcggcggcgcgtacagccgcggctacaagcagctttacgcgccgccgcagcagcagccgccgccgcaggacaagcacgaggtgctcatggaggcgggccgcctggcggcggagtacctggtggcgaagggcgtgctgccgccggcctccctgcagcgccgcggcgtcggcggcgggggatgggtccagctcccgcctccgcccccgccacctccgccgccgcagggaaccctggcgttctatggtgcccagaatggccggcggcggttggatgatgatgatgatggtaatcctaacccccgctcgcggcggaaccgcggtggtgagaacaataatgatgacagtagtagtagctacaatggtagagggaagaggaaattcggtgcttacagtaggcattcggattgggggagggacaaggggaggagtagggggaattcggatagccggagttacgatgatgaggatgatgacgggcctcctggttataggagagagcggcgaggtggtgggagatttgatgatgctgggagtagcatgtcgggggtggcagcgtctaagacggaggccatgggggagtcggagctggaggatactgggtcgaaggtgggctctagcagtaatttcaggaaggatgtcgatccgccacaagaagtggagggcgttgataagttgaataagattaatgaggagagtaatccatcaaattcagaggtggtggagcaaatgactaatggtgagagcactagtaataatgcttcttgtattgttattgatgaggaacagacgaaggcaaaatatttgcctgtgccctcagatgacaaggtttcagatgagaagcctgacgatagtagtgttttgaatgagaagattgaagatgacgagactttagctgagaaagctgaagatgataagacttctgatgagagggtaccaggtgtgaagaataacttgcgtgatgattgtaataatttgctgagctattgcagttatccaaatgtaccgacaaggcggcgatcaatagttgcacacaggaatgcagcaccagcccatagggaagttgctgttgccgaacagattgatctggtttcctctgaagatgaaacccatatggccactgatgttacagggcatggcagctccttgactaatacccaggaaggcaacaaagatggccttgcctgcttggaacataccgatacaagcactacttgcaatcagatggtggagccagtaagattccagacagaggaaacacagattggaactgatgatttgagaggacagaaaaacattgagcaacattatgcagttcacgaatctagggaggagaatatgttacctcctaaagtgggtgttcagcagcaagttgaggaaggaatgcagatttacaatgttgatacaccgccacaagatgaagacttgattgcttcagctgataaagagaaagtagctggtgtggcattattacctagtatcaaagctgaagctgttgttgcgaaggaagaggacaagtttggtcagtcaagttcatttaaaatatgtgatctaaacctagttggtagtccagaggttgctgaattacgaaatgatcctggtttgggtcaattctcaactgctggatgttcaatggagccacaaaatcagcaacaagagtttagaaatacgggtaacagtgcagatgataccaacatgcatgcccaaattccattgcacaataaggtggttcaagttattgatcttgaagatgactcgccaattgaagctggtgcatgtgatacttcaaaagcaaagtgagttccttccacctccctcttatttgctatgtcattctgcttttatatgagtataattttttcttttggtattacggtttgatgatacagtacctagccttaaaggcttgtcccagactagttactattaggcaaccagttttgtgtagccagcgatgaatggtagctggcccagacgctcagcaatacaaaaatacaggggtgactgccttcttccagtcgctgcacaaggagaatgagtctaggcctttgctgtcttcttattgttgttgcttttcatgttctgtaggagtggcagctgatcttgctgcctaatcagcagacttgctgtcaatctttgtactcttcgctctgatcttaataaaatttctctgtcatctttatggctagcctgactaaaacagtatttgtacataatgcaccgacaaccatctaatttccacatccaacctatgcattagtttatttctgtttattttctcttcatttatttatccattgtggctgctaactacatacctttaattgtgtatgctagagaggaaaacatggcaaaccctgctgtgaccacagatgttcttcctggtatccaagatggatataattttgcgatttcagattatcttggtgctgatataccatgctaccaaccaatgcaaacagatcttcccaatgggatgagcctaaatgattcagaggtgaggttttctgatattgttatacatcatgtggaggcttaataataggaaaatagattcaccactatccagtaccagtagtgacatttgaggatttgtgaccatatgtttgcttgacatgcgtagacacatatagtcaccataagttcataatactgttttttttccatgagtaagagattccttacactttttttcctcctgttgcagggcattactgtcatggatgattcaatatatggttctcttagcgatatcggtaattgatattacttaaccactttttcagtttttctacaacaatgtgcgttatgtctttgtcgtgttgattttcgatgttgtatttcttcacttgctcgttgcgaaaggatgttgatttcaaaggctatgaaagacatgcctaagctttaattcgtaaacctataaactgacaaatccttgtagcattattcactttagacaattttggtgtgacaaaccgatttgcaaaattcctgatatttatggtgcctatggtaattttcattgggaaaagcatcagtaccagaagtggttcataatcttaatacctattgagcatatgaaaattgcagccaatccatgacagctcatttctctcaacactgacttgcagttcttttaattcttatggttacaggttttatggaggtttgggaccagcaacctcaggactacgagaagttcttctgaccaggcgccaaattgctgttgtcagtgctgtgacagttctgtaaccctgtaactgcaataatcagaaaaacacacacacacaacacacatacaggcacccatggtggccatatgatccaggccaatgtcctgtctaactacacatcatatatagctggagcctttgatccttccaggtcaatatcaacagagcattcatcctaaaaaggattgttcttgtgtaaacagttcgacaagttcatgtaccgtgaatacaatttactctacaactctagatataaatacattgtttcacctcggaaaggaaaataagaatacattgtttgattatctgctccctgttgtgatattgtctgactgctctacgctgaatttatccataaggccataagagatgtgcaatgcaacatgatgttagggcccacggtgcggccgagcaacacaagcaaatgccgctagctgttcatgtccaaatctccactcattttcgtgggagaaataaaatcacattgattgcacaggggaaaagaaattcatttaaaaatagtagcttgaaatcgctatgaaaatgtacacataaagacacccatttggaacacaaaaccttcgcatggtatggacagtaaaaaaaatgagctcccaaagaatggtgctctagctataacttgctactgatttcctgattttgtcggttggatttccaggattccagtttccagcagattcagacagcggcatcttctttgctatcctccacaggcttctctgtagatggggagctcgtctcctgggtgccagagccggttgagaccttcacagtggcaggccttagcagcctctcccttagaaggaacccgcgtttgacttcatgcgagacaatcccagccttgaactgatgagattcctcgcgtgcgatagcctcatgaatcttaacataagaaattagaaggtatgagctcctgctatggcgcatgtaacacagaaataacagcacaatgcctttgtatttacatgtgcaaatattgtaactatgtaagtgcgcgaatcaaactttttatatgagcaaaagatgtactggcatatacccaaacttgtgaatcagccgtttagaccacctgtacataaaaaaggtgatataaaggataaattatactacttaccgaaggatcaaatggcttgccaactgtttccacaactcctacacctaagcttctcaatgtctctactaactgcttgtatatgccttgatagcttgtgctaatcgtctgctctttatcagtctccggggtgatctcttgattcaccttctcaaaactatcaaccagagtcaatagactctgaacaacatccacctgtatatttgaggtaaacctagcacgctccttttcagtctgcttccggaaattctccagatcagcatttatacggaggaacttgtccttccctgaagtaatttcggttgcaatactttcatactgagcagctgagttactcctttctttctcaatggcaatgatagcactctcaattccaccaagagcctcatcatttccatctagaaaagctttcttgtatagacgaagtaggtccttcataggggggaaatcttccccattaacaacctgcataaagctattcagtttagtgaaacttgatgaaccacactctttttttctttgagaatattatgagtcacgctcgatgaaatacatagctataagttcaaacaaaacacccaaacaatcatcaattaccctgttcctcctctcaattcactttgctcatagtagtatgagcattcctttagttatttcattgttcaagttgcaacagtatggatttatagtcatgcttaacaactaaaatccgtgctctacccatagttcaaaaactcaatttagccaagaaatagcaacattagccatgtcgtccaattactcatgtgatgatttagaaagcaacgcagattccaaaattagctcttgttttcccgagtttagccaaccaacaaaaactaacaccgcatggtttttaggttcagaccatgctgcattggcttacaaaaaaaaagaagtatttagcactcaccaaaactcaaaaatgtttacctttccccactaaaatccagcattactcactcgaatgctctaattcaagcttcttactaacaaacaaaatgagctatatcactgcgaacatacagtagaaaaccaggaattaagagagcacaatctacatatccttttttttttaaaatccaccacgaaaacggggctccctatcccctcatcgacgaagagaggcgaaaagaaaaaaaaaattctccacgaactaaatcatcactcctcgaagccgataacagcgagaggatgagaagcggtcaaaagggacggcggagcggagatctcaccttggggtcagcggcggcggcacggagcggcggcggcgcggcatgggtgcgccggagggagagcagcgagggggtcgccggcctcctgctgctgctgctggggctcaggcgagcaggggttgaggcgggtggggctagggttcgggggcggtggaggtaggtggggcttgcggcggcggcggcggcggcggagaaggtcgccgccatattctatcgttttgctactacttctcaactgttcggaaaatactgtactacagggaaaaagggaaaaactgaaaggcaaatgaggaaattacacggtacacaccaggggttggcacttgggcccttggcactgcttgtgtgtaattctacagtggtttaaaattttatatttcatttaaaatagaaataaaatgattaatttaaaatattattcatatgattacagatccagctcgatggatttgtggagttaggaatacacagcttcaagaaatattggatctggaggctggagctatgtcaaacatccacgaagttaaaatttaaatctgaaaaaattaatttggacttgattttaggatttttcatcctagtcaaaattaggcttacccataaattatctttgacccttttcacttatttttttatcgtttattagttgtagcttaacctactagaggcttagaacgtagaagtttgtgaaaattttagaggattctttaaagtttttttttagaatttctttacttcaaagaaaacttgaagtgatattaattatgttaagaaaaatctaacaacctagcggtgtattcttcaaagagaaactttatttggatgcacacaatctacgcgtaacatatatgtgcacatatgtatacccacacatttgaaataagataggtttatgctcataaccatcaagatatgtttacgctcataaccacctaatatatatgctctaaatgacccaacaagctatagagatctacatcaatacaatattatgtgtgtgcaactggtagcagctttgtagccaaacaaaacacaataattcgtgagttcttgtcggctatgaagcatatatagttctggggctagagaaaattataacacgactatttgtacaaactagctactacaatgattattaattatatgaatttggactagagctaactgttcaatttattattatacttttgatatggtcctattgatgtaacatcaccaattcaatattactgaggaagttccctcatacggatagaaaatatatagtttcttgattgtttctatgctaataaaaacaatgtgatctagctcaagcctaaattgggcctaaatatttgcaatttgagcaaaaaatttatttggttccttgctaaaaataaacggtaccaaattttagtataaccaaatttcggtaagccaaaaatatagagataattggagtaagccttgtcaaatctcttcttgttttaagagaagtttttagagttaccaaaattcgataggatactagtggtagacggatagctgaccgttgccattctccaaaattgcaaagccaaaatttgagccataaaccaaagagagcttttcttagacccattttttgcactctttaaagatccagggatataatatggtgtgcatctagcaaaatataccccataattcataggatgtggttgcgaattagccgatgaaaaagaagacaaaaagaaaaaaaaataaaacgaagtatccagaggccacgagtccaggcgcttctcccccccgaagctcgcgcgcacgcacgcacgctgggcgcttcttcttcccccgcgcatcgtccgaaatcctccggattttctgaggaatccccccgaatttccttgcgtcccatcatggcctcctcaggtaattcctccgtgccaattcgtggtattcatcaaaggggggggggggatttctttctcttttttttttcaagcaatggatggtgaatcgagggctaggcgaaattactaattaccctcgccattttcgtgcgtatcctgcccttagcccaccgccaccgcctccggcgatccccatccatcccgcgatccgatacccgcgcactttttttttctcgaatttgcgttaaccctagcttcagttctagaaatttgtttgccttttaaccttgatactaataacaatttgatggttcccaaaaagttcccatgttagaaccgccactgtctattgcaccgtaaaagtatgcagcaaccgaggcgcttgatataatctattgagcatctaatgaagcagggctagatagaaaaaaaaagagaagttcagattgtcacagctgcaactgcaattgcttctagagttttgcatgagaaaatattatcgcagtcttaggacttcttatttctgttgtgaaatcctgggtatgttatcagttctcactttaacactcgcttgtatggtatgattatgcatttttatgcagatgtctccgttgatgttcggccagagtttaactcttttgatcatttgagaagcatacgatatattgcaacagatagaccatggctgagtaagtacagcctgaagctagccttttcttattttgattgatatggccttggtcattagcacaattgaggattaatgaactatcttccttttggtgtctggtttcgctaacagcgttatatggaataagagttcaacctgtaacaccattcagcagtttgagcagtagacctgatctggcactcattcatcaatgcctacctgatgagctgctttttgaggtaatatgtggaccgatgggcatttgtcttcatatttgtatcatataaaatgtattatggtaaaatggaattcctcatctctgtagtataatttgcttccttctaattgataaaatatcactatgtaatatcctcaattgacatataatctttttctgctcaagtatataagtagctttgtggctctattctgtagtacctccttgtatcaaattatcattacatcagcatgaaagaagtgggaatacttagctcagtaacaaattacatgtctctttgctgaactacacagatctttgcaaggatgagtccatattctttagggagggctgcttgtgtgtgtcgcaagtggaaatatactgtacgcaatccgactttgtggcggaatgcttgcctcaaaacttggcaggttagtttacacatatctattttggttggtttcgtatgcgatgttttgctcaaatatttgaattttacatgtgaagaggactggaatggaggctaactaccagatggtgcagtcgctatatgattcttcttggaggaaaatgtggatgctgagaccaagaatccaatttgacggtataagttcaagaagaattttatcataacatatgttcaaacattaatttgatgaatgttaaattcatatgcgccaactaggctaatatcatagcacacatcacattctttagatttgtgtggaaagaaattgtctagattttaatcaaactgataaaatgtctcatcatgagctgtttttctctcacttggctgtttaaaattttaatcaggtatgtactgtacaatactggtaccttggtcaaatattgtacaaaagtatgtaagcaaagtaatgtgtcattcattctcaaattttcatgtgtcactagcctagagctcgtgcattgcaacagaaaacaaattgagtttctagcttattaagtcaattaataagcacttatttagtctaagtaatactatgaattttcttttaaacaaataggtgattttgaaatttgggggagccaatagtgaaataggggatgacttgttgaaaggtggtgtaataatatagattgtgcggcccagatgttagtggtaggggtggtgtgggaatggacaccaccactactaacattttaagtagtatagataccggcatacatgtaaaacaacaaaatactactactgtacacatgcatcatactcttgtgaattggctgtgcaaagacggtggtgggaggaggtgcatagcagcgtggaggcggacaaatcacagcatgtgctcaggcttgagcattgtgcactgagcccaggaagaatcacaggttcagagcagaagagctgcattgacatgttgatacactgtgcaccagtaaaaaaaatctaggccagaggaattttttaaaatcattgctgtctcgcatagcttcatgaggtgtagctttttcataacaccaagatctggttccgatctgtctcatctaactgtttgtgccaccatgtttacttgtggccagaggctgctcaactcacttgtcaattccaaaaatgcatgaacaacaagaaaacattttgttgcacagatcttggagcacaaccaatggctgatcggagttcgtatgtacctattttgctgcctaaaaaattccaattattactggtccaaatgaaatggacatcaattattatggtgacaagtgaatgatcagttgattgtttttgggaatgtgtatgccagtttatctgttcaatacactgaatttcacgcataattctatgtttattatcactatggtacacattgatttcgtgcattcactttgggttgcatgctgagacaccatgacatttttaaagtacagtaagaatagtatgacccgcagtgaatgcgcttttgactcattaatgaatgtatgtcgaggcatatcaggctgttacattttgactgaatttcagctgcagactaatcctgttgcatactgcgataatagtgtatttggatcagtagtttgctactgaagactagctgaaaggcattgcattagttttggaacttttctgttgttattgctgtaattgctagagtaccctgtattgtggctatactttctttggttctttgagcgaaatttgatacttgttgcttcttcaggtctttatgttagtaggaacacatatatccatacggggactgcggagtggcagttcacaaaaactgtcaatgtggtatgatattatggtggtattattgttcatttgattatacttacctgtacaaataccggtctttaggatttggttactgcatatttctattgttggtgtctgaatagctttagtgtttagtattaatttatgcgcttattgtttccaagttaatctgttaatggcatggtaatgatttttgtttgccccccaggtttgctactatcgttacttgagattttttccaagtggaaaattcctctacaaggttcatatttgaattccttttgttttctacagtatatttctcgttagtgtaacatcggttgatattttaatttcctgtgaagagcagatttccccacagaagattaaggatgttgtcaagtgcatgcatttccgggcatccaaaggtgattgtgtatttaaaggcgactacgtattgtcagaggatggccaggtgaaacttatcgtacttgtttattcgtccttgggcaggatacatcaaattactgccaacattaatcattaattagttttttttctggcacacagatagaactggcactcctgtatccagggcgtcgctacacactagttaggatgcgcctcaggtattttggcttgaacttctgtctatgttttgaactcttgatgatttctcagtgcttctaatttgaaatttgtgcggacattttgtaggcttagaggcacaactctgggcgcaaacaacaggttggatgtattgaagatcttaaccaccggggtgaatgcaaccgaactgagaaactggaaaggcagcgtgcttgaacttgtggagacctgggatgaggatgagacgcatgatccagaagttcctgctgttacccacagcaggggtttgaccccatttgtgtttgttccatttgaggaggtatgacctatgatctatactactgttaggtgtaatgctatgttttcatttgcgccccgcgcttttcttttgttttctatattggaaaattatttcatacctagatagcctagtagaaagaactgactaattaatggctttgactaaaatgttcaggctgatacttcagtgatgaatctgccagtggagaagatggactactttgtccctgggtgatcttgcgcacaaataatagtttttccaagatatatgatgaagacgcaatttcgctgatgttagggcaataatgtgcatacaccatcagacgtcagtctttgttcaatttcatgctcatgttgcttgtatactgttgtatgaataatgctatgttttgttggtgcttgaaagcaaacattttgttggaccatcctcccgcagcaataatggtccaatacttactagtacatggtgttgccttgtaaatagatcatggtgcaactgatgaaacaatacatttgtggttcagtacatttctcaccaaacactggccttgtgatatgtagtacagatgagaaccacatgtaatataatgtaatgtaatgactgctctttctacattgccaggactgcagattaggagaatttggtcctcggatacattctgaaatatacttgtactgaagatgaacattcccagcggtatcatccgcgttgtatatggcttgaaaggggcattatgacattatgagaagatacacttccatgagctgtatatatagctgattatttagggtggctaatttgtagcagagttgcatgaatatttcttctacatgctgctgggtttgggttctttctccgtgatcacgagctcgttccactccgggttgcgagggaggtaagtctcctgcaggttttgaaacgaagacgtcagagcaatgacagtttttgcctcaggccttgagttgccaacttatattgagaatagcatttgcttttcagcagatgtagtttgttactgtcttggtcctcttggacatgaactaaaatttgatgtcagaaatattactcccttcttccctaaatgtttgacgcc

SEQ ID NO: 66111 - DNA, 2599 bp, Oryza sativa
taagagggaaaaaaggaaaaaaaaaaagaaaaacgtccacgccgccgcctgccgcccggcggccaccgcggcccctccgtgtccgcgccgccgcttgccgcccggtggccaccacggcccctttgcgtccgtgccgccgcctgccgaccaacggccgccgcggcccctcctcgtccgcaccgccgcctgctgcccggtggatgccgcgccccttcacgtccgcgccactgcctgccacccgacggctgctgcggcccctctgcgtccgcgccgccgccgcccgccactaagcgctagttcaccactcctcagccgctcactcgcttgccactagaagaagaacacgacttagtagctaggataaagaaaagaaaatagagaggacaagaaaagagaggagaagggaagagtagttgctagagaataagtgcaaaggattatatactatgcgccaatttttagtcccggttggtgtttccaaccgggaataaaaagagtaggggacgaccactttttcatccaggactaaaaagatctttagccgcggttggtgttaccaaccgagactaaagattataaaagggcttgtaagatcaaacagaaaaaactaagccaaccagagggggtgaatgattggagtacccaaaaaccaaaacttttagcgaaattaaaagttatcctcaattcgattcagatcggtctgaccgaggttgatctaccggtctgaccgcgcctttgccatcggaatgaccaatatagattgcccggtctaatcgtcccgaagtcgccttgcctcctaacgccaccgccggtctgaccgccggtatctcgccggttagaccgccaagcccgagcaaatacaatttaaagaactctcagagtagatgacaacattattacttctctatgtgtttagaaagtgcaacaacagcacaccacatggaaactcgactaaactcaaaaccgtaactaaactcacaactcaatgctctaaaaaatgatacagggaggccacaccttccctctctatttatacatgaggtaggcagcctaaagccacgaatcaaactcgtacaagaagtcctaatccacctaggaaaccttcccgtacaagaaaccaactttacatactccaatcataccaaatttggactccttccaaattcgactccgcatcccatacgcacacacaatatctccatcatatgccatatggaatcttcaccaaccacgtgcattgatctttagccaatgtatcccgcatgctatctgatcgtctggacgtcgtcttatctccaagtcgactcccgatcattcaccggcaatactctcccgaggcatcaagacacctacacatgaatcaaacaaagaaatcatattctaagactaagatatctccaacttgactcatttttagcaaacaacaagtattagcatagcaaaagcatgccacgggagtatgccaaagccaagagcagagccgcggaaaggcccaagagagctggagcaccagaggtccgagaccgagaccagcactgtgggcctggccagagtactgaccgctcgatgcgcacaggtctgaccggaccaaaactccagcagtaccttttcatcacctataaaatccaatcatctccaaaaccactccgccgataatctccaaatatcaaaaccaataatcacatatgccaattgttcatcacagaataagaatcaaacatactttgattttacaaccggggctaaagatgatttttagtcccaattctctttagaaccggggctattaaggttttaggtcgacccagcaaagatcagctctcagtagtgtaagagaaacagaaaggagtgtgtcatggaaattagcacaaattgtagcatgagcagctgaaactgcaacgacacatagtaccacggggaatacctctgatcctgctatgatgttgaattgaatttactttgtgttttgtgctgagatttgacctaaattaaggagtatatgttgtttaatttggtaatggcatatatcaaccatgactgatcaatacagttacacagatgctattctaagaatgaacttttaggtaaaacctagtatgttcatatcatttcctagtgtattgattggatcaaaaacaaaaatcctttgagttggtcgaccgatggagaaaaaaataagcgggcgctctcctgaccaatcatcctctatccccctctgcattcttatccattcccttcctcccctcttgctctctttctctcccactctgtattctctccggcgcaggagggtatgcggagggcacagctggcggtggctttgctggcgtggcgggggacggtgcggatggggtggcaggtggcggtgctgagggagtgatcgacgtcgtgggcatcagcgacagaggcacgtcgatggggtggcaggaggcggggttgtgttgtttgcagcgggtgctaccggcagcgaggtcagcgccggtgtggtggtcttcggcgatatctcgcgacttcttccggagtagacaccgtcatggggaggggatgcggagagcacaaccggcggtgccttcactagcgcgggcgggggacggttgtc

SEQ ID NO: 66112 - DNA, 4643 bp, Oryza sativa
catatatgggacattgttaggactggaaggcaaatcaaaggataatttacaagcacgcttggacctacaagaaatgaatataaggccagatttgcatcccataagaaaagctaataataagtattatttgcctcctgctttctatacaatgtctaaacgggagaaacatcaattttgcaaagttctccatgatattaaggttccagatggctatgcaggaaacatctcaaaatgtataaatgttagtcaagggaaaatttcaggtcttaaaagtcatgactgtcatattctaatgcaagaacttctcccagttgctttgcggggtgtgcttccttacaatgtcacttctgtcttatttgatctatgtggatattttagagaactgagttcaaaagtcctgtacattgatgtgcttgacaagttagaggaacaaattaaaatgacattatgtcgtttggagatgatatttccaccagttttttttaccattatggtgcacttggttgttcatttagccactgaagcaaaattaggaggtcctgtgtgttaccgatgtatgtattttgtggaaaggtacatttctctcacaaatataatttcatttgttatctagtatagaaattttaacatttttaatctttctctttatttatgtaggtatttgagtgtattaaagtcatatgtgcgtaataaggcacatcctgaaggatgtattgcagaagcatatttggcagatgagtgtatgacattttgttcaagatatcttgaaggttttgagacaaagcataaccagcctacacgaaatgatgataatgatgagtcagttgcatgttcagatgatgaatgcacaccatatctttttcctcatgttggaaaaccacttggcaagccgagaagttatgttattaggggcttgactaaaatgcaagcacatagatatgtgctcttcaactgtccagatgtcaacccataccttcggtattagctcaagatcatacacttcatcactaatcattttcttcaaagcatacttcatgacactttttccttttacagaactcatgttgatgagattagaagaacatatcggcaaggccgcatcaccccaaagattatcgagcgtatccaaaatgaaaaattccatgaatggttcagagctcatgtaagtttcgtgttattatcatttagatcaacaaataaaatcatgactaagtaatcctatgtacacagataatggatctagagaggaaaaatggcatatgcagtgtcaagaatgatcatagatggctggctcgtggtccgattggtccagcaaaaagatatcgtgctttcaatacccgtggcttccggtttaggcctaaacatttggatggagtgacacagaatagcggagttgtcctaagtgcaaaaacatccagttatactaaatcaagtgacacaaatccaatattgggtgatctaacatactatggtagagtcatcgatattattgagctaaattactctggacaattttcagtagtactgtttaaatgtgaatgggttgatgttgtttctggaaaaggagttaaaaaagataagtatggttacacactagttaacttctcacatctcatacatactggagaaaaagttgagcatgagccttttattttccccaatcaagcagatcaagtttattatgtcgatgatccaatgaatcctgggtggtctgtggtaaggaagaacaaacctagagatatatatgacattggtgaggatgaatgggcaggtgacatagaaattgagccattccatgtttcacaccttggtggaatgtccagtaatgcaaacaattacaagcaatgggttagaacagatgttgaaggaacaacagtagatgttgataataatgctttgaataatgaaggataacagaggaaaatagttactctttcatgatttatttcattacttcaaggtatatgcaattccctgatctaaaaccttctgatggattaattcttgttagcaaaggtgcttccagttttagaactatcgaaaactctatccaactgaatgcatctaaatccaacaatatttatggtcttttaatttaacttttctgcctttttggtgtacggtacaactattaggtccactggttaagtatgatcttacattatgttcttgtgagaaatatgattacaagcgtagtggatgaataatttgtggttaccttggctattctttctattaaaagatagcaataatcgttgtgtttatatttatttctgattgattaaaacctgttcatgcatgttcatgtccattctttgctctatattgtttagtttcaggtccattattttgatgcagacgcagttacattggcaaggtatctgtctttctagattctattgatcagctcgctatctccatgtcttctttaacaacaaaagaaatgtcatgtctttgctgatgaacttggtttcttttcctacatggccaggtggcatcagggtgttactgtttctttcggcaagcgaaagtgaacaagcagctgtcactaaccaacatatggcagttctagtccaagcaaacatgagtttaggccagtcttcagtagtcaataataattcccaatgtagtctatatgtatagattattttaaatttgttcgtgtgagcttttccttttctactgctatattgattagtcctgtaatcatgtctgggttatgtgatctctctagcatcttgttttttaccatattactgaaatgattattctttcatattgccgaaatgattattcttccatttttttttctaagttcatgatgtaagacaaaaagattctgtgcaaatacctcagctacattgtagcaattttgtgattaaatatttttatacacatgtcatggatcagactcactcgctaaattaaaaaataaatccaaggagttatgaaccaagcccacagcctcatctataaattctgcatgctttctcactgtgcttgtggtacttttataacttgagtccagccatcctttttttatatataaaatgggcattggtcaacccaatgaatgcttggttcattgatcaaaccacaattcctaaaaataaagtgtacgcatgtgtgtataaaattaaatttcttaaaatttgattaatgcaaaaaaaaacaagtacaataatttacaactaatgacacaaatgtttgcttgcccagttggctagtctggtgcgattcttgtgtatttacacaggaggttaggagttcaactcctctgttaggcacgttagttgttttagaaagcaacccaagtactttttatgcgattagataatgttacatcactatgttaaataaacccatggcaccaatatattatccaaccctagtactttttatgtgattagataatgttacatcactatgttaaataaacctataataaaccaaggcaccaatatattatcccaaactaaatctgttttaattacatagcgcaacacagagttactataggtggtagtaacaatgaattggtgttactatatgtataccaactgtaacatattggaaatatgttacaacctttttttcaacacataaggtttcgttgctatagcattcgccagtaacacatctccgaatgtgttacaaaatagtgttacagaatgtcagttctgacgtagtgtcatcccttgtctccatttaattttatcagatggtgattgatagcacactaaaataataacaccacaattggtaaactttttccccctctctcaggtgtgataatactgttgtaagtactgattgaaaagagagaaactaaatgttgtaagaaatagttgaaactcaagggaaagaaattctgaattagttctaatcaggccggatcgagatctagtgactaaggctgttggtttcttcaccacgttggcttcatcgccacccgttatcgcagccgcgccaccagctgcagccacgaatctcgtcgcccactggcgtcccacccacctctctccagggctcacttctccctatcataggagcaaacatatatagtgcgcatgaagtgaaggatttggcatgaattcagtggatgtcactgatctaattgcacatacacattattaagaatgcacatattgcattgagtaaatttcacaaaatctcagagtttgcaatggatatctaaggtcgcactttactaattgataatgtaattcctatgtaacattttgatcctaattaagaaaggtccttttgtagaagtccgagtacgtgtctcaccacctagccaacttgagaacgctggccacgtcgctggctgagccatctttagtcccggttggactaaaaagagggtagcggcaatccctcgaggtccccttttctttttttttcattgttaatttgctattggctagagttaatccttgtattttctcccaaattgagtaggatgcgtatccccaaatcaaaccccaaatcattaacatcacaaatcctaagttatacacacaaatcaaatacatcacaaatcctataagtaattatacacaaatcaaatacatcacagattatacatctcagatccatacaatgaatgacaaattctagaaattatacattcagtgaat

SEQ ID NO: 66113 - DNA, 1244 bp, Oryza sativa
cccggttggtaactccaaccggaactaaagataaatctttactcccggttggtactatcaaccgggactaaagatcctcggccgctgacaggcttctgacagggatgaaccaggactaaagatgatttttagtcccggttggtaactccaaccaggactaaagatgattttttttttaactgggacaaaaatattctctagtcccggttctaaagaaccaggactattatggaaatcgttcgactctccaaagatcacttattctccagtagtgtgccttccactgcattttctaatttttagggtccaaactgccccccttcgttgttcatctcctcatcttctcaccaatctctctcgtattcatcgatctccctgtacactgcccccttctgtgtggcctccggcagcggccactcggcggcgccagcgacgtcgccacacgacggtcagcctctatgccaagaacggattggagaccgttggcatgccatgtaggacggcaaggatgggagctcatggaagccagaaaggagtcatgtcccgccggcagttgtattagagtttttagtccatctgaagatctctaccataagggtgctatttcattaggattggatggttggccaacacatagtggacgcctttgcttcctggtgcctctctatcctacttcgggaagcacggagcctgttaatgctatgaaaatatcacagagaacgaagttcccggttcaccgttcatattcttcctcctctcatcttccacctgcttttcacgtatgttgaagtggaagatgcaataaagtcaaaaataatgtacaaatatatggtgtactccctccgtactcgtaaaggaagtcgtttaggacaacgacacatacggtctccaaaacacaactttgacttcttgtttctataaaaatatttatttaaaagtgatatatgtatacttttatgaaagtatttttcaagacaaatctattcatataatttttacctttttaaactcaataacttgggagttatttatgatttatattcccaaggtttgacttaaacattgtcctaaacgactttttttacgagtatggagggagtacatctttgtgtttttaatatgacagtaataacatcaccgcatggccggttaagaaggccatatctgtgctagtgttatagcttctaaattagtagagtacactacagaaaagaaacttttgcatgcttcatgtcacaaatagt

SEQ ID NO: 66114 - DNA, 5565 bp, Oryza sativa
gagccgacgccgagccgagcgctctccccctctctcgttctctctgcccgctccatccccggcaagctccccgccgcgttttcgagttccccgcgcaccgttgcctcgcacgcgcgccctcgcggtcgccgcccttgccacgcctgcgccgcctagccgctgctctgccgcgccctgccccgcgagccagcgcgcgtgcccgagccacgccgcctgcatctgtccaaaaaccggaggcagcgcctcccgctcccatctctctccctccccaaaccggcatggcgcgagctccctttctccccctccgtttctccctttcccctctcggcccagcccctgcttcctccgttctgttcccgctccaaggacgcagaggagcagccgcgccagccgtcgcccctgccgtttgaccacgcccgtgaacccatcccttcccctcgaagctccctcaccccagtgccgctcgaggtcggtttcctctcctcccgaaccgacatagccaccacttaaaaggcgcccctcgtccgtgccctgttcgccgtcgcctttcgccgttgcgtgtgccggagtagccggtgcgcgctaggaacagaaggggactccaggcgtacgtcttccttctcttccccggcccgaggccgtagcgatcacgccccgcgccgtcagccatcgtcatagcgccctcctctgcagtggtagtgcatcttctccgttctccttcctcgctccatctcctccccttagactcgggtagtagctcgagtagaccccccgtagctagctggcgccgccccaagccttgcggccacccgctgtgtgctcgccgccgttgccacccgagctcagtagcgcctctcgtcgccggccatgctcggcgtagctccgcccaatccgacgcaagaaacagactctggtggccgagtagatgctctggtctggaggaatcgaactcccatcgcgccgtcgccgtttcccccttttctcgccgccggatgccgccgccgcaatccgccaccgtcgagcatcccccagcaaatccgagccgttggcccgtcccctctcaacccgtgctacctcccagtgtgctcacttttgcctgtaccgccgtagttcgccccgccgtttgcagccgccgtccgccatccgttccggccgacgccttcttcaacctcccgccggcccgcgtggcagccacgtaggtgccacgtcggcgccacctcggctaggaccgggtcaacccgacctcggcccgccgctcccttccgccccgcttgcgcgcgcggtccaccgcgagccgtgaggctacgcgtgggcccgccgcatccgcgtcctccgcgagccgcgcgcgtgcaccgcgcccccctccgaaccctagcgccgcgctacctgctccccgctcacggtgagctgagccgccgacaagcgggtcccactcggggccacgcaaggtggacccggcccaccggttccccctccctctctcacctcgcgtgcccttgggctgccttctcgggccggccggcccatttagctcggccgagccgcccttttctctcgggccgcgccctagccgcccgagggaagtctatttcccctccctctttcttttctttttccaaaagggtttaattaaatcctttttcctttagatcaaaaatccaataatcttagaaattcaatatcttctcaaccgtacatccgattcactccgttcaacttccaaaattcctcaaatctcgagatctatctaatggcacacttagaggtcaataatagggctttgttttcgccgtttgttgagttgtcccgtttcacgtgtagtttcgaagcccgaagacccgcagtgtgaggatttcgacgatcgagctcaagatctcgagcaaggcaagtcacctttgatcatattgcacctataattaaaatctaagtatttattttccgcaaatgttgcatgaatatgttaaacacaagtaattcggccgcggcttgtgagatagcctgccggccccaatcgtaattgctgcaattaccctccgtgaattattgaacacttaaacgtttcttcgactgaggagccgactacaggaggcagccaggcaggcgaggagtagaggaggccgtctttagcagttttccgtgtgttaggccccttttgtgccgccgccaactcttttggagtcgtggcgaggtagtgcgtgcgtgtgtttgatgtggatgttgtatggtagtctggattctcctaggaggtgtgcgtatagtcaagctcggcgtagctctgtgacttgtccacacccgttgtatcaggtgtctttatgatttgagaaatccagtttatgcctagtatgtgctatctgagttgttatttattttgcttcttgtcttccttaagtgcttatctgttgcttatctcgcccttttctgggagtttagatggctagccgccccaccgcgctgctcgtgcaccagcccgcttcggttttgaggaaggtagagttgagccagaagcagatcatgagtcagctaatgagcagtctcaccacagcaaccgttcgcaccgtactgcttcccgcaatgcagaagttgagcaatcccaccgcagcaaccgctcgcatcgcatagtttcccgtaatgcagaagtggaatagtctcaccgctctcaccgctctgtcggtcacaattctggtgaagaacgcattccttcaccaccccatgttgagaataacatgcagcacttgatggcagttcagactcaaatcttgcaaggtttagccacagctatagccggtattcagcacaacgcgcatggaaatggccaccctcacatgggcaacaatagatccaagctgacagactttctgaggtctcgtccgccagagttctctcagaccgtcaagcccgttgaggctggcgattggctaaaggatgttgagagaaaactcaacttagtgcagtgtattcctattgagaagacggtctacgcctctcaccagctaagaggacctgctgcagattggtgggagaattactgcaatgcacaccccgaacccactaacattccatggaatgagttcgctgcagcttttcgtgtagctcatgtgcctaaaagcactattgacatgaagaaggaagaatttatcaggctcaagcaaggcaatagcagtgtcaatgagtatctgagtcagttcaacaagttggctcgatacgctcctgaagaagtggacacagacaagaagaagatcaggaagttcttgaaaggagtcacagttggaatgagactccagttgcttgctcatgacttccccacctttcagcacatgatcaacaaggcacttccacttgaggatgccagaaaagaggctactgaagaatataagaaacgcaagtctacccatcaagggaattcttcccgaggtgcaccccaccctcgctttggtcagcctaagcagtatcaccagtcggtcactcaggctaaccgccagccaggctatgcccctcgccctcagatgaaccgtccagcacctccgccgcagcagcgtgccccaagtggcaatattgcgccaaacagtgttacctctttcaagtcaccaccaggactgtcaaccgtacagtgtttccggtgggacaagatgggtcactctgctagacagtgccctcagaatcctaccaacaccaactcagggcatgctaatggcagcaccgccagaactcctactctagcagcagctcagtctcgtcctagctcttaggcaagtggacaaggttcccatgcttccaacaacttcggtcgaggtcgggtgaaccacattcaagctgagaccgctcaggatgctccagacgttgtgatgggtatgttctctgtcaactccatacccgcaataattctgtttgattcaggagcttcctattctttcatatcgcaagcctttgtgaaaagaaatggttggaaaacctaaaatttacgagtaccaatgatagtacattccactggaagggatataagggcaactaaaatatgcccggaagttaaccttagaattgaggaagttgacttcctagccaaactgatagtcctggactcgcaaagcttggacatcatcctagggatggattggttggctaagcacaaaggacagatagattgtgccgaaaggtccatcaccttgcaaggacctggtggaaagcaagttcactttacccccaacactcttaccgcaagtcggtcaatcctaaccaatttgcaagccactcccttggaatcggtgcccatagtctgtgaatatcccgacgtgtttccagaagagttatcgagtatgcccccagatcgagagatcgagttctccatagaactggcaccaggtaccgcaccgattgcgaaaagaccctaccgaatggcagctaacgagttagcagaagtcaaaaggcagatcgaagaactggagagtaaaggttatgtgcgacctagctcatccccttggggagccccagtgctcctggttaagaaaaaggatggctttgagagaatggtaattgactatagagccctgaatgaagtaactataaagaacaagtacccgttgccacggattgacgatctgtttgatcaattggaaggagtgaaggttttctctaagattgacctaagatcaggataccactagttgaaaatcagatctgaagatatccgtaagaccgctttctcaacgcgctatggtctgtatgagttcacagtgatgtctttcggacttaccaatgctccagcattctttatgaacttgatgaacaaaatcttcatggaatacctggacaagtttgttgtggtattcatcgatgacatcttgatatgctccaagaatgaggaagaacatgctgaacagctgaggctgataatagagaagctaaggggtcatcaattgttcgctaagttctcaaaatgcgaattctggttggaccgagtagcattccttggacacgtgatctcctctaacggtatcgaagtggatccaagcaaggttgaagctgtacttgcttggaatccgcccaagaacgtgtcagagatccgcagtttccttggcctagctggatattatcgaagattcatcgaagggttctcaaagctagctagacctatgaccgagctgttaaagaaggaaaagatgtttgaatggtcagcagcctgtgaggacagctttcaagaaataaagaaaaggttgaccactgccctagttcttaccttgccagatatacgaaaggatttcgaaatcttctgtgatgcatcaagacaaggcttaggatgtgtcctaatgcaagagcgaaaggttgtggcctatgcatccaggcagcttaggcctcatgaagtcaactatcccacccgtgatctcgagttggcagccgtggttcatgcttttaagatctggcggcactatttaatcgggaacaaatgtgaagcatacaccgatcataaaagacttaagtatatcttcactcagaccgagttaaatatgaggcagagaagatggttggaactaatcaaggattacgatcttggaattcattaccatcccggta

SEQ ID NO: 66115 - DNA, 9278 bp, Oryza sativa
cgtagtcgtgataccaaacatcaacgatacggctatagcacttcacctttgggtgcccacaaaaggatgggttttttggggaaaaaaaaaaactttttttaccaaagggggggggggaaaaaccggtaatgtaatctacctaaggctaagactgttcaaggacaacaactatcggtaggatagctaggctagaaaggattttctatatgttttcactatctaagctaagtaaatgtaattttctaactgctgcttcgggcaccgatccctgctggtctgccagcgtggttccggctatagctgtatgatgtatccgaacatggaggattactaggacgggattctgggatatcatcacctgtcgtctacctctaacaaatccgtgggatacacaaaaaacaaatataatctctaacctagacaccacgtctaagttattaattactactctaatacttgcgcaggaatttcctcctttatctagagccctagtactagagcacttagtacaaatactaaacaataaacccgcaaagatgaaaatttatctcacttagactaagtaattaaataacaaaagaaaggatcctgaatgcttacttgatagaagaagtttctctgaaaccggagtagagtgcaccgacagctccggtactcctcaagaattcctcctagaaatctacactcgccgaggtagaagtcgaagagagcgccaaacttccgggcactcctccagagattccctaactctctacctattttctaatgtacaaaagatacaatagaatctcttataattcagctcaaagttgtgtgtattggaatgagagcctctcatcttttataggctccaaatgacggttatgaccatgggaaatgaccaaaataccctccaaccatcattggggagtaatcatggccatccacgtggaacagatggcaggaggcgccacgaatggttcggctgaacccaaaaacactcctcccggcctctccttcggctgggaggttgcttattgggcccccaacatcatgtactacgatttttttccaattctaagtggttttgattgacatatggaccctccaatccgtgtaaacgtgtcctgattgtgcggatgtgtattttgttgcatgacgggtgtgttttctccttaaaacacttgcatacgcatatttcaccaacactagtggaaatgattagtaataatccctaccactgagttggataccatattttatttcattatatgcaagcattgatggtccaatattatgatttaagaactgtcaatagtggttttcatacaaaatccttgcatacatatatttcaccgatacttgtgaaaatgattagtaatagccactaccactaggtttgatgttttatttcaattgcttatatgtaggaattgatggtcggatttggtatttaaggaccatcaacagggttcatctctccctccttaccatgcacagggctgtggttccctctgacgggtgtggcaatggcctctcccctccctagcgctgcagtgaccagcactacctaagccagcgccacccctcaagctcggaagtgatgagcactgccgactgccaacgttgatgcctctcaccaaagctaggcggcggcaatagagtaggcgaggaatactacaccatgacataaaattaccggcagatgtgtattagcaaaaatatagaattatctactaactacctgttggtaaaaggtttgaatggaccatatgtcagcaatgctacaatataggagtaggaatctatttctgtcagcaattctatataacttcaggtcaaagtatatgtcggtaatactaactttaaagtcagactatgtgttggtaaaacttgccaatccatcatgtgccaccaaagtttcatccgtgtgtcacgcccgtgataaattcatcccgaaataaaaatcattctctaaatggaataatagaattaattaaaattcgaaaagaaattggcaaatactaaaatacgtacaagaaaaattcgaatgttgtccggagattttttgttaaattctccgtggtctaaaaagagccctcaaattttacttgaattttcagagcaccgaaaatattattaagcaacaaaaacaattatcagagtttattaaaaagaaaaacctaaaattaatccccctcctccctttgggccaagtctggtccaaagtcctcccactctctcccggcccgcggccaaagtcctcccttcctccctctctttctctccctctccttctctccctccttctcttgggcctccccttcccctcccggcccactccctcctctcctcctccttctgggccgcccctcccctccctccttccctctcggcccagacgcccggcccaaatcaggccgagccgaaccagccgcgtgcacgcgcgccgattgcgaccgcgtgggtcccacccccggtcgtcgtcaacctccagccgcccggcctccttcctctctctctctcccgtgcaaacatagctccttcctccccccaaatccgcctcaatccaatgcctacattcaaattaaattaggggaatggaaaccccattactccctcttcaattcccctaatttttccccttgaatcctgtccccaattgccggggatttattccctcccttgaccggcattcatggccgccggccggattcccggcgccgtccccgcccttgccatggcctgctcccctctgtgacctataaaacgggatctcctccctctcctgtccccgttttgcctcttcccgagctcccccacggccgcaccacttctccccgccgtcctccttctccctcccatgccgccggccacttccagccgcccgtgccgccgcgccagtgcgtcggctggccgcgccaccatcttcctcggcctcgcaggtgcctcctctacgccggcctgccctccgtttcccgtggagacctccggaagtgcatccccgccggcaacagtggcgttgccgccactgttccgcctccggccgcctctgccgcgtctcttgtgcaccggccgacgtcgccaccacctctcccggcaccggaaagccgtcctcttgcccggccaggccacggcgtcgcccgtatttcgccagaacaccgccgtgccgcgccggcctctccatcagcctcgccggaatttccccggtcggcccttcctccactcgtgcgccgttggccgcgcaaccaccaccttcggcatcacagcggcgagccagcaacgtcgtccttggcttcgcctccccttcagttgaatccgccggcgttcgtcgtcgcctcctcgccggttcccatcgtcgtcctcccatcgttcccggtagtcgtggtgttcgtctctccgtcaagccgtgctgttcgtcgcccgcctttcgtcaaggttgctgcagccccgtcgtcgtcttcgtcctcggctctgcatcgtcaagcgttgcatcgaccgcgtctcgccttcgtccaaggatcgccgccgaagtcgttccctcgccgttcgtctccgtcgtccccgagccgtctccgccgcccgttcgccgtcctcgttcccacgtgtcgtcgcgtggtggtaagggtccgtcctttcgctgcccccgtcctcgtcctttcggtgtcgccccgtgcccattgtgtggttgtcgaccctggtacccgtgtaccggtgtcggtagtcgttcgtgggtgcgtgtggtgaccgtgtttgtgtgcccactcggtagccgcgtggtttccacgtgtgcagcccgcgtggtgtctagtggagtccgtttgtcggccactcgccttggttgacacacggggtctgcttccgtcgacccgtggaccgtctctatgtattcggtctaccgtggtccattaggttgacatgttgggtccgcatgtcaatagcgcagccttcctgtcttttccaggctagcgcttgcacatgttttatagttgcaaaacctaatcataataatccgtaaatcttcatataacagcattaaactttggatgatcatatcttggtcatacgaactcctaatcgacccattcaagtctcttaatgtttgtcataacctaaagaaccgtgtgctttctttttatgtattgttattacttctttttaggcttgtagttttgcttgtgtgcttcgcgtagcttctgtcattccggaggtttccgaagcatgcttcgcggtcgtcgccgaaggttcggagtgccgttctctctgagcaacgcaagtcgcatcacccttgagcatattgaatcccagtttataaaattattttgatttaaattattgcattaccgctttacttaaattcccgcgttatcactgttttatttagccatgcctatttacctttgttatgaccttattattattgctattgttattattatcttgttcaccctaggataaacaaaaccccaactagtgggtactctattaacggttccactagtatgaatttaggtagatgcttcgctgattaattaggcaacactaggtggttttataactttagactttgggaattcttatatcatttggacagtatggaatggttggcttatgttggaattggacacacacctccccctctattcaaaacccctaaaatggttttaggctgggctcaaggtgcatggttctgctagtagcacctcggccactataaggaccggtcttcgagcctctgttgcaaagcactactgtactaaccacatgtctaatgggtaaggcttaacccggtgctcagtctagtcctggcaagagtacacggatggagatggacgaagtcggggctcgatggacatctctagggcaaatgaaggctacacgagctgcggctcggtagtcgagatgtcatggcacagggccggtgtcctgctgctaggggctcaatcttacctacctgtctcgggatttcggccataggcgaggttgggtcggtgcttttgtcacggctaggatgggtaaaggggttatgtcacatcctttacgatgggttccacggccgtggaatgcagagtaaagatgtgtctagagggtaaagatgtacacctctgatcagattataatctattcgaatagctgtgccctcggttatgggcatgcctagcaatgtaccaaagttagaagtttgcttcttaaaacttgcttaacaactaaaatgtggaatgattggcctgagttggcttgggatgagctgggacccaggtcgggttgccagttcggtctgaatcatcgtaggccttgggttaaggcaggttcgtgtgggttcacggccttgattaataatattgtgtagctctaggatcgtgtttgcaaaatagctttgggcaactaagtgacttttaaatgttgtttactgcaaaacctaacccctattattagccccttgtaccccttgcattaatcatgcatctcccggtgtggcttgctgagtactgtggttgtactcattcttgctctatctctccccccttcagtaagagaagctttagagaagaagtcctaggtggagtcctggcttatgccccagttgagcgcctgtgaagatggaaccgtaggcccgctagtccgctgctgtttacttttgtttgtcaggcctgaagtgtctttgtaataatggaaatattattgatataataaagatgtgtcttttatatcatgtttgtgtggtgtaccctggcttttcctgggacggggattaatacactagcgttcgggaaaatgtaaattttctcggtcgcgacacgttggatcctaatcgaacagtcttgttaacgccagaatttggtaagcccaaagtcatcatcggcctagagtcagtatcggctttagagtcttggaatcagccgatgggagtcgtcaaatcgccagcagttgtattcttggtggagtgggatcaattagaggaaatttatccagaagagtccgagttcaaggaggatgcggcatggcaaatatatctattaatttggagtagtttgttagtttccttttatcttaaggaaagtgtgtttagtgtcctataaggactttatgttttccttttatctttaggacagtttctttcttgtcctacaaagactagtatctacccatgggtataaatatgtgcacccggggtcattgtaaattatctctcttgatcaatacaactactctcggcgcatcgccaccctctttaccgaggttttttacttatcttccggtggaatttggcacctgacatgaggctgcattggttcagttcgatctctggcgaaggagtaagtcctacgttccaccggccctggtgaatctattggctatattggtgttgttcaaggctgcattgcttcgatctcttggatcgctctggtttggttgatatatttgcctacctgatatctcaattctatctctaattgcattgtgtttagagacgcatcggtttagttgggactgtctcggttaggtctgatcttctgtcttagccgatatatctctgcaatcacaatgttgttctaaatagatttgttatatccatcacattagacagatctagctcatcaagcattagattatcatatacaatctcgtgctgtatcggttaggttcgacctactagattgttgttgataatataaatcttgttgagccgataggttcacgctagtgttttatcggggtgctagccgataagttatctggacgttgcatcggcttataaggattacatacaagttggatttagccgattacaacaaaggtttcactgtttatctaatcgtttggattctatgacatcggacctccagccgatgtatgctttaaccttcggatcaatgcttattctatcatattgtattgctagccgattggtttatactagattatattgttattttattacatcatcatcagccgattgcctttatatcattatctatattggacatatagccgattgcttaaatccaatcgttattggctattatcggcatcggctggaactactccatcggcttgtcagccgatcggctcattgatctattatttgtatatcttgtcagttgcagggtcaaactgattggcacgcccgcatctcactaacctttggttctgcactggagctaagcagatctcccaggccagtgtatgtttttcgcgtcaacaagtctagatccatttatcaagatgatatatctctgctacttaaaagttccgtagtggtgacggtgactccaaccttgacagatacgcgaaatatagaaagtcggatcgcctaatcgaacggctcagatcgcctttctcttcctacgcatccagcgcacgcgtctccctcgaatctcgatcgctctctcctctcccctaccctcaaccccctgatccacgccaccgcaaccccctcaaccgcccgcatgcccgatccgttctctccccctttcctccttccccaccgtcgctgccgtcctccccggcactcccaatccctttctcctccatgccgcaccgcctccccatcgtcgcagccgccccgtcgcccctgctcgcctgcatccaccacaccgcctccctccccagtcgagacggcgtcgcctcctcgcccccttcgcagccagattgacaccgcgccgttcaatccaccgcctcaagcaccatgcatcgtcgtcgttgcaggcgtcagcacgggcgcgggcgctgccgatcccgagtcgagacgacgtcgtccgctgctgcttctccaccactgacggttgccctgcgtatatcctccctattatcgcggtccccacctgctcctgaatcctgatccacaaaaacagcggagcgccgtcggcctctctgcctccctgcgaccaccagtggcatctgccccgccgtcggctctccctcacccgcgactcgccgacgatggtgctccacaaaccattcaggccgtcactggtctccggagcgcccgaggccgacgtgtctcgcactccctataatcttgctttgctgtagcagtaacaacatcataacatatcgtggttcatacaatggatcaggctggtaattcgattccaattcttgctcctgaacttttttattggtgataatgttcagcagattggtttggtggtggcagtgcggcaccactgatttgtgttagacattggtccttatccaaccctctaatctcttgattatgctcacttacgatgacttcagctcaggtggttgaaagaaacactcctagactgctatttatttttacgttacagggatttggctacagatagttgcaagctgcaatgttctgatatttgttatgttttagagcaaaatctgccttatatataatgttataattaggcttcgaatttcttgcttatgttctttaaaaattccaagtaaccttttcagttctttatgtcaggttaattgacagatcgagttgcacttacacatatcttgttttaggaaatgctccaatggcccttgaatccagcaaagtaagtatttttttatgcttgatctgtgactgatctcaaacagataaattgaaatgagtaacttgtacacagataaaaaagtgacatgggacttgattagagttacggtatttttatcttacgaggcgccagcattatttgagttttatgagtcaaatattcttccattttttcctgttatttggttgtgtcatgtcattatttgagttttattgggtaaattgtgtcctgactggtcctgagctggatgtagtgcttaattggtgcaaaaactgggcttaagttgcagtcaatttccagtcatgtgtttgaaaccattgttttctgattactttaattaaataatccatgatcacaatataaaccatatgtgcaaatatccagtcatgtgtcgtgtgcatgatcagatgactgctattggctataatgcagtgattctgaaattgctatttgccaaggcttcctatttttgctgaactgctgcagcagtatagtgccaccaaatgaaagtgaacacgtaagcatattgtttgggagaagatcacagttcggaatttcagattataaccaagataaagaatcactcaactttatgatcgacttgctattcatgtttattactccctcatttcctaaatgtttgacgccgttgacttttttaaatatgtttgaccgttcgtcttattcaaaaacttttatgaaatgtgtaaaactatatgtatacataaaagtatatttaacaataaatcaaatgataggaaaagaattaat

SEQ ID NO: 66116 - DNA, 3939 bp, Oryza sativa
tacacattcatctaagatcccttatattttaggacggagggattagatgattatgatattaaacttgctctgaaatatggttagtattaaaaaccaagagagttgcacagttaaaaagtgattaaccaaccaaccaatccatggtgaagtgaaatggcagtgcttttaaaggagacccacaccaaacagcagcagagagcagagtctcttgctcccattatctatctctgtctctgtctgtcaatctcacgcacaccagcacacagccttttcttctcctcttcctcctcctccagttaacggttaaggcgttggtgttggtgcctcctctccaccaccgtccatcccactcccacgcgcacacagcaaagcaaaccaaagcaaagcttcgtttccgctgccccccacaggccactggacgaggaagagcacgcagcttcgcctctaccggcggcgcatggcataggcatccccaagaatgagagcttgggcctccactacaagagagagaggcagacccaccaccatcaacaacatcaggaggagtagatagatgggcaactgcgggacgcgagaggagaatgccgtcgtcgcggcgcacgcccaaggtattcttcgcttcctcggattgatttcttgggggatttcccggtgattgttttcttaaggatgctggttgttgggatgggatctcgggttggatgatctgaatttcatcaaaaaatttgatcttggtggttatttctaggtttcccctgatctcttggttggtgggttcagtggggaattgacaaaagcactgtctttcctttttgctatatatgatggcctatggcttattgggacctttggatgggtgttttggttgcaaatgttgattcttgttaggtctattccaaatcggcattttggtactttcggtttaggtttgattaaaatctaatatcaacatttgctccaaatgttcaacattgtctttctgttagttgcatatggggattctgggattttggtttacagtctacatttgctcaacatccatctttctttctttctttttctcttttttttttgttttttttgggggggggggagcctaatctccttaagctttctggtgtgattgctctatgatttcttttctgctgcatatcccggccaagttacgatcttactgtctttccttatcttcttggttgctgtatcagaaattctgcttcattgtgttcatcgggacaatttacaggcacttcccccaatagtgctgcaatttctgtgctctctgcttcactgaggcactgttgactttcagtttaacagaaatagagttatgatcctgcaagttggaaaaacataatcacttcttgcagtttgctgcattctttaagcaatttggagccctttttttattgcatgcaactctgcagtagatctggtctcctgatcctgtttacctcttgctgtaatcaacttgcccatgtatgtacttttttacagtatttttaggtagaataccattttataattgctaggaatcgccaacgctcgtttccagtagttctcttgttagtttgtgattatagcttccctaaatgtatttcagcaggattagctctctttcatccaaccatctctgtgaatgctgaaaattcaatatgaaaaaaaagttttatttttatcttatatgtatgagaatttatggtaaccttaattcgtttttaccttgactattttttctttcttgttgttgaaatgtcatcttctcagttcagcagctccatttgttacaacatcctgtcaagaatgctgttgcagagaggaagcatacccgcatctcatcagatatgagtgatccttcaacacctaggaaaattgaagatgccaagaacatctccatatacaacgatgtgattgatttcacattgtttgaactcgagaccatcacaaagagcttccgtgctgactacgttcttggtgaaggagggtttgggactgtttacaagggctacatagatgagaatgtcagggttggtctgaagtcactacctgttgcagtcaaggtgctcaacaaagatggacatcaaggacacagagaatggcttgtgagttgccaccttgttcaatattcactatggttgctgatgtctgttatgtacatggatacacggaacgttaacaattactcgtacaagaacatgatatatcttaattatgtaaattatggaaaaatatttgttgatgctaactatgtatttcacatcaatggcacatgcagcatttagttgtactcatgttaacaagtacgctagcaaataaatacaccatttcatctttcttagtctgttccctttttggaatagaaaatttctcaagaagctacaatacatggttagaatgattcattgggcttgtatcatgaaaaatgtgcaaacttgataggttgatgaaggctaaagtattaatttcattggccgaatgcatgtagactgagtcatactgttagatagcatatttcttgaaagtttacaaacagaacagtgtatctacacatgctcagaataggtgaaattctatttatttttaaaaagagaataagcaacattgtccataaaagaaacatgatgcatttaatttgacgtaagcaattttggcaattttcgggcatattattaacttggaaatccttaccttttcattcttgtcgttatgttataagaattatcaggaagtaactcatcttttgtttctttgtcagactgaggttaggttccttgggcagctaagacatccaaatttagtcaagttgattgggtattgctgcgaagatgaccacaggctgcttgtgtacgagttcatgtttcgaggaagtctagaaaaccacttattccgaagtaagaatccaactccttttcatcacttcatgatgatatcatggcggaatagtttctgtgatcacactttttaaatatatatttttctctctataatacaatcaagcaccatagctgaagttgaccatattgtggataatagtgtggataatagagtcgcaacgttgttctattaaatatcgttgatatgagcaaattgatcagcgttctaaaacctggtctggtaggatttcatttcaacttgctgttcatatggggattccaaattgtccagagctttttgactgaacaaccgatttaactgttcactgctagaccctcagtaagtttaggccctcttcatatttatcattcttggaaaactttattgacatgtttttaacaagattgtccaaagtgtccagttaaccatctgaactatttgtcttgccatagctaaatgccatgattttctttgtttgtatacttaatagaatcattcgtgatagttcactaccatgcatagagtatgcgagctacccatacttatctgctaaatatcttctgtattttttcttccaaaataaatgaatactattgaatactggcatgtatgatttgaaatgtcggcacagtatttcatcgattcatttgtaggtgaagtaaattatatgccaatactgaattaatggctgactaaagattgtgctcaactatattttgttcttgtacattgtggtgaacttgtattcaagattaggaaattttctgacattgtctgtgcttttcctttttcttctcagggacagctactccactatcctgggctactaggatgtcgattgcattaggggctgccaaagggttagcttgcctccacaatgctgaaaggccaattatctacagggatttcaagacatcaatattctgctggactcagttgagtagcatttcttgtcaatgtcttgttttttttttcctttctcttctatgctgttgggaatatgtaaatatttttcataataacatttatcttttatttacacttacacaggattatactgctaaa

SEQ ID NO: 66117 - DNA, 24827 bp, Oryza sativa
  unsure (1)..(24827): unsure at all n locations
tagccagcatccactgcctgaacgaataggagttgtcatgcaaatccactgcanatttaagtgaagtgatgatcgatcatgtgcgtactttctaaagtagtntgtgtcatggatatgaatatgatgcatgcacctgtgaccgaaaagctaccttcactttgcaggcatatattggcattgtttggtgacttgacattaaacaagttgctgcatgctcatcagctttgaaggagtaagagataagtcaatctacaaaggtgtttatacatatatttttgtttatcttcaattgttcatggtagtgcttgctgcgtaggttttgcaatgatcgcctgattattattaatctatctatgtactctctctctctctctctcactacctacttgcacggatcaatcgctgtttgacttcatttgatgagataatactaatgaactagtgcaagatagtgttcagtcaacagcaatggagataatactatttttatgaccttgttcaaaggtttgtaattttccattaagctagtgtttacaaagcaaaccactatatatgtgcacttgttacttagagcaatctagctagctagtgttatcatatcatattccaaaatccttaaatcaggttagatacaacagaaacaaaaacaaattcagaaagctgccagcacaacaaccacaattattttttactagctacgatcagttgtgttatccaaaccaaagtactagtataacatttcaggctttcagcatatatatgcttgctacacctgtatccccatttttgccctgaaacaaacaggaagtactaaacatgatagtatggcttctagcctaattgcactgtaatcggaatgataggggtgaactgtgcaagcacatgtacgtagcatgtagtagcaatataacctgaaagttgtggaaaagctatatattgggacattgcagcttcactgccactactgatcgatcatcacaaccgaaaaagaaaagattttgctggatatttaactatatacactcagctaagctggagtgaccacatgggccagtttggatggtgtgcttttgatgatgttatgtattccctcccaaacctgcaagctgcatgcatgcctattctgtgtcttaagcaccttggacaagcaactaattgaacagctcgcacagagcaatcggcaattgcaacattccaaattaggcctggtttagttccaactttttctttaaactttcaactttttcatcacatcaaaacttttctacatacacaaacttccaacttttccgtcacatcattccaattttaactaaacttctaattttgacgtgaactaaacacacccatatcaacaatgaatcaaagttgtccatatgcatgcatgacctagaaaatgccaagatctctgcaagagacagcccccgtgcagtccaaaatcaatctagctttaagctacagttagagtttgggttaatttgtttggtagcgaaatatcattcgaccatgacatgcatgtggcgaaccatgcatatgcagtttgcaaaaaagatagctacatagcgtggatggaatacttcaaaagcatatcaaaacgatacgatatgcatggtgtttcagtactacaatctttcaagaggaaaaacaaaaacttcatgtgggggcagggagctgcagatgcgtgcctcttcacttccagagaaaactaatggtatgtcagttttaggagctaatacacactgccattacatgtgttatgataaggattttaagccgtttgcgaagacaatttaggtactgctccctctaggttaatactaatacttattgttttgagagaaaaacacggtctaaaacacaacttcagtcactgttttatattataatctatatagaaaaattattaaatatatgattttatatatgatgttattataatatacctagtcttcatatttataagataaatattttaaaaattatttatagttaaaaaaatttataatttgataccaaactcattcaaaacaataaatatcactctctccgtcctaaaatataagaatctagtatcagatataatattttctagtactacgaatctatattagaaaatatcccatctagttttacgtttttttatattttgagataaagggagtatcaacgagagatgtatgcttagcaaagcacatgacttgagtgatcagacacacatgaacgaaattgttaggtaactgtctccatctttgccttcaacacaggcatgcagccagtgtatagaaggagaagaaccctgcttttgccccccttgcagaggaacaagctatccaggatatactattgtcgaactccattccaatgtctacccactagtatatgttaactggatcatatcgagaaggcaattagttaacatactgccaagagttgcacatgcatacttcatatatacaccttctggttacttcatgtgtctgagttctctgaatttgcttaacccatacatatcattggactccggttaattacctcgaactttgtagccaccccaccccttgcatcgatccgcatctggtatttataagatttagggtttattcggatcagagtaatttcacaggatttttggaggaatactgtacataggaattttttccttttttttattcggatcatgaaaactggttgtaagaaatccaaagtaaagtttcctttgatgctgatttcacaggaaaagtacaggaaaaatccatccaccttgagctcattttttgcttcctgcatgcaaatcctaggcaatcaatttcctgtgatccgaatgctatcaacttttgtattcctttgttattcattcctctgttttacacttagggcctctttgaatcgcatgattgagaaaacgtaggaataggaaaaacgtaggattttgataggaatgtaagtgtaaaacagaggattgtaaaacacaggaaaaacacaggaattggatgagagatatagactcaaaggaaaattagcaagaggttgaagctcttgttaaatttcctccaaaatctctataggattgtccattctataggaatttcaaaggattagataggattcaatcctttgattcaaagggcttcataggaaattttcctataggattgaaatcctctaaaattcgtatgtttttcctccaaatcaaaggggcccttagattcctttcatattcctatacttttcctatctatgtttttcctatcctataatccgaacaagcccttaatgtctatacatacaaaatgagtatatatgttgcaccgatcaagcatgtaaggcatatattgtaaaatcaaaggtgttttttattattattttgtgatgaacaattggcattggagattatcagtttagatatttggaatttatttgcgaagtggttttggagatgattggatttcataggtgatatacaggtactgtgctggattgggtacggtcacaccgggcacgggttgccggtcagaccggcgtgtatctcgcggtcagaccggcgtagcccacggtatgaccggccgactctgtgtcagtttcggtttcgggttgtttgtttggatatccgtgattgtttcatgattatgacttctagacggatattatgtgtatgaatattatcgtttgctactaatgagtcaagttggggatagcttggtctcggaatatggtttctttctttgttctatgtgtaggtgactcgagatgtcgggagagtatttgcggtgatggaccgggagtcggcttggggataagacgacgtccgtagtggtcagagatcatgcgggatactaaggctagagttcaatacacgtggttggtgaagattccatatggcatacgatggaggtattgtgtgtgaatgggatgcagagtcgaatttggaaggagtccaaatttggtatgattggttatgtaaagtttgtttcttgtactagagggtttcctagggtgattaggacttctagtatgagtttggttcgtggctttaggctgcctatctcgggtataaatagagggggagtgtgaggcttcccagtatcgcttttgagagcaattgagttgatagttgagttagggtttcgagtttagtcgaaatttttataaggagtgttgttggtgcactttgtaaacccagagagaatcgataaagtcgtcatccactttaagagttcttcgatttgtgtttcaccgggtttcggcgatctaaccggcggcgcaccggcggtcagaccagcggcattgcgccggttagaccggcgtctacgacaggcgacaggagctgatctcggcggtcaaaccggagatacaatctcggtcagactgacggcaaccaggcgatcagaccggcacatctacttcggtcatatcgcgatccgttgaatttgaggtaacttttatttccgagtttcggtttttgggtataccaaccattcaccactctctggttggcttagttgttctgattcgatatatatatatatatatatatatatatgctcatagcaacagcgacagatgctagtgaccatagtatatctcacacgaacaaattagtaaggtatatacgggcaaacatactcaaccgattaacgctagtggaaatataggcatcagcagtttataaagaagaataaataattgtacgcgttattttactatctatattctcaggaatagatgaatagtacatgatagaatagttctcatttgcccaccagtactgcaagtgactctgactacacaatatgtcaattgtcaatattcttccaaatgcatgtaatagtctttagaggttttctttcgtccttgagaggtatatacctctcattgtctgagagctaaaaaaaaataaaccattaaaaagcaagtttatgattggcaataccaataattttcttttatcgtcaccttatagtatatttgttcataggtcagagatatatgagtaattttacggtccttgagaagatacctagatggagtcatagagtatatagtgaaaagcaagtaggctatgttcgatttagatgttagagcaattatagccctatggcttaccggagaagacactccattactgcataattaatatatatagacatttaaaatatattgtttttacaaaaaaaataaagaataaaaagttttttaaaagaaaatcgtactcccttcatctcattttaagtacagccatgattttccgtgtacaattttacccgtccgtcttatttgaaatttttttaaaaaaaataagattcatgttttatcatctcataacagtaaaaatactaattataaaaaaattaaataagacgaataatcaaagttaaacacgaaaatttattattgcactttgaataggatggagagagtactatttagcatttaaaaacgtgcatgtctacgataatatggtagttcagaagcgaaaagaacatatatggctggttggctggctggctagcttattaaccatacgtacgtgtttcgtggacaatatccataaggctcacatggttattttagatgtagaatattctgatctagtagctacttgtgtgaactattcaattgttccaaagtataggatgtccccggcatatctccctgaatcatttcatctgaatcaaagtgaattattttgccagcatatgccggaccagctgctagctgatcatgaagcatttgttctagctagctccaccgtgcatcttccaagatttattttgtgcgcatcttagccaaagaattaggatgaatgtcgtttgttgcaaggacttggatacatccgaaagaatagttacaccttttccccacctacaaatcttgacgagctaatcatattttgggaaaaaaagaagcgttgatcacttgggaatatctgtttttagtttccagtactctagcttcatccatatcaattttcatgtgaaaatactacctcacacgtgtgatttaagagaataaatcacgttaatgtctaattaactttcaaatcaatccgtttcaagatttgtgcttcacaaccttttgcagcaccagcaaactctaacgagctaattggaggtgttcccttgcttagataaatatcctgtataatggcagctcactagtgtgggccagtttgggcccgctgacaatgagggaagctctcgccgtctttcgagtggttaggaggtgtggtgacggatccggcagcgggaacgacgaaggaggatgaagatacgatcaatgaagtccgagaatatggaagatgagggttaggagagagaatggaaggtgaaggcggattttgtggctccataagggtggttgcatgggaacaccagctgatgatgatggagaagatggcagaggggtgacttattatttttcttaagaagggagagggattacgcaatgtatagattgttcttttttttttatccatgttttactgtacatatatacatacaagtcttatcataagtctacgtcacattaataaaacttgggtatagagcatagatcagtatatttattgaaagaaaaacattcgaaaatacaactatataatcagtgctaccaaaatttgtctagatgggtttaaatataaacatatcctatatatacaagtcgtcatatgtacataccatgcatatcaactaataaatatcataaaaaattatacatgcatgtaatttcaatataatatatagtattacatctacgtgtaaattcccatctttaaattcatcgtacatagagaacagcaaaataaacaaaactgacatatttagtcttaaaaatatcagaatttttaatcatggctaaaatataatgaatttaagattaagactttagatgtaacactattgaagtatttcttctttattttttgacatttgttagttagtttacacgtgaaactaatatacacatgatgtgtttccggtttaaatatggtcatttgtacaaataaaggtagatcttaatcggcaacgagaatgaagattagaaggtctaaatataaattagtacaaattatgtgcttagcgaatagcaattaattaagagaaatcaacatgttatcagaatatagcaatatatttgtaaaggcttaaaagattatatttaattagagatgtcgaattgagtacgtagtatgtgggagatgtagtttgacaagccggtgctttggtatttttggcagtaggtcattcaattattatagctttacatgctctttaacaccttagaagactgtgggggaataactttgagttgattgtagaagtaaaagtggattaagtcggtgtgtggctaagtcttagctaggcatgcaaagaatatgttcgtccaccgccgcctatgacgcatatatccatcctgatcttgccgctgccccatgcgtccaaccgagaaaaccggctccttaaaccttaaacaaaagattaaaaaccggtagagatatgcaaataaaatcatcagtcagagaaaaaaatttgtgctagtcaagtgtggtgatgaggttagtttgtcgtgaccgcaagacttctatcgtgacttcgatacattttgatcttgtttctgggagatagaatatacgtgtaaaactgctaaaaaattagtgtacgtttccgggtaaaaagttttaaatataaatataatatactgtaatgtaattacaatataactacattgtaatctctaatgaataaaattatatatttttcagtacttacatacaaacaagttacttcgtatattataagttaattatatactatagaattatcattccgatccctaattaccacgatccattcagatcctacgtggcgctcgcgcgttgcatgccacatggaaacaacagtttatatataaacttcaaacaatatgtttttatttgatattgttaaaaatagattattacaaattttaaaaatagattgattgatattttaaattaactttatatacaagctaaaatctgcatctgatgtacacgcagatgaagatgcgccggcacccaatcccaccacagcgaattaagcggatccaaagctaataatactcgatccgctgttagtgttagccgcgggcgcagcatttgtctgcatcgttcgatcggtttcggcttcattcattcatgtgctcccccctccccgcccacgcactagcggctgccgtccacgcacaaaccacgtaagcacgcaccacctcgcgcggtataaattccccgcgccctccactcattccattccccaaccccaaccattcctatttctaaacaacacacctcctctgcacttgctccttctcttcttctgtccatcgaatcgacaagaagaaatttacaagcaagaatggccgccaaggtgcatcctaacgtcgccgccgcgccacagccaccctgcattagcagcatcgtctcccaacaacaagaagaagaggagcccccggtggtgctcacggtgtggcgcaagtctctcctcttcaactgccacggcttcaccgtcttcgacgccaagggcaacctcgccttccgcctcgactgctacgactccaccagctcaaggcgcgccgacctcgtcctcatggacgccgccggcaagccgctcctcaccatccgccgcaagaggatgagcctctccgacagctggatcatctacgacggcgacggcgccgccacctccaccgccacgccgctcctctccgtgcgccgccgccgcgtcggcctccgcgcctccaagtccaaggccatcgcgcacgtcacgccgctctcctcctccctgccgctcccggaggcctacgtggtggagggctcgtacgggcgccggagctgcgcggtgcgcgacgcccgcggggacgccgtggcggaggtgaggcggaaggagtcggtcggggacgacgtgttccgcctcgtggcgcagccccgcctgggcgcgccgctcgccatggccatcgtcatcgccatcgacgagatgctccgcggcggcagctcatcgctgctgcggaggacatgctccgcgtaagtccaaaattcttccttctgtacagtagagacattgagctcgctgcaaggggatcagaagctcggggtcccacctgtcagcgactcagaagcagtgttcccgcagcagagtctagctagatgcagggcactaaacacccagaaaagaaaagcacaggaattatgacaaacttattagagttggtgctgtatgctacaatcaagttttagctagctgctgggttacttaagcatcatccatgttgataggaaattaagcaggactgatacagtcaggcttgtgaaagtaaagcacaagtaggacaatacatatagatacagcctagtacaggggagttctttttttttcttccccggatgtaatattacaaaagattattgtttattattatatggagaaatggaactgcttctccttttccttcctttttttttagtgatctgtgtacacggctagcccatacagcagcatgttcagtgtgtgcgtgcttgaccgtctatccgagcgacgagagaccatttctgtgttaatcagatgtgagtagtaaacagatcctatctccagcaatattttattttgtttagaagtgagaatccttattattaggcgattcttctgctagtatcatattgctacccactctttgatatgacacagatcgatgatggatggagcagagcttagcttggaagtgcacaacccttgacagagatgagtaacacacattataaacaacagaacattattcagctgaacatacaagatgttagcagctaacatgcacttgacctgctactgttagtcccagacttgtgccagctgatatttcttgaaattaatcccagtttgttaatttgtttcaggtctcattcactgtgttgtactgtagagccactcgatctgccttgttcatctcgcggtggagctagtactaccaaccgatctagagtatctatcacgttttaatcaccattcattcttgtttgagacgatgaaagagagaaaaggcagtagatgcctcaaggacgacggatcgaggacatccttgtcgatgctctgtcccaactagagtagcttatagctcgatgaagacacatgcatctttcttccggccgtgtggtgtggatgtggtccttgatttgtttgcgctagaaattcatcgcttccgcgtaatacagtagtactacagtatgagagctagatggaaaattagacgaaataattttgtctatagactgtgcatgcagctgagaaaatcaaactcaacatcgtcatcatctcatcgtacagagagaaaaacaaacgcatgcagtgtccccgcccccttgcaaaacacaaaacacatggacacgatgcagactggtttaacacagagttatccctggatatataaaaaaaaaaaggttggacccaaagaaggacttagagtcaatggttttagtaaggaagaggtaaatttttcctgtggtgagcgcgctcgacaagggtcgaacccgggccagcggggtgcatgccagcgaccctgcccttgcgctaatagcgcatctctatccctggatatatcagtctttcaagtgtaacttttgctgactgcagatcgagggtgcttaatttcttcatatcattaaagggtaatttcatgtgtaactttttctggacatgtgcacttcttttattcaagggaaagggaaggaactcagccattcaatataattacaggaggtgaaaagagcttagaacactagaggaaaacacattattacaagctgaacagccaagaagctgatggagcagctagcacaactaatttgacgagtgctccaaagtgattactctggggctggtgcttgtcgtgcttcttctctcgcttataacaaacttctttgccaaatttgctacatcttcaaccgtaccatagacactgttgaatatcctgccatttcgttgcaaccaaatgctccagatcgtttcttgtgcactttttcagacgataaacagagaactctgcactttctcagcgctttctacatgacgatgaacagaggatcgtgcactttttcagcgttcgactacttggtttagttctcgatccattcgtttgatacatatacgtatgttgtggagattatggataccacatgtccacacggcatgtatattcgactgggtatggtggtaccatatgtagatagaatatatttaaggggctcgagttatattcttaacctgtgtatcaaggaaatactcgagattctagtcggttatgattgtattttatctttacttgcctattttgctaggaatatgggctgtatgttataatacggactcctctcactatataaggaggggtccgggtgcctcttggggcataacttttcccccagatcatacgatcaataatacacttggtggatcaatccctgtacatgagtagggtattacttctcattgagagggcctaaacctgtataaaattcatcgtctccaaacccatccacttttcatgcttgatagccacccctttttgtattgccgaaatcttgtttcgacatatgttgacttgattgggatactgatctggactactaattcacaggtcaggcttcagagggagtgccattccaagtttccaacaagccaacaattaccactgatcatacataaacagaggcaggaaatgacggatttgagcgacggctagcccagctttttcatgctgaaaattttaggcggattcatcgaagtacttgctgtacagaaacataatggatgcatgaatggctgctagacttaaatttctgtctgctcattcaatccaatattgatcagagtgtcattttcagtcctgctcctgcatgcgccactgtacgtgcatctgacctttggcgaacttttgcgcttttagccgccgaaattgcccaactctttgagagaaaaagttcggttgcaatacgttttaaggaggggccaaagtcatcttcttgttatactcgatctgctcatttcatgtgcatgattagaacaaaagcacgcgaactgaacaatcaaggaagctgccatacaaatacgtactacggtactagtacgcgcccttctgtaactccattctgagtttcaagtcttcaaaaaattaaagtggcttataatatgaaacgaagggagagtactagttaccatattcatgtttacatcttcactgataatatatttacatgcttctcccttcgtttcacaatgtaagttattttagcattttccatatttatattgatgttaatgaatctagacatgtgagaaatgctaaaatgacttacattgtaaaatagaggaagtagatgctacgtacgaagtactcctaagtaaaaatcatcatgctagagaaatacgtgatgtcggtaatcctggtggtgatattctcaaaccagacatgtacagtaaactcaatagtcaatactatgggtaaggtatggattgagatccggtaaggtatgcatattctcgaacatgatcagtcactgcatattcgatcgatctcctaatcaagatgcattaacaagataggttcgaagaccatttgctgaaaacctaagctagattggtccttcttgcatgatgatatcttgagaaatactccctctgtttcgaaatgtttgacaccgttgactttttagcacatgtttgaccattcgtcttattcaaaaacttttgtgagatatgtaaaattatatgcctacataaaaatatatttaacaacgaatcaaatgataggaaaagaattaataattaattaaattttttaaataagacaaatggtaaaacatgtgataaaaagtcaacggcggtcaaacatttcaaaacggagggagtactaataatcgtaaccatccttttcccttgtgttttttgctgactggttgtgctctttaattatcactttatgcgcacttttctttgacgccttccacaattaacatgcgcgcgcgatgggtggttttgtttatatagtactccacactattgtacccgtatgatggcaatactagtctgactagtgtttgctcttcatctagaattgttgtgtttctgtacagtagtatgcatggaaagcaaagaagttgtggaaatgcggtcatatgcttggctaggaactgaagagatagcaattgggatggttggtttggcgtctaaataaaccacagcgtcctggaattgtgagtcatgcgtgatgcgtgattcctccagtacagaggagagagctgatcaaggaagataactcgagacaagccagtcagctaggatacctaatattccctcttggggctcctacaacgtatggaggaggagaaaaacgtgtcttgtgatcttaattgcgcagaggaagaacaaattcacctccgcctccgccgccgcgccgtgtcgagggatcccgatttatggatgcaaatcgctttttcggatcgtgattaatggtacggtggcccaaagcattccaggccctactagatagtggactcaacatgggccgaaatatcgggggggcctccgaaagcccatatacaattgccttacctgtccccacctgtcacatgcctcacgcagcagagctcaactcaagtcaaggcggcatttcgaaattcgaaaacaccaacggtttcaaatcctcctcacatcttctcttcccccaaatccctcctccccatcgcggctcctcctccggcagccagccatggccacggtcacgccgggggtgctgctcaagctgctccaggcgatgcacaccgacgaccgcgtcgccggcgaccaccgctcccccgtcctccaggtcaccgccgtcgtccccgccctcaccgcctccaccgccgactccctctggccctccaacggcttcctcctccagctctccgacggcctccactccacctacgtccagccctcctccgccgacgccgacgccctcgtctccgcgcgcccgcaactcgtcggccacctcgtccacctcgaccgcctccgcttcgcccgcccggtgccccgcgccgtcgggatccgccccgtcccgtcctctcgcagcgtctccttcgtcggcaacccggagccgctcgtcgcccgccccgccgcgtgctcccgcggctacgtcatccagcccgggtcccactccgacgccgcgccgccgctcatgccatccagttccggcaatgcggcgcagtccgatgcaacgaatgccatcaataggacggttctcgcgcacaagaacgtccccgaggccgcgccgccgcccgccgtttcagccgccaagaggcggttctcgtctccggcgccgtccaagcagcgagatccgtcgccttcggtcaagggcggcgcgtcacggccttcgtcgccctcggtgaagggcgcctcccgagcgtcctcacctgcggtcaggggcacgcccagggcgacgtcaccagcgccgtccaaatgcgtggtgcccagccttgttgcggccaaggaggagaatcgccgcacggcgagggagccggcgattatcgtgccatcaaggtacaggcagccgtcaccagtaggagggaggagaggggcggggtcgcccgcacccggtgggaggcgcgcgtcactgtcgcctagctcccggaggctgtccggggaaggtagcagcaagaagaaggtcggggtgttggtggctggtatctccaagatgacggatttgacgaatgggtcggctgttaagccggggaggaagagctgggacaatacctcaatcgcagcagcggctggctctgtgatgaaatcgaaggtcaaggtggataagagtactattctgaggacacaggtcaggatcatgtttcatttgtgttgcaattgcaatcttggaattgcacttgctatgctactattgctatatagttgtacatgcactgcacatttatcttgttgtagtgaacagacaaatagtacaactctactttgaacaggctaatcgtagtgaaaacagtggttacttcaaatgcttgattcagtacatatgtgaaaaatggcatggttttcttgcagttacttaaaatgtttataagtttattgaggaaagagagaattgaaaacactgttatttattttctttccagatacaatggcagctagtttgtaatctttgaatttgactcatggacatgcccttccctaccatcatcacattgttgtgttactgcaggaagcaatggcaagacgactgagtgatgttacaacagaactatccagtaacgatgatgattcatctgtagatgagaagccaaagccacggaagaagatagagtcacctgcagtaaagacgaaagcaatggctccaaaaattatgcttcatgatcctaaatggaccgatggaagcattccattggatggagtttctgatgtgctttcaaagatgggaaaggtaagcactcccaattcatctttgttagcaatgatcaagtcgcagttcattgatccttgaaacaccacatcttctctgaatttgcaggaagccactgaacgaagagacgcagcagcaattgctgcagctgatgctctgcaggaggcattaatcactgaatccgtaatcaggaacctaaggtaattaaaagccgacttgtgtccccggaatttcattcagcacaaaagtggtttttcctaacactcagcttgctattgtccacagtaaattttctgaactaacttcagcatcgaagacctccaatccccttccaacagttgatatcttccttgctgtctatgaggatactctcaaatggaagaaaattgctgagtctatatccaccaatagaactgaaactgcatcatgggagaattcagttactcattgggttgaagcagcattggcaactgatcttgaagtcctaaagttgatgaataaggcacctgaatcgctctctcggaaaaggggtgctgataagccaaaggctcccttggtggtagaagctccaagaacaaccatatccaagaggcaatcacatgggacttctgcaaaggtccagtcaaaggtcttaccgacctcttcagcgagctgcgcatggaacaaaactcagggcgtgaatgagacggctgagcttgccacgaccttgtgctgtgagatgcatacgtggttcctgaaatttgtggacgaggcaatggatttaggtttccacctttttgaagatcagaatgttgcaagtaggggaaagcagagcagccacataacaatggtactgtcccagttcaagaagatcagtgactggttggatggagtaggcaagattgcagaagaggctacaactaaggataaggttgagcagttgaagtgcaagatttatgggttcgtcatcaatcacatgggatctgcatttgatagctcggtctcgatttcatcaaggaattgaggaatgcttaaagtaagcctttaagtttcttctcttgtatttttgttcattggggatgggatcaaagctacataattctatgacgagaggtctgctacagtttgtagaagctactccttcagttattacctttggttttgccttgtgaataagttgtttgtgaaatggttcttgttttatcggttacaattatgtacacttgatagtttagcttgctgtagtctgagtgaatgactgacttgttaaagctacaagatatcattcttacatccttgcaaatattgtgctaggattaatggtatgttaatttgattggtgcccaatcttttcataacaaaggttaggcaaatgcctgacatgccacaaaaactgtagctagtacaatatgtgccaagtatatttggaatgccgacacattttgctagccgaagaaggaaaacaaatcttcagttgctagaggtccttccatgttgctaatttgctataaatgctggtgaaccatttggtcagaatacatgaagctgtagaattccctttcttgtcgaaacattgatgaaggataggtctagctcctgaacctttcagctgactggtcctaatgattagttgggtcactaatgtcaaagagatgctgcacctgattatggtagtatacaggaggtattggtgccaattcatcttttcaattgaaatttgaaagggacccatagaacttgacaaaaatattttatttgatgcgcttgacgcttgggaggctgtagggtgaagtaaaatcaaacacctacagagaactccctttgagatatgttattgtaaactgattgactgaggcagaaatgccaaattgtctaccggagttgaaaaggagttttatccaaactagtattactatgatactactagactagaattattgaactaacagtcctcaccaaattgaagtctgtagcagttgtttctgttcctttgttttccttgatgtggttggaacttggaaagctgatttgcttgaacatgaagagctgaacaaagacagccctgtttgtaacaaactagtaatcagataattcagccgattactacgacaattcagctgtttggttgtgcagaaggtatattgaccatgcagggtaattcggctgattgcatgaacttgtttggtaaaaactattgtgtataaatcgtgctccaaactcttgagcggatgctattagtgggtgtttttgattggacaatctgagcggcgagtagtgcagtactatgttgtgaagaaacactagtgctgggtgctgctgagttgctaaaaagtatgatatggaagggaagtatggatgtggttggggcagctactgtcccatgatggtttgtgctaatgaaggatggggagttgattgcgggagggatgagtgtggacgcaggcaggcgttcatagttagtgctggatggtgacaggaaacggaacaggaggacttgagagctgggcctaatgtgtggtttgggccgactaaaatgctaaagcactcccttctgatcgtacttgtgattgtagtaattatgtactagtaacgaaaattctgtttagccttttcgattaaaaaagaagaagaattaaactgatagcggacgcactggccgcatcttgtattcttaccaaaaaaaattccatgtcgttgttgtttaaccgccagcagtggactacttttaccaccggtgcacaagccaaattctgagacgcaatgcaacgacgtcatgctatgcttgcagagttgcaggctggtttgtgctgcgcattcgcgtcaacactcccatttattatgccaactaattccaaacaccagcaatactctcctcattaacttcttccgcgggacgagagagggagagagagccaaccgcgcactacttgtacttcctcatcttcctcttgctattaatcgaatcaaattactactagtctcccttccacgccacgcacacgcacccaatcccctatcgatcgagagacatggcctccaccaccgccaccgccgccggcaacggcagcggcagcatcctccccacccacaccaccacggcgccacccttcagagcccataaggacgccgacctggaatccacgacgcggcggcgccggcgacgctgcctgtgctgctgcctgctcgtcacccttgtggtgctcctcgtccttgccatcaccctcctggtcctcttcctcacggtgctccgcgtccgcgaccccaccacccacctcgtctccacccgcctcaccggcctctccccgcgcctctccttcccggccacgtcggtccagctcaacgtcacgctgctcatcaccgtggcggtgcacaaccccaacccggcctccttcacctacgccacggggggccacaccgacctcacctacaggggcgcacacgtcggcgacgccgagatcgacccgggccgaatcccgagccgtggggacgccaacgtcaccatggcgctcaccctgcaggccgaccgcttcgccggcgacctcacgcagctcgtctccgacgtgatgggcgggtcggtggcgctggacgcgagcactcggatccccgggagggtggccatcctgggcgtgttcaagcgccacgcggtggcgtactcggattgccatttcgtgttcggcgtcacggagatggccgtgcgtagccagcagtgcagcgaccgcaccaagctctgattgatcatgtgattccaacttaatttgcaagtttccaagcacgcaacgtaaggtgggcatgccgcatcgcgacgtgggacaagacgagaagccgtatgatatgctgctttgttacgcaggtgcactgcactagtagtacatagtagagtattatattctacacgggcggcacattagttcgttacagatagtatcagatcaggaattcaggattcagtgctacgattttcttcaatatttcttactgcgtgttgggattgatttgattcatgtatataacacggtgtcagtttggatatatatacagtaatttcactattctctatttcttcaacgtatgcgcccatgatgtttactagcgactgattcaaaaattcctaatccaagcgccaaacttcagttaaacagacctttctcgacagcatgcccacagcttcaagctgccaagtgccaacactcacagaaaactcggcccggtgcaaaaaaaaaaaaggagcatatcctgacttctttcactagcaaatactgagttactaggatttaggaccctcacatggtcaaacaacaaacatactaaacattgttacaggtttcaaaacatataatgaagccacatgtataaaccaaacggccatttccagcggttttctgtttaacctcaccactaacagtcacatcaagcaagcagcactttacattatcaatcatgattttcactactccgctgcattcatcacataaatgaaaacatttaagcacggcacaccatctcacagttcttgtgaaagaaaaatgaactactattgagcagcattcagacgatccacatcatgaacctgcaacagactcactagttcaaccagacacagctatccattttaagacttacaaaaggtacgtggtcacagaccacaactcctaattgtatatgactaacccacccaaaaggaagactgattaaagcttacatgtataacttattaaactgcctcctactcctttagcatcactacctacatgtttcagttagcaaagttaccatattggcacagggcaactgaaattggtagccaaaaactgccccaaaatgctgttcctgggcagatcaaaagggtgtcaagatatcacttattctctttaacgaataaacaccttggactgactgaatcaaagtcgagctttcgacaaatgcttgggctgagctgtaccgctttaagaggtcgcctcagtggcgcatctgggcaggtgtctgcaatgcctgtaagtagaggctctgaagaaggggtctcacagcttctaggtgaattagaacctatcagatcctttccagtcgtctctagtgcttgatttgagataatcagatcaataaacatcatgcagatccgttcgagaaactgatcctcctcctcagcatcatcgaattcaaaacttaaccttttaacagggtaatcacctgaatcaaaacttagctgccttcgcgaaggaagttctggtgccttggtcaccttcttctttggtgcacaagctaactcctctggtcctggagcaaaaggatcaaagatgctttcgcgcggtgtctgacatccatatgaaggatcttcatctgcaacactttttgagatatatgattcaatcgcttcattctctggtggtgtaatcacctcagcaacaccactcttgttattttcatgatcacataccatgccaagggatcttgtgtccttattttcaaagggagattgcacagaaacttcttcatctacacacttttccaacttttttacaacagggaaatcacagtttgaaactagcgaattatcagtaacattcttatccacgccttgatccatttgggagtaatgtggactcaacctctcctgtaacttgcaaaatgaaaacctacaatgaaataaggaatagaaaatttaaataccacaaactaaccaggacataacagaaaatgatcaccgaaacaaacaagggacacccaagaagagtccaaaaggtttctaggagaaaataaggcaaaaagggtcataggagaaactaaagcaaaattaagtggttatcgacaaaacactagccccaaatgtaactgcaactgctatgaatgtaaaatgtgttctaaaagactatgcaaggcgccaaggtagtcgtcagccactaataagcagaacccagcttcaactcttgttagaagccgagtgaaatcactggcatcatctgatctaatataaccgaagccgtttttgtcgataaccgtttttttggccacatttcaaactgttcaaccatcactctgagtccaagtatgtatacaacaattatatatgtttctttacttctgtaaaaagatatcaattaaccatcaacatctattttataaagcaccttccgactgtctaattggataatggggaaacctaaaaaataaaaagctttctatgcattagctccttggaagaccttcatccacactttttgcctactatatatgtatcaatggtttatatgcagctatgactcatacataaaagattaaaaatattctctatagccagcgtttttccagtatatctacacttgatctcacaagtttttccattatcacattttcctgaaacatagtaaaagtaaacaggataacctgtacctttgaaatagtacaggatctgagttgcagagatcaggttccaagagcatcaacacttaatagtagtatgatctttaccaaaagagcaagtgcagagtgtatcggtttcatataaaaacttgatcatgtcaaaatcaagtgtggttacctaaaaaaatgagtacatcagttgatatcaaaagatgaacaaggaacttgatagtatttgcctgacatcaataactcgaaaatgtagcaaatatgtgcagaaatttgacatcattgagcctcatttccagcaggtaaataaatgcagaacaatggcctcagatatatgaagaatgtgaagtagctactgtcattggtatctgttctttccagtatctatcaaatgtagcaaaagaaaaagtacaaggaaaaggaaaataagaccaagtgtaggaaaaaagaaaccgcaagaaaatgagaacaagtgtagagcaaaaatctattcacatgcatcacaaacagcagcatatatcatcattggccatctttcccagcctaacagcacgaaaaaaagaacaagtgtagaaaaatctgttcatgtactcttataaattctgctcagttcaagtgtagaggtggcctcagttctgctaagatcatttgaactataaaatactgagaaagatcacagaaagacagaaacttagaaagggcatgtttggttgcctgaccttatcgaataaggtcaagtgcgggcatatctgttcttatgcatcacaaataagcactattaatcaagtgtgtatctgtcagtatcaatttaaaagaaggcactattgtatccggccttatcagtaacttgtatttgtagccaaagatacaatggcataacacaaatcaacaggaaaaataggaataagtgtaggaaaaatgaaaagcaagccactagacatttcattccatcgaaatcaaccaagaaagatgtcagcttttagtagatctagcatatttatgaaggggacacggtcggtctaatccaaacaaatcggctaaaatcgaaggaagggaggagaagacaacctagcccttaccagagagctcaacggaaagagtcgacgaaagagaggggcatagcagagagacggagagagcgaaccagtggaagagagcgatggcggctagcgaaagagagggaggatgcagtgctgacgacgaccggccctcccgccactcgcgagtcggcggaaccctagctttccactggtttggaacaaatgaggagggatggtggtactggtgagtggtgaccccatccatggcttctgcaagagcaggcaaatctgctgggaaccaaacacgtacacgccctaactgaacaccacagtgaaatactcaaagttgctagtattataatggtactaatccagagatccaaatgtcaaatacgtgtggtctctacatcaagatctattgtagccctattgggtgtcttggcttgcgcatgccgccgctgaataacaccataaaccttacccgagcgctcgcttgacggcgacgtggtgcgctaagaagtttggatttgatccctcacaccacaaacaaaggggacaagactacaacagatatctaattaagcaaaacagggttccttaccaacaaaagaagaaatcaatccaagcccggatggatcttccagtccaacccaatacatgagatggggagcaaaccggataagagttccttgttggcgcacctagaaattagaatcacatggtaaaagaagtagatttagggctttaagaagtgagaaaagccgaaaaatcacatgaaaaaaagagataaagctcactagaaccctaacatgtgaaaaccataaaaaaatccatagaaagaagaggagcattttggatctgcgtgagagaaagattgagaagtagaaatggttaagaaaatggaagaaaggaaatacctcgcggcggctctggattggggcacgagattggtttgggtggcaccaaccgggattgggatgaggcctcccgccgccaaaacaatcccctctattaaaataaaacaaagatttcacaaaacaccccatagaatgtctcatttgctaattttattcctttgtacaacaactagcgaggagcaaggcagctctgctggaccactgaggaatatatgtgaaaaataaagaatcagtgggttggagagtaaaatgcaccaaaaggagggaaaactaatttgggcgggcaaccttggcgcgcgtgtagcaatttagcatatccttcccgcgaaataggcgtgcctatacatatcatcattttggtgaaaaatgaaagtttcccactgcctaaggagttttttcttaggaaaaaataataaaataataatggtcgtgattatttagaaatctataggtgcaaataatcattaaatgagtgggtttcatgtgtatactatgttgaggctagtttgcgggttatcgaagatcataatgattaagagacagttaattttatgttttcctggtttaatggaatttatctattgcaagcaaaatacctgtgtttcatgaccagtgaagaaaattataactttacataccttgttttgccattcatctctccatatgaaacacacctgtgatacctttgttccgtcatttatgtattcgtatgaaacacgccagtcaggttaaagaataagcctgtgagactttgatactcaattttaacagtacagagaagtttatgtgaaaatacatataaactcaaggcatgcattaaaaaataattgaatgaataacttttcataatattaacaaaatgaaagggttaaaatgaaagattgacaatgaatccaagatattttatcatctaatactcatagatagaatccgtttggtgatgcatggtagaggcattatccagcctctctcattgcagctcacgagggacggtggtggtgctcccctagccaaccagcccctctcggcacgcaaggtcctcccttagcgcgaggtagcagtg

SEQ ID NO: 66118 - DNA, 8823 bp, Oryza sativa
gaaagcaactaactttctccctttctctctttgtataaatcccgtaggaatgtattttattgggtttagtcccacatcagtaattgatgatggggagcacgacttataaggtgggggcggtcctcacccatcagacttgtcttttgggttgtgtgggcctaggacctaaagttgtgactccggttgggtctgtggtggagcaggcccagtgtgacctgggtggcccacggttggtggtttgggttgcgcactctaacaagtggtatcagagcccatatttggaatccggcacaatttccattggtcacatggtggagaggccaggtatcaagttttcggagtcacatgggttgatgtgacgagggagattgttgggcctgaggccaggtagcaagtctttgaggtcgcatgggttgatgtgacgggggagattgtcgggcccgatgtgtgacgggggagattgttgggtttaatcccacatcggtaattaatgatgggggagcacgacttataaggtggggacggtcctcacccatcagactagtcttttgggtggtttagccctagaacttaaagttgtggctccggttgggcctgtggtggagtaggcccaatgtgacctgggtggctcacggttggttggccgggctacgcactataacatatttaaaggggcatatagtaaaatctaataaaccgatcgattgataacaaccaccaccactttatccaaagatcgacagaatgcaatacatatatataatatactgtttcatggagatcaattaactcaatgcatgtacagtacggtgcatgatcatccatccgaattatgctttgaaaggttaatttctgtgcgacatatatcaaattcttttccaaaattgctaaaaagaagtgtgattttagattaaaggatggtcgactacacacagcctgttacatttttgtttcgtacataaggttcgcagaatgcaataagactaggaaaagaaaagctactacatctccaagagtcctataaacatgttcccaaaagttaaatttcataaaacccctcctataatatatggtccaagttgcacaaaaccataagatcttagtacatgacatataacttcaaaaattataaattatagttctaaaattttagagaacccaattttgtatactcctatattcatatttaaaaaagctttacttacgtgcatataacatttatataatggataaaacactcataaagttaattaagatgtgattgtagaacttaaaagtgtggttggtcaaagtcaaaatgatcaataccgtggttttgtgaaactttatggccagaatatctaaagttacgtgctacatgacaaaaatcgtgtgattttctacaacttagttcataataatattcttggttaagtgagatttactctttggtataaatcaaaaacaaagctctctaacaggtaccaaaaccctctcccaaattttaggcacgaccaacaacgctccaataatcatattcagatgagaaatctcttgggtatattggtgcgaactggagctcagtgatgacacaggtagcagttggcctgtgtagcaatttgaagaaatcgcagggcaaaatcagaacttgtctctgataaaaaaaaattgcaggtgcacttccacctagttctaattccttgatgggtcggaagaagaaatttgtgcagaaatacagcatttaattaataacattaagaaaaaccggaagttctgattggaacttgtggaaacttctgacttttgggatcataaagagctcaccgtttgatagtgctaatacaatctgaacttccaatttgaacatcggaagttcctaactaggttttatatttgaaccattcacatcttatattttgctttaatttcctaggttttggaaatttaatattttataattttcctatagattgttccttatctctaagaaattgatttaatcttcagtgattttctcataattaaatcacttgttcgtcacacaaaacatgacatgtcctttcacaaaatgtgattatccatcagcacatcgcaatcaccaatgccaccaccaaagctgtagtcactggaaccgctgccgccgctgtccgtcaactactctccgctgttcgcactccatccatacaaaagagtgaaggcatgcacggctggaaagttgagcgggagggggataatacatttgccgtcatttacgtaggctcgtatttctttcctaatctttactagtgtgtcatttatctatattttagcttatataatatgaggtatgatcaaactcggtacggtctctaaaattaatttttagcttatattttctcatattgtattataccaacagaaatataacctaaattcaaatgttaatcgaatgatattattttcagcaaataaaattcaattcatgttatattaattgttagttaaatgttttttaaaaattaaatcttaaattgcgcacaaatattatattatgggatagagaaaataatatctaatgacttgttaactaatttaatttatgtgtaattgacttgtttcttcgtttctaggttcctctagcattaaaattaaggacgaaaagacaggggcaatatagactgttcaaggaggttaccattcttcgggatggagaattcaatggccgatgcccctggttatgttgttggttacaaaggtgtggaactttctacttttctaacacaacgtacactctattttcacccaattattatgattccaattcctttcctgataagatctgtatttgatttgcatagaagatataattccactatatctgtcttgatatgaaacaataatgaattttcatatggaattctactgttctagttttcctacgcgattgaacattagtgtgttttgtcgattggctagagtccattcgatgtatctcgccaggtgtgcatgcaccacagctccatttcatttatccaatggttatgtgtacacatgctatacactgataaatactccctccgtttcaaaatataatcgtttttagactctgacatggtttccgatatgctactttaaccaataatatctataaaagaaaaatgttttaaaaaaagagttacatatgatgataatttgtttaataataaatctagtaacatcaattttatatgattgattttttttctattaataatcaaagttaaaaatatttgacttgttactatgctaaaaatgtttatattttaggatggggggagtatatagtatgaacagtagaattgtatagggggctagcacaaaatttgtgctagtgaagtcgtgagtacatgactccatttaccgtgcatcatatcctagtgccaacaagtattggatccaacaattacacttactacaaacatttaatacttcacggatttatacatgcatcgacaatacaatttcttagcctctccatgcgatcagaatgggaattactttcatttcatcacttccacgggaaatccatgaattgaaatggttaaacatagtatttgtgtaggttcgaatacaattaactaagcctacaaaacgagatgcatggtagattatgtgagcataagtataataatcaaactttgatagattaaaacacacccaatctcaaaagccaatagaacacacgtcgagcagcctatccaaccttctagggtcggtttgactgagacctggatggtctgaccatcggtctaaaaacaagtcaatacttctttaaaaatatgtgttttttcgataccaatcgttggatcgatcccaaaatttgacaaaatatacaatacaaattgtttgattaaaacaaaataacgaacacacggaaatagagaaaccctgtatattttattaatcacgattgattaatatgaatgtataaaaaaataggagggctcctgcacgagttctcatgttgccttcacgaggatacttaatagaaaggtacactgactggatattacgttcagtccgctaagtcccagtgcctacggaacacctctgattaagttgcacttgtgatcatggtcttccaaattatttgctcgccgaaggttgaggttggtgcggatttaatggtgtatggcagaacaagtggctttgttttgccaaacccggtcatgatcgatacgttattattacatcggtgtatgaaacaggtgtcggaatgaggggatgacttttgcctcgttggtgcctagcaacggtgcatctgttcctgtttgtttggacgtataaataatatagcaacctagcattgctagcgctcggtcataattttgtcgataatagaaaaatgtggtggccatagctttgtcagctttagccaatgcatcgtctggtctcatcggtctcggacatagagtcaattatgtatttttaatctccacttctccttgcatcttgcttattttgtacggaggatgtttctcttcaggaatttgggactcgctcctctagaatttaggatatgtggtcctacttaaaaatcttttctaaacatcgtaaatgtaacaatgttaataaataccatacaagtatagataatataatagatcaaacatataccttgacgtcttgctcttcagtgtgtttcctttaccacaatcgaggaagaagacaatttaaaagtattcttctttgttgtgtatttttttaaaatggatgcaatatctccatctttcttcatgtctccacagttagcaatctacaatatagtagtacaatttaatctcacaacgcataagaattaaaatttaaaactgaaaattgaaaaggctacacaagtagaagaactaaaacagaagtcgtccagcggcctccgattccgatacacaatgccatgccatccaacgcgccgagtcaccgatcgttgattcgatggtcagaagcagggtcgacgactcgacggtcgagtgtcgatggcggtcgtcgctcggccgttgaggctgagacgctatcgctcgacgctcgtgacagcatgactcatttgttgatgatgacgatcgacgagaggagtaatgggcgcggtcgccggctcgccggccgccgaggacgctgagacggagggagagtcagagaagtgggcacgcgacgcgggcgcatggcggacaacgaactcatcgtcttatctcaggcggcggcggcgaccagcggtgggcgtgggcgaaggcaggcgcgggcggcgctcgcggagtcgaggtgcctcgtggacttgcttcgctctcctgttgcgggcagcgggcagcagggcgcggcgaaaaaagaggagttgcgggggaggtgaaaaacgagtagtcaagttgaacatgcaatggcgcgtgtcagtctcttcagtctccaaattgcagttacgtgtgatgatttgggaccaggttttttcgttttctttttaatcccgatatatacacatatctgccagtggactcgctcccgacatgtgcaccataaaaacacgaggatagtccgatccgccgattagacatacctaagtttgcaattcaagaaggaaggaatgatctgatttctagatcgctcaagttgatgaagaaaagaggtactttgatcatccagtaaaatgacaaatttaccaaaatctttgaaggaatttattcaccacctcacacgttgataaattccctgtatgcacatcaaaactgactcaatcccttccatgccctccagtttaaccaatcccctgtgtaccctcgagattttattgtgttctctcccatgtccctaccattaggtatctgttagatctatcagtgtatacatccattacattgtcagtaatttttaaaaagaccaaaatgcctagcgaaaccctaggtagcaaccagcaagccagcaacagcgggaaatccccaaataatctccaatctctcgtctcccctcgacgcgggcggcgcacagcgccgccgctcttctttcgtggctgtcgctgtcgttcctcccgtggtgacatgtacttagtgtgtacctttcccctatatcatgagaaaattagcgtaatgacaaccttggttaaaatgcttagtcatattgtgactcttaagggtataatggacatctccaggtaaattaaccagtcaatgctgtgagaaataacggtagagacatgggagggatcacagcgaaatctcaagggcacacaaaattggaggacatggaagggattgagtcagttttaaggtgcatatagggaatttactctagcacatgatcatctccgcctgcgacatcagcttgatgacaagggatgtttgaacattgatctccactgcgcgcgcgcatggattggctgtgatttctcaggagcgagtctctctgtttttctcgtcgctgtgtattttctcaagtctccgtctctccgtctactgcaccttttaaacaggcagaggcgaggcgatggcgccctggcctaatcccttccgagattctagcacaagccagcgaaatccgttgattatctgcataacacgcaaggaggagcatatccacccgattgctaaagaaagtcacgtattactgctaatgacagtgggccctgcatttgatttttttaatttcttctcgctggagataatcagcgtaatacacgtgatcggttccaaccgagcaactaatactagtcaaactctcttatttgaacgcctgaaaactgtttaaactacgcatcaaatttaaaatctgttttcaccaacattttctattcgaaaagaacgagtccaattattgggtatattcggacacgtttattatttgataattttgggcccatatatcatacaatctcgctgcatgtgccaaaatattttttttattaatacacattgatgtttgttatttgaaatatttattcgataaattttaatataaatttttgtcaaacactaacccagaaacaactccaccaaagggtttgcaaactaataaatggtttaaggaaaacaccctcaaaagccagctatctcagaatttcaataaatgtgaactaaatgtcaaacttaagccaaattataatgtatcaagaaaaaaaaaatacacgaatccttccaaatccgatggatgaagtattataaaaattttggatggattaaacttgaacaaaattactgcaaaacgaagaatcacaagttaataccaagactggacataaacgcaaaacttaatacacactggtggagaaaccttctttcgtcggtcggccgatttccacaatagtcccggatgcaataaaaactggggctaaagatgatctttagtcccggttcaaaagggtaacgggcatatttgatctttagtcccggtttgtgttaccaacctcatctttagtcccggttcgaatgctgtcaggtcatatcaggcccccccgggatctttagtcccggttggtaaagatcgtaactttagtcccggttggtaataccaaccggggctaaagatcccggtgatctttagccccagttggtgctaccaaccgggactaaagtcccacccctatatatatgtcttcttcctccttcagctgcccgagcaagtttcaaaatttcttcaaaaaagaggggaggtcatgccaaaatttctattgaatttattttggtgattacatacaaatcggaggtgcctaaaaggtttgcaactttatcctccaatgttttttttgtcatactacatttgcacctatgttttgcacactttttttgtctccaaaatttagttgtaagttgatgagagagaaaatgtgtgtggggaataaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcaggtagatggatcggcaatggatgtacgctgaccggcggtccaaagagtttattgacggcgtgcactattttttgagagtggccgaagctaacaggcaaaggggttttatttgttgtccatgcaataagtgtaagaattagaaggagtattctgcatccaagactattcatttccacttgtttgagtcggggttcatgccaagctataattgttggacatcccacggagagtaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgctagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagactacgtacgaggctaagaagatagtctgcccgttaggactggaagttcataagattcacgcatgtccgaacgattgtatcctatatcgcggtgaggagtatgagaacctagaagcatgccctgtttg

SEQ ID NO: 66119 - DNA, 10466 bp, Oryza sativa
tttggatttcccatattcatgctgatcaccacacaggtgtagctagagttcttgctttgaggtctaaattgttaaaaggggtacctcacaagcccttacttgttattggaccaagaccacttgaaagatttctaaatgcatattcaacactcgaagatcttgatatgcagttcctagactgcaggcagactttaaagcctagtatagaggcttttctcagtgacaatgctactgaatctgccacatctcaacttggaagcactatatttgctcctggaagtaaaatggagaactacagccggaagcctgcaagtccaagagatactacagctctaactaatttgaaagatgtcctacatgaatcaggtttggaagttctttacagtgtcccagttctgcactgtccacaggcgtttggagttgttctgagagccaaggagaaggtgagcagtgctggaaaagctattccaggatggaaggttgtttattcaggtgacacgaggccctgcccagctcttgtagatgcgtccagagatgccactgtactaatacatgaggtaagatgaacataaatcttttggacaactaattccattattaccaacttgatatccactgccatttccatggtggctatgattctatattcctcccttttgagtgcttgccatcactgcttatgctccaaggtggtttccaaaagttcaatatattatttgagttatcagttctgttttttctgtctgtcctagtgtcctgtagtaaaatatttcactctccaattgatgtggacgacaactggccaagtgcatcaccaactaaccttgcatgtttttgtatactgttagctgcagaatgttctcttctaattattgatgatattaatcactagttaatggcaataatggtattgcgtgtctaaactgtgcaatactcgtttctccaggcaacatttgaggacagtatgaaggatgaggcgatcgctaggaaccatagtacaacaaaggaggccatagcagtaggcacatcagccggagcataccgtataatcttgacccactttagccaaagataccctaaaatcccagtttttgatgaggttgatatgcaaaagacttgcattgcgttcgacctgatgagtgtgaatctggcggacttgccagtactgccaaaggttcttcctcacctgaagctcttgttcaaagatgagatggtggttgacgaatctgatgagatccaggaggctgttatgtagtactgatataagatagaatagtgtacaacaatttaaatagaatgatttttgacctgagaatccaattgtagacagcgccatccatgcgatatgttactagtgaggccaaccaccctgcattcagatactagaatagctgtactgtcaatttttggcgttgtcttgtgcaataagcattgtcggcaatttgcaagtctcgtgtgcgttgaaaagcaagcgtgcgacctgcccttctaatttagtattttgatggacagttaaggctttgccgttacagatgatgcgttcaattacgtgtcatgttaatgttagtacttggggtttcagtgtttcacagagtgagtcccatttcagcctcacatatgttccacgtttctcactcatcaaggcaccatccaaaccccaattttaaattgaagatacactttcagttttaaattcttgaatttgtttgtttagttaaaaatactggactgaagaagtctttgattttaaaaggtccttaaatttcaactttaaaatcccagtggctttgtcccaggctttaactgggtgtgcgatgaatttccatttgcaggaaaccgacaatcttaggaaatgggatcctccacattagtttacccatttgtgcaccatttgctctgcggtgaccatctcgatcgctactgcaaaaatagtataacaacaaaatgtcactgtttgtggcatcaatctactatgttactcacaactataatgaaccgcagagaggatccatatcaagtggtatgtaagagatttaaaactagtagaggagagtattgcaaaagtactcgcgacacttgtctctataagcacgcctatatagattgagacaatataaattgaggggctgttgatgcccatacagattggtgaaattattgtcgatatctcgttgttgatgcacatgacatctaaactaaaaagaacaattagcagtaagtacaaagcattacccgtaaatacaaacattggtattaagtcaaatactctaattaaccataaatataagcactaacgttatgtcgagacttttttttaatgactcgcactagatagtgtgaagttcataatgatagagtagaaaaaaattacaagattataatcatgtaatgtcgtaacaaggaaaacgaaaaaagaataccaccatccacgtaccgataacatcaacacatagacataagagaaaagctagcaccgaaccggccatcgctaatcgtgaccagccgccgctaggccaataaaggaactacaatcaagatcgcccaaaacccaaccattacaaccgacatgaaactttgttctatccacatctttgggatcaaaaaagttacgtcggagacttgaacccatgatagcaggttctaccgaaatgatttacaattttggccgtgtttagatccaaagtttttcttcaaacttctaacttttccatcacatcaaaacttacatgcacaaactttcggcttttccgtcacatcgttccaatttcaaccagacttttatttttgacgtgaactaaacataatctttgaaaagtttgattttgaacacggtggcagcaaagtgacacgaaactttccagtgcgactagtagcagaatctcgggttttgccgcattacccctctgagcctcagcctcactcttggcctctcccctcccctcccgtcgtcacgaaggaaagcgaaacggttatcgcgttaaccaccccgcccttcccttccccgacctgaccccgacccgccactagaagcttccatccaccccgccgcacgtgccgctcacccgcgccgcccacctcccctcccctcccctcctctcctagacccggtccaccgccgcccctctcagatccgccgttgccgcggcggcctcggcagctcggtctccccccgctagggtttcgccgtctccgatcggaggggcgcagcgatggatcagagcaggcgggcggtggagtcgtactggaggtcgcggatggtggacggcgtcacggcggacgacgacaaggtggcccccgtctacaagctcgaggagatctgcgagctcctccgcgcctccgacgccagcgtcgtcaaggaggtcgctgacttcgtcctcaagcgactcgacaacaagagccccgtcgtcaagcagaaggttccccttctcctcctctctctctccccttgtgtgatctcgggtgcgagggtattaggtgggtggcggcgaggtggatcgatcgatcgatcgattgagtacttatggattggtgttcttgtgttctcattgatgatgatgatgattagttctgtggccacggttcttgtcgaactctggatggtcgaaggatggcgcacgtatccggggagtgatttgagtgggtgactgatgatttgtgtgattgttttgagttcatgcctgcctcctggattgccgatcagttgaggggagaagaggctgtcgaagatatagttctgttttggccttctggatgtgggtttaataagggaaacggcgaaagtagggaattgcagttgttgaatgaaatagttattggttgtgcgccacagcccctagcataaaagagcagtgccttggtgaaggtgtaagggagaaactggctatatatttttgttcttcactactaggtggcaacaatatcttgctcacagctcacctggagttgatggcctgttaccgtggattcaaattagctagaatggattcatgtgtcatagtccctatcaattgaaatttaaaactagcctactgcttcttgaagagctgagaatattctccacatccaactatctggcatgtaactgttccatatcgactgagaccttagtggcttgtatggttgtttttggtgaatgctgttttatagagcagaagccttatgtggctaatgaactacaacaattgttatagctatggaccaatggaaggtgtttttttgtaaactatggtgtctacttttgatttggatttaagggatgttttttttttttgggggggggggggtttaatgctgaaccaaacacatacatttgaggttgtttagtgaacttgaatgtgaattcagatttcaacttgtgacaactaattttaattttataaatgaattgctttacattcatggcatgttgcgttctgactcctgatctcgtaatggtaaagctcataccagccttctgagtagactctctgcgcaaaggaaatgctgcttatgggcataatatttgctttgctaagcatttgtactgaatgttacacgtcagtcctgagcagtggcacattgcaccttttgcaaacatggtgacccccacatatatcatagaatgtaccctaatgtttttgatggaatttttaggctgtcctaacttatgtctaacatttaagtacagtggtgtttaattattgaggagactagcttctgttcttcaattctgtactaaccttttcaattgctcttttccaggctttgcggttgattaaatatgctgttgggaagtctggtactgatttcaagcgggaaatgcaacggcactcagcagctatgcgccagcttgttcactacaagggacaccctgaccccttgaaaggggattctcttaataaggctgtccgtgaaactgcaaatgatgccattgctgctattttctccacagaggaacctaaacctgctgttgcaacagaaggtcttggcaagcgcatacagggttttggaaatactaattttgagccatcaagagatgacaaaaaatctttccttagtgagctaagtgaagtagtgggcattggcagtgcttccattaaacagggtttgagcaactttgctgcttctcattcatcaatgataacaaatgataatggtggtccgtacaagagcccaaaccttcgtaggtctctgaccacagaaatggataaatatggcaggtatgatccaagtgaaattcaaggcgagagccgttcttcatctggtgcttcaaagaatgttagttctggttcatggggtcctagtccatccagttctgcaccaactgatgatactggttcaagtcaaacaggggttaagactcgtgaagagagacttttagatacaattgcaacttcaagtggtgtgcggttgcaaccaactcgagatgctctgcaaatatttctaacagaagctgccaaattggacgcagttgctttgagccgtgcccttgagaacaaattgaattctcctttatggcaggtgactttacgatgttctttgttcatctacttcaaccttacaagttacaatagttttacggctatgggatggggtacctttagtctatattatggtttacactgcttctggcaagtgactagtgtatattgatgcacaaatcgatattttttcttattccgcagtcaaatggaagtactttggatatctaatatatagatactttaaacatatgtttgttcaaattttgacaagtgcttattgagatttcaaacttcaaaagtaaaaacactatttatgagttgacttgtgaccattcacatatacttttttatggtaaaagttcagagctgtatatataatagtgagtggtatgtaaacatattgatgcttaacttagcttccaattttcaggacagcatagtttatttgaataataaattaataacatgtgaaaaatacagttccggcatgaactctttgcatgttaaaagtgcttagttaagggcttttacacccgcctccctactttgcggtttaggacatgtcttagcgtatttaaagatttacccagtaggcagcatactggttctgaaaaaaatattaggcagtgggcagcatatccttttaacatggtcaaaggaatcaaaatgttttgccttgttatacattccaattatcaatggaagtccacctagcatctgaattttaaaaccaggcatctaacttctcaatacttccataaaaccccctgaagtggttttgcatggtggtttcacctataaccccatgaactttcattggaataaggtttatttctactaggggttagcaatacggagtatgttcagaattagtgcattcattatctatgatgttctctgaccttttcttatatttttgatacaatattatctcacattatttatatacatgattagatcatatttataataccattttatcttgaccaagcacttccaccattgttttcactttatatattcataaatattcaatgcatttgttctacttcaggttcgcatgaaggcaatttgtgtattggaagcaattgtaaggaaacaggatactgatccttattcaatcattacttcatatttctgtgagaacagtgcatctgttgttagatgctgtgagcttccgcacgtttctctcagagaaaaggcttcgaaggtcagtaaagttgcaagccattaataaataaatttgtataatgcaccatttattttctgcaaattgctatgtagaatacatgctttgcatctctttgattctatctctctctaggctatagctatttccacctccaattattactatataataaaccgtgccattttcttaggtcttaaatctgctggttggggaacaacctactggaagcaataatttttcagaaacaaagacaacagtacctgctgcacagatgcctgatttgattgatacaggggatcaagatgacccaggagctcaaaattcagctcaggaaggtagcgagaggataatggggaatagcatgtttacttcttcggttgatgatttgctgggtggtgaacctattgctgatataagtaccaccaccagtaatggtaatggaggtgatccgtttgcagacgtttcattccatgagacagcagatactaaggatactaacgacctattctcggggatgacggtagaagaaaaggcaacagcagccttgcatgatagctcatcaataaacaaaaatgaattgtcagatatatttggcagcagccctgagccattcttccaagaaagagtagaggataaaggaaccgtgaatgatttgatggctggtttgaaccttaatggaactgcccaagctcagcctgggattaaaacagaatctaacaatactgtcaatgtttcacagctctttgacatgaacagtcagacaacaaatgtggctaattctgcagcaatgactggtattcttggccaaagcttttatcagcaacagcaggttcccttgcagtacaacttgccatcacagatgctgttaaatccagcatttgctgggcagcaattaaactatggtgctatgagtgttcttcttgctcagcagcagcagctgctgcaaaatctaggaaatttcaatgctgggttgggacattcgtctttgaatgcaatgaacagcggaaatgcatctgtgcttcctgatatcttcaattcaagtaaccaacctcaacatgttgctgtgatgagcaactcaaagaaggatgaaactaaagcttttgattttgtttcggtatgcgctttcatcatgtccctaatttattcttatttcatttcatatatagacgtgccaatattaccaactgtcataatgcgtgggcagtatgaatctatggctctatgctagttgcataagatgttacttcagtttttgacatctgaagcaccatcctctggtgttaacagtcctagttttctttcaggatcatcttgcagcagctcgtggttcaaaaaagtaacccgagagcgatgggtatgttcagaatgtagcaacaatgcatttgtttggcttcacgcaaacttcactcgtactccatcgattagctggatcaatctcaggacaggttttgcatgttgtgctgcaacagatgacccaagaaagaaagaaaagaattcacgacgggggattgtgttgtatcatgtatctagacaaatgtcgatttttatgttgaaataagctgtacttatcttctcagtttcttttgatgccttgcctttttttttttcttttaaagagtcggacattgtagattgttctcgggcgggattttgtttttgctgctgtacaacagcatatttggttcttttgacgggaattgtaaagcttgctacgttaataacaggtgccatacgggaataatgatgcctcttgaaccatactgctcacatgttgagtacattatatctacgaactatctgcattgtgcagattatgaattactccctctgtttcgaaatgtttgacgccgttgattttttaagcacatgtttgaccattcgttttattaaaaaaatttaagtaattattaattcttttcttatcatttgattcattgttaaatatatttttatgtaggcatataattttacatattttacaaaagtttttgaataagacgaacggtcaaacatgtgctaaaaagtcaacggtgtcaaacattttaaaacggagggagtatgtattagcagcactagtatctagtgagataaactttggaagaaaattactgacaaatagacttgtagctgagttccacattgttaaaaccttgtagtaatgatgcttatggttgtaaggtaattgcgatttagaaggaattggaatttattcttgcattgtgattaatatttctcggaagaatgtgttaggtaacttcatcaatctcaagatatgttggtccagtttttcgtagatgttcataaggataaattgtgcgtgtgttcataaaaataagtgtacatgtactatggacgtctgcgtttgtaccgtgtaacatttttttctctcgttttgagaattgagaaaccttttttctcttgttttgagaattgagaacaaaaactttgggttttgctagttaattgtcgacaattttcagctttcaatttgttggctgttcgatctggctctagattcgccaagattcgtattggtggaggaagatccggctctaagatttgccaagattcgtgccggtggaggaagatggaaaaagtttacaagcacaccatggggatcgaacccaaaacccgttcgatttggctctaagattcaccaagattcatgctggcggaggaagatggaaaaaatttgcaagcgtgccatggggatcgaaccgaaccctgcagtatacacacttgttccattaattagttgctccgttgcatttttatgagagttactgatcgaacacgtactataattatataataatagttacatttcaaaagctttgattgtttgtgctggttgcggcagcacctaaaagtttttcatccaaaaaaaactttgttgtatagctactcccaaaacttttccaggctgtttggcctaccgtacggctcctcctactcaccctcaaaccaacgtgtcgaataaacggcaccagtacttctttccccagcggggaccacgccacagaagatcataggatccggggggcccacctgcgaccaggtttccctgacagccctggcccacaccgtggactccggctccaactcgccacctcgcttcccttccctccctccccgagttacacctgaccccgtcgaaccggagtcgccctcgccgaatcccctccgctgacgagtgggccccaccgcgtctctgggcccactggtcagccgccgccgccgcggggtgcgaaccccggatcgcataaaatcactacgcgcacgcggtttttccgcctcggccgcacccgcactccaaccagcgcgagcggcgtcctcctcctccgtcggcgtcggcggcggcggcgacggccatggacttcgggtgagtcggccccctcgtcgccgccggccgaccgaccggacggcggttctcctcttcccggcgttgttttgggacttatttttatttttatttatttattttggaatgtggtgtaggtacgtcggcgtggggcaggggagctcgtcgtcgtcgtcgtcggcgtcgtgccgagcggcggacgtggcggcgtggggatcctccacccagcagcagcagaagcggcagcggtgccaggtcgtgagtcgtgaccaccccggcggcctgttccgtctcgtccccgtaataataaatttcgctttccccgagtttgatcttggcgttgcttggtggcgagtgcggtgtgcggtgtcaaaatctgcgatcgaggtgcatcgcgtttaggggggtttgggcggggtcaggaattgggggttttcgtgttggggggggg

SEQ ID NO: 66120 - DNA, 12652 bp, Oryza sativa
ttgaatcaattcaaagactgatacattgcacatactccgaccggacgagacgcactgcctcatccgtgtcgtttgagaagcactcacttagttgtttcaaaaaggagtttaaataaaatcaattgcaaaaacaatagcctttcctttgaagcctgcattaaacacttaattcccatggcttactgagtactcatgtactcacccttgctctatataaataatccccctccccgcagttgctgaagaagatgaagtggatcccgctgacgaggagttcttccaggagcaagtcggctacgatgagttttagggtttcggtctagttcccaagtcgcgcctgtgatgattggtccaagtcttggcttccgctttcccttttgtaatgcagttgtgagctcgggatctgtccgcagcccaacatgactgtactcctactatgtaataaagagacctctgttgctgtgatattctatcttcctgtgataccagcactgttttcttggactagtatcgattaacaggttaatttggagcgtcacgggctagtttcgttcggggctagttcggggcgtgacaattaataaccatatatgtgttattaccgtattgctttcatgctttgtttgtttatgcatctagcaaacaaatcaaaagtgtcttaaataaataaagactggtgagtataagacaaataagttgtttgtaatattccctgggatttgtccatattattgattcttctaatatttggtataaacaaaactttcttagtacactaacacgctatcttattgcagtatattgtcgatatctttcgaatctttctgagagggactgcaaatcttaagcacatgtacaatgcaaatgaaacacagtgctggtttgaagaaatcgagtaacacgtaagcatggatactcaccatctccttctccggctctctcttcgtggaggacactagttttgcctcttcttcagtgtgagtatacccaacttgctttatactgctaaaggtagctgaagtcattgcttatatcttaattctattattttgagcatttctcttttaggattcaacaaactttggtcacttttgtcctttgcattgtcctgggcatgaatagtgctttgctctgatggtgcttctaggtggatagcattaaaatgatactgcccaaacagttggtaacagctcacaattggtaacaagtggattaaaggaaccacatgggaaaagaaacatgcatttcaagttgcagtaggaaagcatcctactgcaacttgaaatacatgtttcaggcatttcaaaaaaaaaaagttgcagtaggaggaagcaagagattttgattcaatctgcaaattcgatcttcctttcttaagtagtcaaatttagaacaagttacatgttatgttagtcccagtcaatcgacagtacaattagtgactacagtctcatactagcttcttgagttaattcgtcgatttcacttgaattgaaacatctattttcctacatgtcaaatagagctcatcaccttgaactatgaagaacagatcataggtgtgtatggcttccagcagatccggtcgagagcaatgacgaaagccatgatcatcgcacaatctacattcggttggacctcaagactgaaaacatcttcagcaagagtcagtgacaacgatgctgctccagccttcttcctcgttatccttgcgacttcctcaccgacgctgttgcggatcttgcaacttcttctcctgaaactgccctcgattgagaagcctggaacatggccagtacgatctgacgaagcatgggtacatcctgacatgtgcacttctgcttcatgactgctttgcataactgagcattttctcattgagaagagttgttgtgatcttgtcctcttgccttggccttcttctgacgctctgtaacaattccattggtcatgcatgctgataatctgttgcaacagaagaaaggaaaagaaaattcttagttcttacttactccccatgggttctattaatggttggtttctgttctttggcccatctgctgcacttgtaataagaggtaacaaaacttcagtcggaaagtagaatgaactagcggataaatcaaactctgtattgtaacctctccattttttaagttttgattttaactctatatgggattttgggcaaattaaagcaaaacagcatcagaataaccgaggctggaacgatgaaagcaatgcattttagtctttggtcagctgattttgtctgcaagtgtttagactaattattttcctagctagatgtattagtggaggtagttgatagcatttgcctaaaaaccgtcggcatgcacgataatttgccttaaatctttttggtgagctatggtatcttttagtatttgtgagacaaatagacgagacaaacatatatatacttgtgatttggtgaatattttgaggaaacagtgaaagcctggagatacattttttaaaaaaaaatcgagaaaatgaaagatcgggttgatggacgaaacactactctcggggctctcggcaaagcaggatttgcagtatttaaaagtcttcagtgaagttttggaagcaaacttggtgatcgttctatatcttgagagaagatatgtaaaatgaagtctacattcggacgaggatgattgacgagcagaatataaacgatttttggttgaatgtatgatgaattgacgatcgatcggttgaatgtatgatgaattgacgatcgatcgacgatcgttcatgcatgctaacagctaactcaatatatcgaccgaaaccgtacgtaaatattatactgattgtcaggtgtcaggtaatactagtatacaaccacaaagatgcatgaatatagcctataggaggtaattaattaattaattaattaattaattaattaattaatctgagatgcaaatgcaagattttgcaggggatgaatcatgaatgattagaagatagacaagtgtatatacctgtggggtgagggcgaggagaggcgagccatgtccatccatgagcagcaggtcgccggagaagagcttgcggcggcgggagtagttgtcaacacggaaggcgagggtgccggcgtggtcgtagacggagaagccgtcggtgccctggaagcccatgctggacctcttccacaccgtgtacaccgccgctcgcgctgctgccgttgatgcggcggcggcggcggcggcatcttggcgttgattcgaagggtgtatccgactcatcgatcttcttcctcgctgcgatgcgatctacctatctatctgcagagagagagagagagagagagtttggcgttggacgagagatgtagtgcgcgtgcaatgcttaactcgtcagtgctgacctcgtcattgccggcctcacctgcttatatatactcctccggtctctgaataaccgatatgacaaatgatgcagcaacgactgatgattccttttcagagttcgaccgatggatggatgcgcctcttttaaccgtgtgtgtgagtcgatcgtgcgtgtacatctatctatctatatatgtggctgcatgaatgcgtggcatctcaacattctgaatgtgcgccatatattcctctgcctgcttgcaaaggaagaacaaccttacctagctagcttctaacaaaggaatgagccgcggaacacggtttcatttggtccactgttaattagtactacttgtgcttgtcacaacgtgataatacttgggtaaactgcaactactcagtcaatgcacacgctgttatactgacaattaatttcttttttactccaacatgcctgcatgcatatgaccacactgacttgattcggtcagttctaactgttatgtagggtgcaattgagtgtcggaaacttccaattgatctttccagatgtcctaagtttaatttcttgcgattcctaccgtccatttcatcttcctacaagaacagttgtcttgtataaatagtccaatgtcactcatttgcactaggctgctctccatcgctgtgtccatcttagcatacatctcattatttccccaagcacgctgctgatctctccttacccagtaatcagtaatcgcttggaataattactcgtgcaattgttaaagcccaagattctgctaaaccaaaaaagaagtaattttgctttagtgggtgggtgaagtggagtattcctagcaaggtcacagtcgcgcatgcgtaacatcgatctggttaattgctcacaatatctcaacagctgtcaataaaccctcgcttttcgcatatgaatgcatggacaattcgctagtggccgtaacttaatccaattctgtggttttggatcctttattgcttgctaattgctctttgaaaaacatggatgaaagctccttctacagctatgaaaagcatgtcctgagtcctgacaatgcacaatttggccatggaaggatcctcctaagtcctatatattcctagccatgaatttgatttcatcataccccacacactcccttgcgatgctcaacaaaggattaatttattcgacaaccaccggcctatgctagtaagttacagacatttctatatctaggttacagaatccgaaacttggaatgttatcttcctcgtgatgatttatgtcaagatctgttgcttgcacacacaaaagttggcactgccacttggcattgataatttgatatgcaaatgatcctagtgacacaattctgtattccatctctcaataacagaaatatctaatgagatgcacttgatagcgcagtagcaaggggtatgtgatttcaacactacggtcccgtgttgaatccacaatacgctcaaaatttctttttttttaaaaaaatgtttggaggaatgtccctccctccaaatctttttttttaatctaaagtaatgaaagtactaaactttcttgcaaagttactatggccacgtcattgaataaacatgagccgtcggatattcactccagacaatacaaaccgttggattgttgaatcggttcacgaaacttctttttacaaggagatccttccacatccctacggtaaaaagaaagagatcttgattccaccgcatcgtcacgcccctacgctcccgaagcccacgccgcgctcctccgcctcattgccgcctgctcaccggctcttctcccgtaaaaaagaaagagatcttcttttttttttttgtaatatctagtgaaaagagaatacaggtttaccaccaaattaaggtttgcgaacaatttgtcgactgatcatacgtactactttcgtcagttgatgactgagatgaacatgccctgccgccctggcatccatgagctatggaagagacagagactcgtgaacagagcataagtgagaattgaaccatttggtgaatcttatgacaaattaacacagcaaaaacccaaatgcacgtctgtgtttaattctgactctggccaatgacaacgagacaagattcgttaagttgcagctctcgcacattacacgcatgattaatcacgctagacaacacaaactccaaaccaaaataatgacaaaaggttaggttgaacaggttaattagagttctaataagtaatcgctttattggatccttttacaacttgatcataatctccttagtttagtaattaccagtgcactagccaaatggttagttagcgcttaattacaattagtgaactagctacttaaatggcggaattcgttaaagatgtggtaattgttatttgcaaattgcagttttaattaatcacatcatctgtcgtatgtaacgagtcggacataataatgatcaattgtcgatgatgcaataacgtgtcgtagggtttattattttgttggtacgattgatcatccattttaggggctagtaaaaaacaggaagcgttcgcgaaaaagaaaacaggcagaagaattggctccatttcgtttgtagaggaaacgtacaactccaaaacagcaaaactgaaaagtctcgattgttttccgaggaaagtcaggaaaatttaaatccgatgttgattttattgtaaataaaactgaataaaatattttttttaaaaaaaaagacttaacgaccatagagtcatacgcactctgttaataaaagtctaatgcgtgtgtaggatcgaatcacaataactaagccaaccaaagggggggtgaatggttggtatacccaaaaaccgaaaacttttagcggaaataaaagttaccctcgaaatcgacggaagtcggtctgaccgggtggatgccgccggtctgaccggtgttgaatctccggtctgaccgccgagatcagctgccgctcgctgtcgccgccgccggtctgaccgccgtagtcccgccggtctgaccgccgcgatgccgccggtctgaccgccggtgtgtcgccggttagaccgccgatacccggtgaaacacaactcgaagaactcttaaagtagatgacgactttattgattctctttgtgtttacaaagtgcaccaacagcactccttacaaaaatttcgactaaactcgaaaccctaactcaaaactcaactcaattgctctccaaaagcgataccgggaagcctcacgctccccctctatttatacccgaggtaggcagcctaaagccacgaaccaaactcatactaggagtcctaaacaccttaggaaaccctctagtacaagaaacaaactttacataaccaatcataccaaatttagactccttccaaattcgactccgcatcccatacgcacacaataactccatcgtatgccatatggaatctctatcaaccacgtgcatcaactctagcctaagtatcccgcatgatctctgaccaccacgaacgtcgtattatcgccaagccgactcccggtccatcaccgcaaatactctcccgaggcatcgagtcacctacacatgaaataaacaaagaaaccatattccgagactaagctatcacaacttgactcattagtagcaaacaacagtattatatacgtatagtatccatctagaagccataatcatgaaataatcacggatatccaaacaaacaacccgaaaccgaaaccgacacaaagtcggccggtcagaccgcgggctggccggtctgaccgcgcgcatatcgtcggtctgactggctaccagagcccggtctgaccggtcacatgaaataacagaacatgcgattcacctgtaaaatccaatcatctccaaaaccacttcgtgaattaattccaaataacaaaaccataatctccaatgccaattgttcatcacagaataataataaaaacacctttgattttacagcgtgtgcgcgtcacttaagtgaatttatcataagcacgtatttacatttcttattatacaccaaaactttttttcacatagaaactttattatacacaaagttttcctcgagaaacattttcgaaatgcatgtatgcggacacatccaattctgatttagctatgacattttagtagaaacttagattctctataaaaactttatatatagaaaattttaaaggtatgtgtgctggatgtgggccaggtggggtaaaagttgtaagccaattttttagtccaactcgcaaaaggtttgcgcaaaccggccggcatgaatctattaaacccatcgttgatactattattaaaaaaatcatttttctacttaaatataataaggtatattgtttcacaggttataattcaaatataacccatgcatgtaaatcttaacgcatatctatctatctatctatctatctatctatctatctatcatattattaaaacaactttgaaaggaggcatcacgttcgctgtggggattagaaattcccatgttattcggagaaaaagaaaaatatatgtgtcgttggatcgtatttgtctagattttgatggtctagatcaagcaggaaaatacgtgagttcaaataaaaaaaacatctagagagactgactaggaattggacatgcatgtatttggactaatttgactaggagtcggacatgcatctatttgcatgcatgcgtatggccatttgagcctgtaaatttgtagtgagatttgcaattggaatcggacattcatatggcgttagaggtaattagagtcatgcatgttcatccacgaaagaacaagcataattaaacgctcaaaggtagattaaaatatattccaataggttatggtaggactaaattacaatgctataattttatctatagaaacagaagataagtgttgtacactaaatctaattatacatgcatgtataataaaatatttatgcgcttaaattgtgctatattcgctctaaagaaattatcacgttaattaaacaaaataaagaaaataccaaccatgcataggattgtggtatacctgaatattaactattaagatttaattaaaatttaaaaagttaaagagatgaaacggataagagtgtgaaaccgtatagcaattgaaccaattgcatgacatcctgacacagacactgaccttgcctccaaatcagaataggaaattaatttttgaagtgatataaacgcgaaagtttgttcacgttaataagagggaaaaggaaaaaaagacaaaatatatttctaaatagaaaaggttttataggaaatacaactatacgactataatactaacagtatataaatagaatagaaatctaattttctctctgattaagctaagtcgtaagtcggtaactgagtagtaatgtaatgacttgtaaaactagcatccgtgtctgtctcatgcaccatacccatgacaatatgatgcgtgcacacatgaaaaacaaacgacgataacacatgcatgcgaggtgttggacgcatccatcttattgactaaacccaattagcacatcaatgagatgctagcagcttagcatgtcatattactctctaaacctacattaaacaaacagtgaggttagcacatattagtatattaccatgggaagttcaattattggaattatgatttattttaatcttcagagtaatctataacacataatgagattaattaattaacatgcctataaaggagtagagtggtggcggttgatgggatatctaaaaactattaataaaacaccaaatggaatgctaatgacgattaaaaggaaggatgacagagaagtcgtgaagcaaaaaacccaatgataatcatatttgatttttaaaatatcaatgataataaaaatgagaggcagcggacgaatcgtacaggagtacaatggcagagctgccgatggttggtgggagttctagaaagtaaaaaataaattccaacgataattatattcgatttttagaatcccaatgacaataaaaactggtcagcagacgggtcatagagaaatatagtggcagcgtttgacgggatttctaaaaatttaaaaaataaaaccaaatgagacaataaactctaaaaactaaaaactataaggtccaatttttaaaggtccgggcttctaaaaagtaaagaaataaaccctaatgataatcatgtttgattttaaaatctcaatgataataaagaaggtaggcagcaggcgagccgtagaggaatacagtgacaaagtcgttgacattttggcggaacttctagaaagtaaaaaaaaagaactaaaacaataattatgtttttttaaaaaatatcaatgacaataaagagaagaggcagtggatggctgtagaggagtataatgatagtgtttgatgggacttctagaaattataaaaacgagcccaatgggataataaactctaaaaacaataagatctaatttttaaaggttccaagaagaataaatagaaatcgtggtagatcgagcaagcaaataaagaaggatatgacagaagtaaggggtagcaactaatgtgacttttaaaaactataaaattaaaaacacgaggataataaggtttggtcttgcaaagtcttaagacaacgagataactatttaataaattttaagtaaaaccatattaaaaattatataattttgtatagtgctagccgcgcaattgcacgggccacccagctagttttcattttattccatccgttttaaccaattggagtaaaaaaccaaattaattaactaaacttatctcatattctcaagacataaggggaaggatataccataccgaaatttgtttaccattgtgttggcttttaatcccatactacgtgcatattaatgtggaagtattcaacaatttacatgctcagcataaaacattctcctatgcatcattaatcaaattgttgtgctgacactcagcagtgtccgtacattatgaacagaagaagaggagaaatagtttcagaattgtgaaagctaaggccattcacagtgtaagctatgaaacccatagccttagcctcaaaacttggtccaagtacacccatcctatagtgcaagcacccatagttagagtaccaaacccacagccggtggaccccacgaaaaggaatcatcgcatcgagtactacttcatcgcctccactttcccgaactgcactcgcctcctctcctcgagtactactcgcgctgcctctcctccttctcctccctcgcagcgacgccgatgggaagcggtggcgggagacgtcgccggcggcggcggcgggagtcgtccccagcagtggctggcgcggcggcgtcggcgggaggcgtccccggcagcagtggctggctgacgagacaggtaggagaaaggaggcggtggacgctgttcttgttctttttgttcattttgttctttgggttcttgatttgtttccccaccttgatttctttcggttcttgattaacaggcatggatttgattggggaaatcttgggatatcggtggagcggacgaatcggtggcgggaggaggagattagctgcggtgggagaggattttttagggtgaatcggggatttcgcgatggggattcgacgtgagggtacgacgcgtctgggtcacgtgctccatagcgcacggaacttgctgcacgtggactcgctgcgagaaagttcctcgcgtccttgtttgggaccaaggggctctgctagggcgcgcgaccatgctccacgcaagcacaaatcctcgctggtgcggtgtagccctggtccacgtcactacactctgagaggcctaactagctagctatttcagcattgctgcttttcccgcgtgattgcaactttcgtttgattgcgttgcgaaccacttgatatatactagtatcaaattaaggccataattaaaaagaaaaaagcagatcataaagaaatcttgaactacgtaagcactgtacctgaagaagttgtccacaacttgtatctatgcatgtcgaaatcaaaactgtttgagcttgtttgagctttttgggaggcaacgcgagtgcatgccactgtgccgagaaattaaagattgaaatgtatagacatcaatggtgcgattttaattattcttttaattataatctcgtgattcctgatcgttcgttctgtaacctctatataattggttatactcctactgttttaggttttaagatgttttgactttggttaaagtcaaactgctttaagtttaactaaatttgtagaaaaaataataacattttcaaccaagacaattttttatgaaaatacgttcaactattgatttaatgaaactaatttggtattataaatattattatatttgtctataaacttagccaaacttaaaatagtttgactttgacttaagttgaaacggtgggaaacggagggagtagtttttttagaaaaagtaaagactaaaatgaattctattatctttaaggaaaaaacatggatagtgtcttatttgttcatatgggctcaattcaaaaggtgaagctttcggtaaagaggaagggctaaggcccatattaatggacaggccttccgtgggccaggccactatatgcagatgggctaaaagctccctactatagtactagtagttaggaaaaagtacaccgaatgtcccttaacttgtcatcgagttacaaaatcatccaccaaccacaaaaccagatatatgatacccctcaactacaaaaccgtttattttaggtcctttggtggttttggccttggtttgtccaacgtgacggctaactcagcgtggacccatgtgggccccagaagtcagagtgtccacgtcatcgccctccctctttcccctcttctctcccttcctcctctctctttctcactcttctcatctgggattctgcagggcggacggcgagtggagaggaggccgcgggtgaggcgggagagcaggagggcgttggcggccggcgacgtgcgacgcggcggtggcagcgacgcaggagaaggggagacggcagttgcaggggccgcaggtgcagaggagggcgtcggcggccaacgacaggcgacccgaccgcggcggtggcggcggcgatgcaggagaaggggaggaggtgactgccgccatggcctcgccctcctcgacgagttcccctagagaagggagaaaaaag

SEQ ID NO: 66121 - DNA, 25191 bp, Oryza sativa
attcctgcagcccgcatggtaggatggctagttgggagatctagataaaagaagaaaatgatgaatgtctgacatgatatgtcggtatcattggtatatatgctgggttattcgtgtttgtttagtgttttgtgtaatacgggactaacatatataattatatggcgtgagcctcctatctattctgttggtatgtgatatgggtggttttatttatgtaataatgacaaaattttatgtcaagtgaggtaggagccccaaaataataaagatgtttattttatataattatagaaacaagaatggacatattaatctatagcaataaaaatagaacctttctttttttgcaaatgcatttattcccaaccttttggagtcatatttaataacagaatgtactactataatcggtaaggatttccataagtaaactgcaaagtgcacacactgtgcaaatcactgcgccgcagccgtaaaaatggccggctgcaagagcttgagccagcagacataattagtgcgagttcaaacgagagattagcttatgattacctctatccatgtgccatgtcattctttttgatttttaggccaggtgcacctagcctctttgcatgaaatttgctatggagacacaacatgtgagttcactctttgctagagttcaaccaactctttgctagagtccaaacttttttttcaaacttccaacttttccatcacatcaaaacttttctacacacataaactttcaacttttccatcacatcgttccaatttcaagcaaactttcaattttagcgtgaactaaacacacccttatatgagcttctttcttccgaactacatatgccattgggctaaaaggtgaaaagtaatgtgcaacaacatatttaattagttttgcattttgtttgactgagactaaaatcagacgcacacacagacacattacatgagcttcctttatgacccttataaaattatcagcgacacctatatatacatgtgtgcatgtaatgtacaacgtctctattattagttattatgtgtgcatcaaattgtacatttctgaaaaaagcgggtatagaaataccaattaagtctaggactcgaattagcctcgtagctaggctaactacatgcacgtacattcatatatacacatagtcatttattagtatatctaacttcgtctagttcaatagttttatttgatctttaaaaatatacaaatacaaggcaacaataaatgttggaccagtaaaactagatataaatgtttcttcagagcagtatgtataaaaatatcgttgtaaccaataaaccatgaagtgtatataaattcactcagccgtgtgtctatatagccgtttgaacttgttagtaaagaagttaatgttcatatctaaacatttaaaaaaatttcatactcattcaaattgggtatatactcaatttgaatcttggagcccatactccatgtagcaccagttaatttatctatatatatatggcttttggttcccacatggaggcgggcgcttgcgagtgcatataagaattttggggccattggcaccaacaaatcatatatacctgggtatgcgcgtgagagagagaaatatacgtatagaggggggccacaatgcaaagggtggtgaaaaagttagcatgcacaaccctaccactacacatctaccagtatgcttaacccatatgcaagaaaagctatatctgattttaattaatctctgaagggattgatcattgattccataatattaaactaatcacacttcgaatttcgtaggccccttttacaggcttgcaaaagcattgcatatgtttaatggagtctcactagagtcactacgaatattccccacccagcaacaagagattagtactacataacaaagcgagaaatcactaatgacaggagaaaaaaaagattattattattattgatatttattaagtatagttaaagtacgaggaggctgcgaatgattgagcccttgttgtagtagagggcagctggcattgcaatatctttttgccgatgaggacgtcgggttctgatagatattgcaaggatttttttttgaggtattatatttgatgatcgtgcattgtatttcttcaattggtataccacttccattattatttaaaatggtacttatatttcttcgaatgctacgtgacaaattaatgcgtccaacttaaattggagacatcgttcaattggtaagccaaggcactaatcccccaggtctttcggagtaattataaatttggtagaatttttctaatctcaagtcgctcaattggaattcgacacgcgcacaattgaaggttaattgtcgttgaagtagcatgctctaaaattgtgtttttttcaatatcatatatggaccctcttcaaagatatttaaaggtgtaaagatcttcctgtaaatgttgggagtgagccatagactacaactttgaatgaaaatgaagaacttttgccaattttccaatcgttattcattattggcactacatattctccctctcaatatttctgatttaaattagaagatcagtttatagactatagacacataaaaaaaatgaaaaaaaacattattcacgcccgataattaactttacctttgattgacatgattctacactcgtagagtccaaactagcatacgtgtgtcgacattgataagttcgtgagggaccaacgttcgctcaataagctatggtggaaacatagtttcattacaacaaaaatgtctttatgtagatatatttttctattgttatagagacacttttcaaatattacaatgttgtagagacatattcaaaaatatgtcataaatgtcttatggtaaattatctctgtaaataaagaggcattttaaaaaatgtctctatgtcttgtggcattttaatagaggcatttttttatatcataacagagtataggcattctctagagacactgaccaaactactataatatacatcataacaccactatgcctcgcaccatgcactctaccaacttgttgggtttgccatctccgatatgctccacggtgaccccttgagacgtgtgggacatgatgcctactttccccccggtaatacggggttgtagtgagagggggtgaggttgatgtgctgaaccattgatattacatgggtgtaactgactgtgcgagcacacgaatgaaatgagtcttgacgatgtgaacaaagaggaatgacagactataatgcgcgcgtttactacatgtatgtgcacactgtccaataccttgcatcacattgagaccgatcatgaccaaaggacttctatgcctctcttttcagtggtcgcgggccaaccaactagtggccacgggaccaccctactggaggaccaccgcgccacgtcgcatggtgccgcatgcctgtcctactcagtggtcgttcaccatgatgtcacctagctgctacacgcataccctgctcaggggtcaccgtgccatcgtctcctggtggtcatgggcccaccctgtataggggttgccgcactctgttgactggtaggagcaggcccaccatgtcaagggctgttgcaccacgtgacgtgctctgtctattttaggactaacccctgtctatttcgaataattataagtgtggatgggaacatgtaattgtaatactgacaacatgcttttattttttaaaaaataagagaagttgtgactctttaacataaacgaggaatgcacacaaccattacatcacttaacaggctaacaatagactaaaaaagagactaaaaaggcaaaaaataatatgaaaaataaactatcatgttagggttaatatagaaaggcttcgtcccgcaactcagaccactgtaagatcatcttcgtgaactctatggttgcaggaaaatatgttctgggatttttagttttcatggaaatgccgtagaaaaacaggtatgactcgtcgatatcgctagattcaatcgcggtcaatgttacatagagggattaatttacaccccggatctcaaaataccaattctcgatggtgatacttcaagatgggaacacggctgatcgatcacttgatcagatcaatagagtcactttcttgaggcaaatttaaataagattaatttacttgctcacttttcttactgtgagagcagctaagctagcgaagttgacacatggagattccagattcttgcacttgatcgctcctttaatttggaatcttcgctaaaaaaacaccacctttttcttacatccatcagaagaagatcaattcgtttatgttgtgtccaatcctatgcttaattatatgcttttcaaaagttaaacgtactccacatatgtatcctgtatatatacttatatagttcatccccactaaatatagttaatattatttctctcttctcttattaagtcacattaccttaattatttctagtcttttaatgatagatatatagttcaaattgtcttttctttcttctctcttaaaaacatgcaatctcaattacttttagctcaaaattatatcaaattgttttaattttgtacgtattatgtaacttaattttctacagcaacgcgaccagatgttcatatagtatcttataaaagtatgagcagtactagaatactaaaactggagaataccgaatgtacttacttataaactgtaggggaaattaaagcacttaaaaaatgtcctgaatttaatcatattaaacatttatataagcatctacgtctagttcataaaaaacgcgttcgcgaaaatagttcatataaaaagacctatccccaaatttatttattctttttaagtttttctcccattaagataataattggatgtaacttatttgaatcaaagatagctagtaatgaattctattatcaagaaaaaatatacacaccaagattagggactaattactactcctatcaactatatattaacggacatgattaaccaaaatgagagcgttcattagttaattattatattaattaaccgctcatccacatcatgcgtgcatgtatatatggtgtttatttttaatcagtaactgaagttatcatgacttttaactttttgcctagaaagaagtcggttaattactttacttacatggacaagtacgtatgtactgtactgccgtacacgtacgtattttggaatataagatacagggagtacgtattcttgtacgcacacaacacaagactcgcatgtatatatatattgcattggcgttgagtgcacgaacacgcagttggagcacaaaaatggcgtgagtgcaatggtcttcttgtaagaaaaataaaagggtccaaatcctggaaaaaagagaaactgatttccaaaaaactttaaccgttgttgaactgaactgtcaataggattaaaaaataacagaaataactagaacacgatttccgtctaaaagaggggaaaaaaaggtaagtacgtttgtgacagaaaagtagggtgcatttttacatattcacccaccatgttttcatcttttcatgatgatgattggattttggtttagtcccaaaatcacctggtactttaccataattcgttttcatttatagagctatgttgttatgtcgtaattgattagtagagcatttgcatgattgacgataatctttttaattatgagataaaattttgtaatgtttgattatattgagtctaatggtagagatagaacacatggatctaagaaatggaagctgttgaagacgcccgatcacgactaagtgactaactagctattgatggagagcgagttagaggggcagctgatctagtatggtggtcgaagaaagtgatgatatgcatcgcggtgtctaaggcatggccttgagtggataagcctagtatttgcgctgaggatcatcctgtcgctaaacatctcctttggcctgcacgattttttttcttctcaaggcgttgtacaacaccacctcttcatccacatggaagaaccatcgtccagatctacgtagggttgcccttgaccttgctggctttgcttttcctcccaatgaccatcgtgcccatagccaatcaagagttggattttaatagagaatacctgtagcacctactccccccatataaaaagaacaacttctaaaaatgaatttggataaacatctatccatattcatttatatatagtaatcgattttttttcttggacgagggatgtatacacaaagatgctagcttccaaggatgcacagtaaaaccgctcttatgactttatatatattttttaagatcacaacttacattttaacccgatgtcatgaccaactagcggcttataaatttatacatcaagaattagtcttataattcacaacaaaatatgtatcacacaatttttttaaaaaaacgatgacatatacggacaaccttaaattccatatgtgcatattacacaataattattcctttctcctttccacttggtgttaatttgcaccgcacattttcttcgctgcacagaaaggtcagcactacgttcagagaatgtgtatgctacacacaccggccagaaccagagcgtgtgcttatgaatcacacaaacttaaacctcacacagtacgtagtccctgcagggaaattattgggtgtggctgggtggtgggccatgtacacacagattgcatctcactgttggctctagcttgaccggtctaagctagattggcagcaatgtcatctcatctctcatctcatctcatcaggtggtggccctggacttaaaagggctgtgtttagttcacactgaagtatgaaagtttggttgaaattggtataatgtgataaaaaaatttatgtgcgtatgaaatgtttaatgtgatgaaaagttgaaaatttagaaaaaaaaactttggaactaggcctttggccatccatggagcccatgggcaggacaggagatcgatcggcagatcgtccggcccccacggcatccgctgctgctgctgcacgtgtagcatgtaatcctctgcgtccttttcgccgtgcacagcttaattttggctttcagatcgatcgatcgatctccaagctaaacccgtgcatgcatgtcgtcgcatggccaaatggactttgctgctggctgcatgattgctttgtgcgtcgctccatcaaagttcttcgtagggagaagaaaagaaagagggttcatgcatgcatgacgcgttggctgatctgcagtaggttcacagttagggcataataatcccgtgttttatgcatgtatgcgtgtttgtttttttagaatttttcgttttacggaaaaagattttatcgctctatcgtcgcgtcaaagatttgattgctccatctctaagagcgtattctcgcttagaatcctgggtgagatcatcttgtcgtgttagtttttgattgaataggtcaacctccacacgatcttctcgtgtaccatgccatcgctaagttagcctcaatctctctaatatgagaacactgtccaatcagacatcccatctctactcaatcatttctctagcaaggaagtgagaaaacatgtgactacatcggtaatggtttctaatatgaaatatatataggggcttcaacgcggtcgagactttcattgttccaaatttacgaaggaaaggttccgaggtaagcacaagcaagaacacatgatttcttattgtgatggtggatgaattgatgttttttttatcaagggaagataaatgaattttactagaaaacttgcacacacttgtcgtaatatccattactcgggagttgaggactacacaacctttaacaataattttgataacagtaagtagttttggtgatagatcaagttgggtggttgtcataaaaaaatgtcatcatatcgagaacacaaataagggcaatagtttcattaatatgctaaaatctcccttactctatctctagagaaaaaaatgtcacttttgacaacagtgaaatcattgataaatacatcaaaactttttattgatagtgaaattattgactgcaagtttttgccaatagtgaaatcatcgaaagtgaaaccattagaagcatttatgaaatcatcgatagggaaaggtttgacaatagtgaaatcatttacggtaagtttttaccaaagaacttacataaatgctataagggaagaaaaaatgtggtaacattagggatggtttccaattgagacaatgattcggtttctcctagagaacttgcaccaatgttgtattttctattattttgcgggtggacaattgtactgatcaaatttgtggtaacaaatatgacaactaataattaaattttagaaacggagatatttagtatgaggccacctaaaatactcatggtagcaagttgggtcaaagattcggtcactctatttttaggtcaaagatttgatcattatgtctccaacaacaaattcttgcttacaacacaagtgaaatcatcatctcattagttggacttttattgaataggtcatcctccacaggatgttctcacgtaggcgtgctatcactaggctacctctatctctctaaggcaggaagcgaccctatcaagtatctcatctatacacaaccatttctctagcgatggaagagaaactttagcaacaccgatgatggtttccaattattattgggacaatggtttcgtttttaccaaggaactttcacaaatgatgtataatatatattggtttgggggtggacgttttgcgctggtcaaagtcatcacaacaaatatgacgaaagataattaaattttggagatggagttatttagtatgcagccacctaaaatacatcaagaaaacaagtcgggtcaaagatttgatcgttctatcgctagcaataaattctcacttatgacacaggtgaatcatcttcgctaattggacttcgatatgtcaacctctacattatgttctcatgtaagtgtgctacactaggctacacatatctctgcataaccatttttctagtgatgaaagacaaagtgtagcatctctcatagaaccatgcatctggcaagagaagagaattgtatcaacatcaggggtggttcctttttttggagggggcgatgattcagtttttactaaagaacttgcagagatgctatagtaatatattatttggtgggtggattattgcgtcgatcaaagttatagaaaaaaagagatataataattacattttatatatggatctatttggtatgcaataacttgaaatatgtcacaatattaagttggtgggtcaaagatttgatcactctatctccagcaattaattatcacttgcaactccggtgaaatcatcatctcattatttggacttcactatgctacccccatgtctttaagctaggaagcggccctactgaagtgtcctatttctacacaaccatttctctagctagggaagaaagcatagcaactcacacaaccatttctctagcaattgtagagaaagtgtacaaacaccagggatggtttataacttctgttgggacaatgatttagtttttaccagagaacttgcacaactggtgtactatctattattatttttcgggtagacgattgcggtgataatgggatgatgaatacataggttacataagtgagaatgtattgttaaaaatggagtgtcaaatatctttgactccgcgatagagtgaccaagtctttgacccgactttgctaccgtgaaatatgtttaggtagtcacatactaaatagctccatctctaaaacttaatttttatctcatatttgtctctctacctttagcaactcttctgccgcttcagcctaatcacctcctttctctcctctatccctttgcaccaccgcggctttctttaatggggtgagcctaacaaacactctgacacaagaaagcaccaaccgtggcagaccaaataccagtcaagaccacctccacctcctccctccttactcggtgcttgcttcttctcctcactttgctcgttttcctagagaggccaaatgttattctatctattactttgcaggtggacatagttgcattgacaaaagtcatagcaacaaatatgacaaataacaattaagttttagagatggagctatttagtatgtgaccaccgaaaagacgtcacggtaacgagttgggttcagcgattcagtcactctatcttcgagtcaaagatttgatcacttcatctctaacaattaaaacttacatcaccggcaaaatcatcatcccattacaccccctctttgccttctctaccactctaccaccgtgactttttttaaacgggtgagcctaacaaacgctttgacacgggaaagcaccacccgatgactagaccagagaccagccaaagaccacctccacctcatccctcctcacttggccctcgcttcttctcctcacgaataggccaaccgtcacacggtgttctcacttaggcgtgctaacactatgtttcccctatctatctctatctaaggcaaagactcagccatttcacataaaaaaatttcagccataccaagagcatccaatttatagaatatacgggggctctctatagaaaatgtgtagccatacacagagaaaatgtataggagacacacacaaccactcttctagcaagtgatgagaaagtgtaccaaacacaaagtatgacctccaattcatagaatatacagggggctcctctgcaaaaaaaaaaggagcaccaaagaaggggaggacaaaaatgtgaaataggaagaaaggcaagggggtgaggcaaagagtgtttaaagccataaagcgcagccctgtaattgtaacgccgccgttatgcttcctccctccctcctcttctgccttcgctctctcttgctctccaccaccgcggctttctttaatgggggtgacacgagagagagcctaaccaacgccccctaacctgacacgagagagagcagagcagcaccacccggtgaccacaccaaaccaccccaaacaccaccacccccacctccctccctcctcactcttgccgcctctcttcttcttcttcttctctcctcacttcgctcgctccctcggtcgctcggccgccatgtcgtcgcaaggtgacgcgctgcctctggttcttgttttgttcttgttcttgtttttgttttgttttgtttgccgggaggtttgatggggggggggggggggcgcatgcaggagcaggaggaggggtaggggacccggagctgttcgcggagctgtggcgggcctgcgcggggccgctggtggaggtgccgcagcgggacgagcgggtgttctacttcctccagggccacctcgagcaggttcttgccttgcctctcgccgccgccgaattctttggtttctgtccttccattctcgccgggagcgagcgagtgatgatgacgcgcttcttgttgttgttgttgttgtttgtgcagctgcaagagccgacggacccggcgctgctggcggagcaaatcaagatgttccaggtgccgtacaagatcctctgcaaggtcgtcaacgtcgagctcaaggtaatctctctctctctctctccggtgtgggggagcaaagagaggaggaaaaagaaaaggaaaaggcccccgtgaaattctcttacgtttccttgtttgtttgtggctgcaggccgagacggaaaccgacgaggtgttcgcgcagattaccctgcagcctgacccggatgtgagtggtgaccaccaccgtttttttttcttcttttttgttgtgctcttgtcgcctcctctgatggttttggaatgtactttgtgctgctgccctgttctacaatcgtggtgatccttttgggttccccttaattttgattctgctttctttttttttagataatggattaaaaacccggcctctacatccaacgggatgtacacagccatgattctgctttcatgtcctgaattttggcatgttttaacagcggtctttttttactgaaagtaaatttacttgatgtgtactttggatcacattgtgttatatgccgaattggcccggaaaaggcagcaattttgggtttggtgtgtgaaaaaagggggagtgatttggggctccactgtttttcagcaagagaatctgccaacattacctgacccgcccctgccggagcagccgaggcctgtggtgcactccttctgcaagatcctgaccccatccgacaccagcacccatggcgggttctccgtgctccgacggcatgccaacgagtgcctcccgccactggtatgcgtaattctcatggtttttggtgatagtagtatgttcccggctatgtatgtcaaaatcatatatcttgtttgttgctaatcaggatatgtccatggcgacaccaacccaagagctcatcacaaaggaccttcatggatctgagtggaggtttaagcacatctacaggggtatgcaaatttttgtttttattctcttggttatcagctcgatcgttatctaatcatttgaccaccacaccatgatcaagattgtagtagctttatgtgcatgctggcgcttattcgtgcaattctcggttccctaggccaaccccgtaggcatcttctgactactggatggagcacgtttgtgacatcgaagaagctgatttctggcgacgcgtttgtctacttgaggttagatccccacttaccttcagtgcttgttattcttcagacctgtacaagtttatgcagatgttcacaagatttatgtatcaaaagggatcatgcatattttgcttttgtaggagtgagacaggagagcagcgtgtcggagtgaggcgtcttgtgcagaaacagagcacaatgccggcatctgttatatcaagccaaagcatgcatcttggtgtgcttgcaagtgcatctcatgctatcaagactaattcaattttcctagtgtactacaggccaaggttgggccatttctgccatcatttgttatgatacaactgtagttattctctgctaatgggtgctgttgtttgtttgttttaaaggttaagccaaagccaatatattgttagtgtgaataagtaccttgcggctagtaaggttggatttaatgtgggcatgaggttcaagatgagttttgaaggggaagacgtcccggttaaaaagtaatggttttacctctggtttcatgtgtttctatttcactttcttcttgatatgttgtagcatctcatgttcaaatggtcgatgtaattttctgtaggttttctggaactatagttggtgaaggtgatctttctctgcagtggtcaggttctgaatggaagtccttgaaggtaagataaaatcatttattgttgttttagatttcttttcttaaaaagtgctgattgccatctcaactgttcttgatgtaggtccaatgggatgaagtcacaaatgttaatggccctgagagggtttccccttgggaaattgaaacatgtgatggcactgcacctgccatcaatgtacccctgcagtcagcaacgaaaaacaagcggcctagggagccaagtgaaactattgaccttcaatcactgggtatgacattcatttgtgcattgctcaacttgccaataacttgtggaattatttggctcttaatccttttgttttcgtttgcagaaccagctcaagagttttggctatctggaatgccacaacagcatgagaagacaggtattggttccagtgaacctaattgtatctctggacatcaagttgtttggccaggcgagcatccaggatatggtgccgtgagtagttcagtttgtcagaatccgctagtacttgaaagttggttgaaggatttcaactcttcaaacaagggtgtctcccctaccttgtcagagatttctcagaaaatttttcaggttaccagcaatgaagcaagaattgctacatggcctgcacgttctgcttaccaagctgaggagcccacttccaagttgtcttcgaacaccgctgcctgtggttaccgaactgaagaagttgctccaaatgcgtccaaggttgttgaaggaaaaaaggaacctgccatgtttcgtctgtttggtgtggatttgatgaaatgtaccagcatatctactaccactgatgacaagtcaagtgtgggagcaggagaagcttcagccaaaggtactggttctcacgaagactctggtcagctgtcagcattctcaaaagtgacaaaagagcatattgctgcggatgaaagcccccaagagatccaaagccatcagaattacaccgctagaactcgcataaaggtataaatttatctgtctccccctcgagaccttttatggtgcttgggaggtacccagggtacctctcaaactattgagtatcaaccgttgattgctaaagggtagatttgggatagagataatttaatttgcacagattgttttaagtcataagaaccatgactttttcctgatcatttgctgctagccccgaactttcttgtctgccattgatatgctcgtcttatacttcattattctttacgtaattcatcttcacttgtagcgtatcacatctctgttgcctagcctttcaaaggcatgtttgttctctgttctctctggctgaccatggcggtggctcgcattttataattgatttatcgatgaactctcaaagcatcaaagtttaaaatagtagtactccgtattacactacctatcatataaaataataactcagtagtctatcacagattccatgtaatctgtattaggatcttcatactacgaacagtttttgaaaaagaactgtactacgagcagtttgatcgagaagaaccaaaactttcttcaccgatttgccttatctgatagtaaattgatataataccaaggacaaaattacctatctaacctcccacttaatctttaaattaatacctggcccacttcttaagtaccttttcagaggtatcttttgatgtaaaccattagattggggtggatcaacggatgttatggtttcaaagtaccggagaaagtctcctcctgcttcttaaactgtaactgactcaacatttctactaggttcaaatgcatggaaatgctgtgggcagagctgtggatctagctaatctagacggatatgagcaactgatgaatgagctggaagagatgttcaatataaaggacctcaaacaaaaatggaaggtggctttcactgatgatgagggtgacacaatggaagttggagatgatccttggctgtaagcttctgcatatttttaatagagtggcagattattgttcatccgacaaaaacttatgattgtgtatatttgcgattcctgcagggaattttgccagatggtcagaaagattgtgctctatcccattgaagacgagaagaagatcgagcctcacccgaagttactgtcttcagctaatccagagcaggatcagaagactgggttttaggagggaggctagggctgaaaggtggattttttagcctttcaccattgaagcgttggtggctatcgttttgtcgttggagatggtcgtagctgaaaaaatggtggctactggctagttcatcgtattgatgcaacagatttgttgctggtgtcaaaactgtttcttcacaagcattttgaagaacaaattgatgtaacataggtttcaagaaaaaaaaagatttgacaatgtctctttagtagtttgctcaagtttagtcaaaaccttaatggtgcttaaggaataacgtgaagctataaaactggtgtgtaagttctgtaaatattataagggagattataattttgtgatattagctttcaccctttaatttattggtatatattgacatgtagatttcattgttcttgatcagtctgatcgtctgaccttgctatcagatgtactgaaccatgtttctcaatattttcactattgcgatttaacattctaaaattcaaggcgaatgtggctattccacttctgaattctgttctctttggatttgtttgttgactgaacatccttgtcaatagagaaagaaacttcctgcataatggttccagatattcaatttggaaaaaaaaaacgatgcctaacatgcttatgatccaaacggagggaaggcttgaagaaacgagctgggatatagatttggaagtttgttttaactttgattttcagatttttttttatcatagtatatttcttattgattttgaaatcgctataagaacgtagacctagagaattcaagattttggccaacagaacgtcaagacgttcattcgaaacgcatgaaattttcctcaatagccttcgaaacgcatgaaattttccagtatcttcgtagtaggtttgatcagttcctaggaaaaatatctcccttaaaaaaaagaagaagaaaatcctcgcgtgcaaggagatgcacggcatggacggacgcgtgatcgccgtcgacagggttagcaccgggtgattacgtacgcctccgtgcagatctgcgcgcgcgccgtgcgtgcgtgcgtgcggtgcgggggcggcagggaggggtcgccgtccggcgccggccttgtcccctgtcggatcctgccccggcaacgcaaccaccaccaccgcgcacgcacgcacgcacgcgcgatgccaacgtcgtctgcctccctcgatcgtttgtggagcaaaaattaacgggcaggccgagctcgcctgcatgtagctcgatcatctgcggaaagcccaaccaaccaaccaaccatgcgttgtacgtccatcgacgtggttgccgggcctcctatagaaacccggaagaaaaaggtcgactatgagccggggttttgattcgcgcgcgttcctcgattgcaaaattggtttgtgcaagacaagtcaggtgttccccctggcacaccgcacagttcagctgtgacatcttgcacattgtaagatcaattgcttgctttgatgcgtgagtttcaacattcctttagtgattagtagtatcttgcaactatttagaagctccctctctcagttgttcggagagcaattttagttggcgcggtgtctatatggcgcttacgtgacaaggacgagggaggacaaattgacacggttttaaccatcaggaaataaaatgatttattagggaataaaaattagtttataggttaaacttttgtatatactagaaaaaatacctgtgcgttgcaacgggtaattctattttaaatttattgttgttatacggtttaactagggtaaaattcactgtgagaattcgcttataaattttttttagaaaatcataagctgcaattaggagtccatattttatctcaagttagcatacggatttctttaaatagatttcttatacgactcctttttattttcaaaaacaaatgagcttaaaatccaactcaaacacgaatctgtatttttaaagcgaacgaacttaaaaacttactcaaacccgtatggcgtaccagaataccggcaaaaaacatcttcaatttttataatagtagagatgtttgtagctatttaaaagtcaatactaaaagaaaactaagttgaaaatatctttaaatcaacttcaatattaagttctaaaatttaaattttggcttttgcttattagtacaaccaatgaggctcgaagtctatgtccgatttacaggtacgcgaaccaaattcggcctataaggatatgaaacagaccttttcctaaaaaaacacacgtgcttttggcaggcctgatcagtagtactgctccgattcaggcattcaggcccatctgccaatgccaaaaaaccaccgcggccgcgccgcactgccgccgccgttggcggttgccgttgccgctaagagcaagttaaatagtataatcaactactaactttaaatcatctatagccagtgtaatagtgaattcatacaataattgtttactatactattaatacatggtcccatatatcatacacccattacgttttaaagtccgtgctgtagctggctacatgcagcgctgttcttctctctcttccttaatctcttgtgtacctgctctaaccggaagcacaaaccgggggggtgcatgcatatttactcctcctccccattgatggcggggcggccggcacggcggcctgcgtgcggtgtaccagcaagctactactagtcctcccgtagtccggtgcccacgcgagggggaggccacgcgagacgcaacgcaacgcagcaaccacaaccacgggcggtcccggcggatttgacagtgcaaactgctgcaaagtatggtggtctcctcccaatcttgtaggtggtcgggccctgcacctgctgctgctgggctcggttgaagtggcgcagcaactggaacccgtgtttgcctcgaaaggttggtcagcctgttcaatgttcggggggtagtagttggcaggtttcgcagttaacggtaaccatattttttttaacttttttttgggactgaaatggtaaccattccggtttctaatcggcgaaattaaaaaaaaaacattcgaaaatttgttaggttccttactgtgacatctgcccatctgagttcgggtcttcgactcggcgtttgtaggaacgagtgtgagcatttgtatacgagtgtctacgtttgtttgtgttgtataaaaaaacaaattgagatatatctttttagcttttttttaagattttattggttttctttgtttttcgagttgctattgcgatcagtgatgaaaccgctttggaacatgtatttaattgatgaatggtttgactaatatttgtagttattagaggtgtatggatggcgtgactgtatcctcgtaggtgagtcatgccctttttatcctgcgttttttactccgatcatagccttagaggtgtatggatggcgtgactgtatcctcttagatgagtcatgccgtttttaccatgcgttttttactcttctacatttaggggtatttaacaatattttcgtaaggtaaaatttgcttctatcgtgagataaggagactattaattacgaataatttttaataaaaaaacacttctactttacccgtctcgtcgtgtattttgtagttatttttttcaaactgttaataataacatagtactagtaaatataaagcttttagtcataaagtatttttatttgcttagctcattgtagcttcaaccgatcacatctttctcacccacacatgatacataggatcacgtgagccacgaagtagcagtattaaaaacctcatctcaagatcctgtgcatttatccctttagagcaagtttcaatagtatagccatctgctggctccaaatcatctatagtcaatctaatagcccatttatacaatagttacctataaaaatatactacatcattaatacccggtcctacctctcatacactcataacgtattggagtccgtgttgcagccgactataaatctgtagcccgctttcttctctcttctcttttcttctcgatgtgtggttatagctggtttatagcctgctattatacatgctcttagccaaccatatgatctcaccggtccattacacaaccctactattactgtacaatcctacacgatccatgctgtccttccttcacttcacttcacctacatgcacggttgcccctgggccccacccccctaaccattgctctgcttgtgggccccacacatcagcctcacattgcaagggtacactagccgaagccaaggaaggagcaataaacatttaataggggttgttcaaattgatcttgtttcaaactatacaatttttaaataaagtagtcaaagatatgcatccatttagttttttattaaactttgataaatacataagaaatcctgtcaaaacatggtaatattgtcaaattttcaaaattttggcattactcaaaatttgataaggtttattttagttacaatctaaacagcccccttagagcatccctagcagatgttccatccaatcctccatctgagaaatagcggatgggggtgaaaaatcggccaccagcggatgcgctaaaacaggagagaggaatgccaatttttgcgttcttctctcctcacgccaaatcgcaaccgcctctcagggtcgagctcccgcccccatccggaattcatagaggtggcaggcaaagcaggcagaggaagagagatatggaggatgaggcgcggcaactggatcgaaggaagaaggaagaagggaggtagagaggtggcaccaaccggatctgggctagggaggtttattggagaagaagcgccgccgcggctcctccgcccggcgaccgaccgcccacgccgctccccgcccgcgaccccgccgtcggtgccgcggctcctccgcttggtgaccgccgcgccgccggtcctcctccgcccggtgaccgcctacaaccccaccgttcctctgcccgacgaccacccatcaccctcccttgtcctccccgtcgaagcaacggtagaatagaagagaggatgagggaaagatataaatgtaaatgtttggtagttgaaatatacattaaaatatatatggatgatgtaatatggatggtctgttggagtgaagaaaaatacggagtgagaatctttttggatgaccatctaggcccctttgattcaaaggaaattcatagaaaatttagaggatctcattcctataggaattttttctatatagctctttgaattaaaggaatagatcttatggaatcctatgaaattcttatagaatacctaggaccatgcaagttattccatagtaccatgcaagttttggaggaattctaacatgaggtagaaccgcatggaaactttccttctagtctttacctcttctctaattcctgcgtttttcatgtggtccaatcaaacggtcattcttgtgttttccctgtgttttgcaatcctttgttttacacttacatttctatcaaaatctcatgtttttcttattcctacgttttttcaatcatacgatttaaaggggcccctaaatgtgaaaatggaggataaaatttagatgagctccgggatgctcttagctagtactagtactaaaatttagtagtactagtaccagactaccaccaatggtgtcacttgtgtgaatgaatggccctctgccacaggcaaacctttgcctgctggctgctgccgcccctctcatttctcatttgctctttgctccccccaccaacatttttgtagcagaaaaggagccaattttttttcactcctagtagtcctactcctatccccttccttcccccaaccccttcacacttccatcaccatttcttccttcttcccctagctagctgctggctgctgctgcttctctgggccctcgtgctgctcttctcatgtcaccaccgccggccgctagtgcctttctgggagccaaccaggaggccccgaatcagatcttggcgtaggtttgctcgactcgctgttgttgacggtgaggagggcgcttgcctcgtctttctttcttccaaagagcctgctcttttcttgggtttggcctaggaggaggggtttttggtgttcttggtagggaggaggattcttggcatttggcgagagaggggggaaatcttttgtttccttgtctgattctgctcggtcggtgagtggtgcggcggcggcggcggccatggaggcaatcacgatgtcgccgtcctccgtctcctcacaccacctcgacgtcgacgctgcctccaccagcgaggacatgtcgtcgttgcaggaaggcctcctcttctcggacagcctcaaggtatggtgatgaatgcgatgtgtcacaccgtgtgtgtgtgtgtcttggcctcctcaagccgtcaagatgccgcaatctttgcttcttgccttcttcttctcccacctccttttgccatggatctaggtagaaatcgggctgcgatttgttgatttcttggcgaggtttaagaaaagtaaaaacctgatgatgatgatgggtcttgttctgggggtcacactcagttgtgtctcgtgtgccgttttgtccatgtcaatcacaagattttgtccctagtttggtagcaaaacatgataggctctctctacttgtacacctttccaagcttcactgtagttgtaatgtttgaaagttcttactatgccttctacttttactatgtggttataaatttctgatcttgtagtgtactacactattactctctgtaatgtagataatcatctgtttcttgcataattggctgtgcaactctgcactggctgaatctttttaattgatttctccctaattgagcaaatggagcctagaagacagaaacccagttccaagggcttttactagaaagcagcaaaattacttgtaaattcatggtctccttgtccattttgaattttggacggcttaatttcctttagcaagttgatcagtctattggtgtgaaccaatggcgtgcacagttgcattcctttgtcaaaattttcggtgctcaggataaagaagttaggatccttgttcacaacgaaaccccacatgccttcgcatgagttaattagtaatgtttctcccatatgtagctgagctggcatttcttatagtactgtatctcctgtgctgggcttaaattatatttctttgtaggacctgaggaatctgcgttcacagctatactcagcggcggaatattttgaagtattctacagaaacaattctcagaaatctacgtaagatcttttgttttatttggatctctgtttctttgtttaccttgctgcattaaattaagggtaaaacaaatctacactgatctgctgctgtagggtgatgacaagtctgaaagattacacagttgaggcccttgttagcactgtcgaccatctgggctttgtgtcatacaaggtggataaccttgtcaaggaaagatccgatgaggttaatgagacagaatttcgagtatcctcagttgagcaggtacaaaattcatatgtgcactgagtttaaaggtcattttgtatgtggtccgttaactaccttgtaattttcttaacatggagtgaatatcacatacattatttatattctagtacttgagtatggcctcatttattacagaatgcttggtttaatgtctgctaaccttcggaacattgctcaatatgattacagagagtacggatttgccaacagacaatcgaccaggagggaagatctcaacaatctcttctcattagagcaccaaaataccacaggcgttacatattgccaggcaaattcctactcagttttgttatgctttttatatgatgccttcttgtaaaatcacttatcaccgtggttatgttgtataggcacagatatagtggaatcagccattcatccagtttcagaacctccacggtatagcaggcaacatatgagccgtaaaatgcacaagtcacaatctagtaagtttactgcatttctgaatttttagagagaaaactgtcattgattttgaaactgcttttcttcctgcagtctctacgccagttggcaggcaatctacaatgaggtaaacagatagctctcagaaccctgttttatatttgctcctgagtcaaattgtttataagcttatccactgattgttctgtatttttaaagatatactgtgggatttgattttaatacatcttatgtcacaggagcgcgcgttcaccatctccttcagctcgtggcacacatcatcgatcacggtccttgtcaccttctcgaaaagcacgagctaaatccccatctccccaaatcatcagcacacaaacaaaaggcatgttatcttcactagatggtttacacttgtttctgaatgagaaaatgtcatatgttctttgaatgttaagctttcagaaaacataagtctaaactattttaattccttctgctgtgcagaaacaagagcaggttcaccaataccgaattccaatccccttgcacgatctgccacggttgcaagaaggccacctgttcatccaaagcattttgtatgtttactatagtaccaaattatatatttacattaaggagataacattatcctactagatcctaagaaagcctacatcatttgttttcctggagttcaatcatattcagaagaaatttttatttattgcttctgatgtagtatttcttgcagagacaaacttcaatgcagttacactctgactggagcaatcacaaagagcaggagaaaagctcaagcaagggcagggggttcctcaaatcattgctcacaaggcgtcggtggaggaacgatgagtcattgtacagctacttggacgaatattgatttcttaaatgttactgttaaccaactctcacttgttcacttatctgatatttgagattttagcttttttgtccaaatggaggcattttcgccttatctttctatcattttcatgtgtgtatacaatgagggcctatcatcagtgttgctaatggcattgcgcaagtgtatccatcagcaactactaagctgttcagataagctttcccaattccattttcacttttcagtactcgtatgctctccaagtctccatttctcctgataccaaggtacaatcacaagcagaataatgacaatttcactagagatgaatcataaaccatcttatgccctctcagatgctgtgaacttgtctcatatggtggtccattgatgtttttctaccttgtgactgttagcaatcttgtcatacatggagctggttggcagtttctgttgaggggatccctgagggctgtggttgcaatagctaggagctagtgctagaaaatggcagatgacaaacatggccctggtttttttttgtcataatctgtttgtaaataattggattattatgcttatcaactaaaatttgaattgtaatcttaaatttggagttgattttgggattttattcatcatagtttagtttccagt

SEQ ID NO: 66122 - DNA, 3156 bp, Oryza sativa
actaaagatgatctttagtcccggttggtaacacaaaccgggactaaagatcaaatgtgcccgttacccttttgaaccgggactaaagatcatctttagccccggtttttattgcatccgggactattgtggaaatcggccgaccgacgaaagatggtttctccaccagtgtacataggtaggatgagactagagtgatcagtgagggagaccactgacattctgcttgtgcttaatcctcttaactctgaagatcatccttcctgggcccccactcctcttcagaaaagcctgaagctagcttagttaagtgctaactatagcactgatccatgattaaaatactaattacctccacctgttaccagcatccacccaaggactaaggacaaaccacgagccaagctccgactattaagtcattaactaaccaaaagctcctcaatccatgccccctcctagatggcactttatccccttcattaacacctctcccatcccttctaccaacctaccaacctaacccccccaaaaaagagagagcatctcacatgctctccattctctcccccctggccccctgatctccctcctctctatctacaagacaaaccttttctttattttttttctttaaaaactgtgcctccttttctcactggctgctcatgtgattgcaaacattcatcaagaaacctaacttcccataaccaccagcagcaccacaaccacagcatgcaccctccttcactttcatcagtatgtaccactcactccttacctccctcatctttggccaatcaagagcatctccatataaaaggagacataaaaacaagttgcaaaagggctactagcatgcatgagggaaataaagtgtttggaaagctatgtgttgagtgatgcattcttatgaggtctccaaaagggcatgtttagatctaatggtagatcatcaacaacccatgtcttgccctaaaaaaaactatctatatgggttaaaagaaactagaggaagacaagaaagaaataacaactaaaactaactcatgaaccatgtcaccctgatgaatgatgatcgatgaagcatgatgatcactctggccgaggctgcaaatgaggggaaataaaaaaaaaagagaaagagatcacatttcctgatgaatattacaaagagctaagcatgtgtggctgggttttaattgcgaattaagtagtgtatatatatctcctccctcaacttaattaattatgtcattgttgtgctactactgttgtggtggcttcctcctagcggcgtgatgaatctaaacatgtgtgtgctggcctgcatggagggggcgccgccgcgtccgcagctgcacacctcgccgccgtggagcccgaggcggttcaagcacaggcacaccgccgccgtcgtcgccgtcgtcgtcatcgctgcattgccggcgccgttcgccgtcgctgacgcttcgtcgtcctcctcctgcttcatcggctcgctggtctgatcctgcggctggtaaggagctaggctgatggaaaggttgaggtcgatgccgaggtgacgcggcggcggcggcggcgtggcggagctgggctcgtcgtcgctgctgtggctgcaggcctccggcgagttggagaggacggcgaaatggtcagggtggtggtggtggtggccggctggcgcggcggcgaaccgccgtggcgcctggagctgctgctgctggtggtggtcggcggcggcattgagcgggcggtgcgtctgcgggtcgacgccgcgggcgaggagcttgcgcttgatgtgcgtgttccagtagttcttgatctcgttgtccgtcctccccggcagcctcccggcgatcagtgaccacctgcatatacaccatatagatatatgttattatacacacatcgatcgatcagtgatcagtaatatgcttgtcgattcatccatcgccatgttgtcatgatcggatcatgattctatctcttatatagctaatacaatatttatcttctttgcaggatggccggcatggaggcttacttgttgcctagaagctcatggagcttgatgatgaactcgtcctcctcctcggtgaaattacctcgcttgaggtccggtctcaggtagttgatccatcgcagccggcagcttttcccgcaccgcagcaaccctacacacaggtaacactcagtcagtcaccgtcgacctctgaccatgatcgccgccgccatgcacgccatggccggagtagcatgattttgtacgacgttgtatatacctgcggccttggggagcgacctccagcatccctcgccgttggccttgatgtaggcgatgagccgctggtcctcctccttcgtccaggctcccttgttcgtgtgcgccttctcgcagcatggggacctccccatgctagctaggctacctagctcgctacacccagatcagtccctctctctctatatatatacacacacagatcgagggaaagctctcttgttgatgaagagaagaagcacaggagcgagggagggaggaggaagatggagatgagcgggggctggttgcaggtgatgctttgtgggagctttttcgtgagcaaggagagagaggagggtggtggttggttggttttatacgagggagagggagaggaggggagggccccattgacccggatccctctgggccatttgaccgagttggtgcgatgagacgagaggaggagcggaggttggttgagtggctgccatttgcaaaggccctcccccccacggggctggatttggtaggtaggtatacttcactcccagtgctcctcgtcctattccctttccttttttctgtgtctggttttgtttattgtttcatcttttatttttttttcagttcgatttgtttttggaaatgggattgttggttgtacccggtgagtgtaccagatgcgtgagttgggcgcgcataggtaggggtttttcttcgcctccgatttggtgggtgtccttgatggtacatctttctgaaatacgtatgtggtaacagcaaaaaaaaagttttttattacagcatctacggtgttgtataattgtgtattgatatatgaataaggtatttgttagttttgctagtaggacgatgatgatgca

SEQ ID NO: 66123 - DNA, 38702 bp, Oryza sativa
  unsure (1)..(38702): unsure at all n locations
agtgcccaggtaacttttttctcttgaaagtcacataaacttttcaataaatctactttacaaagcaaaagagaagaaaagggttaaagatgttttgacattcatactacataggatgagttaggtctagtgaaggttctacccatgagaaggaccgtgcaaaacccaaaaactaaagtaggtgggatattgtggaagcatgcggatatgatgcaaagctcagtatagctttacctaacaccacagcttgagcaactgaaagatggcatatatgatcttaagtaacatcaatgatgtagagtgcaataaccccttctagaacgaggtaggtcaggtccaaaaatacttaagacctttgatattgcatcacaaccggcacctaacaagagaaaggattaaaaagatattataacctctagtgcacccaccaagccactctggtatgataaaagcttgaagatatggtaggctcgatatggattggaagcttctatgaatctttgtcattgcatcacgggtgctacctaacatgcagagaacaagagatagtttttttcatatttgcagaatgacatcatgactgtaacattttgttagtaattaattgtaccactgtccttgtctaactcctattttcagcagactgtcaaaaaaataacaataagaaaatcttagttgttacattactgttgttccactttcaagcaatagcaactaattaatatagtgattcatgtccctctcatgataggcaagagcaatgtaaatattaacaatatgtacgaaatgatatgacctgcacaaaggtgactaagcttgtatggcattattaaaaggaaatgtctatccaaaggttcaggttaggccttttagacaagttatttaaaggagtttccatggtagagcaaaattgtctatgaaataaatgtttgttgcagcagaagcctatttagatgtggttgactttaaatgcataaagcaaaagtgatcagctgctgaaaaatgtaccttgctaggacaatatttctcaaatatttgatgaagataaatactgtacagcagaagcaggaaactcagattctgggagaggttgtgttttctaaagaggtgtgtccaaaagatgctaactgctcaggtcatcctacaaacagacatgagatgataaacctcagagacagaatacccatgacacaagctaaaaatattttgctgcacatggttgaacagttggagcaattgaccagatgttcaaaataagaacttctggatgggctggccaattcatgaaaagaacatagacatggggtccaattcttgttcaagcatttagaagaaagcaagaattaacaaggccagtcatgggccttgggcctgaattccagaccatcatttaagtcacactacaaaaattatgccctccaagaaaatcatgccctagttttcaaggaagacagacaagatggaggaaaagatattgtgatttacagatttccatatttacaccgcttcttgaatctttgtcgttgcatcaccagcttgaggattattacttcacaaatatgattagttccttacttcctttggatgttgttgataatgaccgtgctttgatgctcaaatcatgggttggaaacttatgctttttcctttgaagtatttgggagcccaccttcattttaaatagacttagaaaaaaaagataaccagcctaatgttgataaagttgtgaagagtggctggctggagggtcagaattctatcctatggtgggcaattggttctgattaaatttcttgtttatctacttttctgttcttaaattcattgtttggtctgtgaaggctataatagatttctgatcagaatgggtctgggtaaatgaaaacactcagatgatggttcttgttgattctgctctgaaaatgaatctgtaccaaaaaaaaaattactgcaatgttgctaaaatcctttggacagagatgtcgaacatgttatctcgccaggccggcagaagccggccgaagtttattaagggaagtcagacatgctatctgttttggtaatagtttaaactttgaatgtgttgctataagtggaaacaagatttaacatccttgtggaatatgagaaatgacctactttttttttctgtgttacattgaagaagtatgaagattgtgcagcacaggatgatgctgacattgaggaactggagtctggggaatgttgtgcctagacagctattatggctgatggaccagaatatgtaaagagtgaagaaggggctggtacagaagagattgaagattgagctgtggagcaaggggcagagcttgaagtggaggaactctaccctatgtatgagaagtaatcagaaagcatgtcaggttgtttagatttgtgtgccaaaagcatgcgttgctgtctacaaatctttgtactctgggttagtgtgccgtgaagtcatccatgtgtggaattttgggcctgtactgcttcttcagcttggaactctgtaaatatgttggtctcgttctaatgaagtccagaactgatgcttagccctttggttctaagaattattaggattatccttgtttccttagtgacttacctccctgtattcccttattaacagcatcatgccattgggccaggtatgttttagtatgctcctgagctccataaaaaaaccttaaagttctagtcaaggtcaagtacaatggaaacaagaacagtatcatatccactgggcaatcatctgatctgtgcatgaccatagataaaccactccattatttaagatcgaagtttcaatgcaagcagaaaatttaatggagtgtgccaagaaatagaagattagcatgtaagcttattttcttcttgtgttttatatagacataggcatatccgcatatatcaggattgtcaacatacctgaaccagagtgccttaccactatcgtatcacacagatgcatttgctccagccaacagtaatctcttttatatatgtacttctaatctatctgtggtacgcattgatgcttcatttgagcagtgctgatgtatatccctgcagaactgaaaagcccactgaaaaaaaggaaattttctgcataattagtatttgtattggacaaactaaaatgcataaccattcccttaatcctgaactcaagatacagtgcaactttctagtgacagagcatcagaccataaaatgtgggaagattgtaataatattggtcgttagttatgaactgctaaagtgctaagacaaaccactacctgggtataaatataaatagctattttgttcaagacaaaccactacctgcgtataaatataaatagctattttattcttttcttttacaataaatagccattgtgttgattgttgaccactataaaagacatggcggaaaacttgtattgtcaactaagtatttacaggataaagcaaggatcaacattcacatttcaattggtgaacatcgaccaaatgctcaaccgtgcgaaaccgtatcagcttactatggttgagaccaatatgcaagtcatgttgtctgctacgcaacaatttaggtctgtacctgaggtcatgctatgctctaggcagaaatttacagattcctataataagaacctgaaagccaatttttcagtcacactgaccacccaattgcaaccattgatttcaaattggcaaattggttgcaattgggtggtcagtgtgtgtttgataaattattttactaaaattcatcgaataaatatttcaagtaatatcggtcacatgaagcagaactgtatgatacgtgggcccaaaattatcaaataataaacatgtctaaatatatccaatattggacttgttctgttgcgtattccgaataaaaaaatagtggtgcaaacagatttcaaatttgatgcacagtctaaagttttgaggtattcaaaataaaaagagattgactagtactacgtgtaaattacatttgatctgttggtggcaactacattaaaggtgggacccactgtcattagtagagataatttcctgattatctccagacttcagtaccacgtcgatgggttagctcatctctgcgctctggcttggcttatcacggagattaacgcgtggcgctgaaagtgcattaatccccctagtgggttttggtgattaatgacaaatgtggttaagggactaatgagttcattaagtgactttcaggtgcattagtccaaagtgtggaagatggatgcttggagaccccaaaaagtacaaaatcaaagcggaccggaactcgagaagtgcataggatagtttatcttttgaaatcgagtttttaggaaaaaccgtactattaaaaggggttccaggtgatgctctgagatatatcaagtgctcttagtgtgaaccaagtgtcaagtttccctaggagtcatttttgcaaatactccatttgtccaaaaatgcaagtccggaacttactgtcttccaggtccggaagttccggtcttgtgaaaaagattttcctaagtgtagtccggaagttccggtcttccaggtccggaacttcctgtctagtttccagttcaaatttgtgagtaacggctagatgacgtcacctagccgttatacatatacagctcgtttccagctcgttccttggccattccactttcatttttcaaacctagagctattgctagcctctcccaagtgtttctggccttctccactcaatctagagcctaattcttgtgagaaagagagattgagagggagagaagaagatttggagatgtgtgaagactagatcttgggtgagcacttggaatatctcgtgggctgtcatctcggtgcttattactcttggagatgatctcctagacggttaggtgtcgcccgcgagaatccgttgcatattgtggatgtcccgggtaagtttgtgaaggatttcctctcctccgaaagggaacgaggtaagttagtgaagttcttgtgctgagattctagaggctttccaagtagagcaacccacacttgtggtggatttctagaagtaggttgagttggatcttggtggtcactcaattctagaaatttgcctaggggtgtttggggttgaaggctgtggattttctctggggtttttgcacaagtgaggcaaggggttaatcgagacccagctctttggagctcctcaacggagagtaggatcgcaagatccgaacttcgggaaaaaatcgctcttgtctctttctgtgatgtttcctgtggatgattctgtgatatatcctctgcttagaatacctgtgcaccatcttgtgaagattagcttagtctcttgtttcgaaatttgaatttcatctctgttctgttacccggaagttcctgtcttagaacaccggaagttccgggcctgggaggccggaagttccggagttccttaccaggaagctccgggtctgtttgaattttaccgcttcgatttgtttttaagttttcagggacagcctattcaccccccccccctctatgcttcatcaacgcgttcaggcgctagaaattcggaggcaatttccattgcctctgcctatataagacgtgaaccactaggtgtcgcgggagaggggaggagaccggagaaaattagaaggagaagaagagaagcagggagaggcgcacaaaaacaactcacattgatctatttgctggtggtgttccgaggagattagaaacttctcggtgactcgcctgcagttcgtgagcaagcgcgccacagtgagattaaatatctctcatcgtcgagccgatgtcgcaagtggagatgatggtggtagatggtaagtatgataaataatcctctccaaccctgttggtaaaccagtcgttctaatggattatcggagtacctccttctcatcaattggagcgctttgaaaatcaaatcgcctccattttcttaaagcataaacttggatttgcctaatctgcggattggattatcctcgtattttttataatcaacactcttatttttatggtgcgcatgccgggagcgagccctaaattataaacaaaggaggagtggagataaaaaaaaaaagatatatgctatgttcatgaccgacgaggccaagcaatgcattggctaaagctgaaaaatgctatggctgttatatatgtctatttataggcgaaaccatggccgagtgctgacaaggccaggtcactatactattaacacgtctagtctaaaatgaacgggagccggatacaccgttgctgggcactgacgaggcaaaagcaaccacaaaaaatccatgtttgatgaaggccgagatacatgactgggcaccgatgaggcaaaagtcacccgcttcaccaaatttcctctacacgccgacgtgatggtagtgtactgtgaccgggttttggtgaaacaaagccacccgttacacattcactatattcaccgtaaaatctgcaccaacctcaaccttcagcgagcaaataatnnnnnnnnnnnnnnnnnnnnagcgcagcttaatcggaggtattccataggctcgtcctgtggatgtaattaactggtagcctcattgctaggcgccgggaatcagcgaactgcacgcaatctccagtcagcataccttttcattaagcatttctcgcgaaggcaaaaggcgaactcctgcgggagccctcatgtatttgtaaatattcattaaatacagggtttccctattttctgtgtgttcattgttttgttttcatcaaacagtgtgaatcgctgcagctgatcaaaatcccaaaggactaacactgaaaccaccccttcttggtgaatattacatttttgctgttgtcgccgtgcaaatgctcccccccccccccccccacacagacaagagacgatgcaattgtggctgcggcgtatgccaaactgccaagacggtgctgatcaccgatcagccaaaccaccgagcaggtcgcgggcgtggggaggcaggcaaccaacaacccaacgtaccagagctgacacgacgagaatcaacgacgccgccaatggcgaaccaaaatcgcaatcccggcgccgaatctcctctactctgtggaatgacgcgaacagcagagcagagacaacacccgatggaaactaccacatcatctgcaacggattgctcccccccccccccttcccccatccgcttaaccccacggattgctcccccgatcccgcggcaaaacccctcaaacctcacatcacacgcagcaacaagcaaacaaaccctagatggagtagaaaagctggagagaactaactgtagatgcgttcgcgggagctcaccgattgcggccggcgacggctggtcccgaggaatcctccggtggcacgggtcgctcccgcggtggcggcggtgagctccattgccccccgagagattttgaaatgggagtaaaaatcaagagatcaaatcaaaatgtcctcgaaatttcgaattcttttttttttttttgttgagagatggtgttgtgcacttgtgcgttagcgggaatgcggcggacgacggcgttttggcgctgtgacactggtgcgtggggcccacttgggaagctttcgcatttgcaagggatcgtctcttctttgctaggcccaccactggttttatcgaaatcattaacaggtccttccaggacttggattgaaaaggcgtgaagataagcttgtgatttttaactcttacatatgggttttgcgcttgtgtaattgtgttgcctctagcacctggccacctgctacgagaaaatggccctgctccttttataatttttctcaagatttttaccacggattatttgctcctcacttcttaaaaaatatgatttcttaaaaaaaaaaactttctctccactacagtgattagacaacctattctaaactatttttaagtttagtcttcaaaatattaatcattatattaatcaaataaacaatccgtgacaataatccaagcaaatgtatatgcatctcatgttggtgtcatgattggggatgcgtcacttagatttgtgttgtgttgatagcatgttttagattgttgggttagtagtatattagatcgccaaaagcttggatgtgacataagagttattgcctgtataaactatgcatattagcatgctcataattttggatttcctctcttgtatgtctagcaataagttgttcccttttatttttagtgccccattgctaccaaaagattagttacgctaggtttaattaaaaaaacataaccaatttactaatgaaaggtcattgagatttaaggtaagtgttatatttgctgtgataattcaagtcttgtcctaattttatcaaatggaatcacagtttcacatgcaaattaaaacatgaaagatttgatgaagtcaaaatagcttgtcatgttccgctatagacaaatacatgttttatacttgtcaaaggaaggtcattgacccctttgacaatgacagatgcggcttcatcagagaaaaggcacaaaaagtgacagaaactactgaacgtggaggccactagaggtgacgtggaccattggaagtataaaagaccaccagcggatagtaaagacctttgagagagtttataccacttagatccaacagagtaggcttgtcctatgaggccaagccccacaacaaggcccgtaggacctagaagttggaggcttgcaaaaagacatgtatgcccttgtacatacctatttgtaaggggttgggatataaaattacctatgtaccataccctagccctatacaatactgggtttcaagggaaatgcaatgaacatattttttaagaattaagaagattagggtttgagcgtacatcacatcaagggcattggaacttctctaaggctgtatttggaaccctaagttcccaacccctctacctcgtattccacgtgcacattcaaactgctaaatggtgcatttttttgcaaaaggtttctaaatgaaagttgcttaaaaaaatcattttgatccattttttttaaaaaaactaatacttaattaatcacacaccaatggaccactccgttttccgtgcacactgtgcgtgttgggaacatatgcttccgaatacagcctaagttcttgccctaacaaattgttgcctttgataacactacctttttatttgttatacataggatgatataaattcgtcaatcatacagtaattagcatttacttccccctctcaaatatatgactagcctaaaattgcaccaaaagaaacacaaacaataattaaaaggctagcatatctatcttctccatttctcatactcaaaactagttggtggtctaccctaagccttagattttgttacctagactctcgttgtaatatacagatttatgtctagatgaaaaaacaggtcttttatcctagtatgagaaagttttttttttcttattttctttttcaaaaatatattgtagggtcataaccggatttagttactcgtgatcaatctccacaaaactatatttgttgaaatgagctacataaacacgacatgtttttcacatgcaaaatttagacacttcttagataattcgttcgtgagcataatagcctttgcccacgatttcttgaaataaacacccacttaacacaaactaaacatcttccctagctaaggctaacttatgccttttatcattttgttggtcatgatgtctctataacaagctataattggcctcgaaactaaaccttggtgaggtcagcttttaagcaaatgacccccataggatcatagtctctcatgctatgtactgtagatgacagcaacaaattatatgagcgtgtgctttcaatagaattttagcaaaggttaaggagctgctgctagtctccatctatttgaccttatgttcgggcacatattcccggagcgcgagtatagtgatatatgtgccttcactcttatcttgaaaaaaaaagagacaaaatttaagactttatttaaaaaggatggtcatttataaaatttgaaaagtataaaaaaactacttctgccttactttcactacacgaaacaaatgaaggatcatgctgcatgaaataccacattccacaggcacctcccgcaaaaacaccgaaggtccccgtatgaggaggcagctcgtgctcgggcggcgagactgagacgagacgcgagaccaaaccctcccctccccgaccgcgccccgcccagatctcgccgccgacgagatgcatcgccgcggcggccaccacctccacctcctcctcgccgccgccgtcgtcctcctcctcaccgtcgcggggctgcccctcgcttccgcctccgagtccgaccacaaggtgcgttgtcgcccgctcccccaccccctctctctctctctctctctctctctctctctctctcttccttccttcctttcttccttcccttaaccctagatccgaacccccgacgtgttcctcacgctggatccgccgagtcgccgcgctggatctaggagcggcggcgcggtttcggtagctttgggttccgtggcctctttgctttgggcgagtgctgcgtggttcgaggtgcaaggttgatcttagcaatatgataggaagggctggacagctaggaatacggaagctatgggctggaggattggttcgaaggctgttctaaaggcttgctacttgatgatcttgtttgccatgagagtgaagaaaaaaatcattagtggaaacacatttggtagaaaaaacgtttttggtgctgtagtgcttcgattagcttgttatttgagcagacaagccactgcaattgtattgctgttcaaataatctgtatcatgctaggcctttgaataagattatgacagcagacttttcctgccttagcttcacatcatcaaaattttgaccttttggtggcgcatcaaaatgctgagatgcgaagcatttcatgcttgggatacatgaagcgcacactgttgtgggcttgttacagttgatttattatcctttggcgccttgacggggcagttatccttgtccttgctgcgtcttgaatgttttcattaattcttttttcctattttggcaaagcttcccaatgtcggggagcttactagttgaacgtgtaataatggcatgcaggggtggacctgggaacatacattctgggtcaatgccaatgagcaaaaaaggagctcctgtaacacggtgttcacgaatctcgaaatcccactctcacatgcagccatcgaaagagacaagagaaataactaatatttaatattacctttatggctgttttttaggtccgctattctatttcccttatgctttgttggatttgaaattaagttactagttctagattatatggctatgcaaatcccaaaaagactttttatattggttgaaccattgaagccaaactttgtgaggtgatcctggaatacttatagcaatatttttgtcaggtgttctaatgcattttagcagtcgacgaattttcatgtgatcgaataagacttggttgacattgtggtctctgtacaagaacttttggcacactagatttggataaaattatcattcttagaatcataatggtagaattctgttagataaggtaagtatactctgtagtgtaattacatggctctctagtttgatgtggaaatctgaaactgagtgtgagtctatgtctctctttgattgtgttctgttatgctgcactcatgaactgtgatatgggaaaaatttttttaccgaaagtctatgcttcttctagtaagtattactgttactattctaaaaggaaatttccaaataagcaataacatatggaacttgcatcctggaatccacctaagaggcaaacagagactaaggatgcagttttctagctgaaagctgaaatactgatttctgtcaagtctatgttacatatctacattaaaaaaaactcaggtatctaattatcaatttaaaggatgatttaataatcatctctaaaaatgagaaaattgcatgagaactttggctatagttttttatagaacacatttcatcgtggttgatattgaatgtattgaacagtctaaattcttcgtgaagcatggaagagcctgcaaaataagcaagttaggaacttaggatgaaccttaaggcgttattttcaatttggtcattcttcttaacactatcacaaactggtcatgatctttgttattctctataacttagaaaattgcacttcgtaccagtatacagattcagaagttttgagtgttactgtttaactttattgtcgcttagttgccatttctaaaaactaagcctactgatttgtaatcacactgagaacaacttttgtatgttagtaatcacttcatctacctgttatttaattttatgcagtacaaagctgaagaaacggttaaactctgggtaaacaaggttggcccgtacaataacccgcaagaaacttacaactattacagcctcccattttgtcagccatctgaaaaccccgcacacaaatggggtggtctcggagaggtccttggcggcaatgagctgatcgatagtcaggttgatataaagtttttaagtaagttgatcttttcataccctccttgattttatttacttttggaatgtgcatcaatgtatgttccttgcaactaaccgatttccctgaccattttacattaaacttctttgttttagaaaatgtggagaagggtcccatttgcacaattgaacttgatgacaacaagattcaacaatttactgatgccattgaaaggtcatattggtttgaactcttcataggtatgaatctgcatttaattgggcattgttttcttattttgtatgctatttctcatttctgagtactgacattctttttatccaactttctctgcattgctttctattgtccaaccgcctagatgatcttccattatggggtaacaaattctaaacctaaatgacatttcttttgctttaacactttctaccctctacctctcttgaataacatgcaagttgcctctgagcaggttttgttggtgagactgacaaaaacaacgaaaataagcactacctctacacacacaagaacattgttgttaaatacaatggtaacagggtatgtgctggtctgctttaagaccttaaaatattagctgaaacctattatactggctaattatttttttttgcagataattcatgtcaatcttactcaagagtcacctaagcttcttgaagctggcaaaaaattggacatgacctattcagtgaagtgggtgcaaacaaacgttgcatttgcacgacgttttgaagtttacttggactacccgttctttgaacatcaggtaatctttgttcgaaccaacattactttttatgtcttttgctggacagtttttgtgctataatttactttgctctgtggtggttttgacaaagtggtagactttattttctttaaaactctcgaggaattgaaatttacaagaaaactaagttctgctgcaaccttccatgttcagatccattggttctccatcttcaattcgttcatgatggttattttcttgactggattggtatcaatgatattgatgaggacgctgagaaatgattatgcgaaatatgctcgtgaagatgatgatctggagtcgcttgtaagtactgaacgtgaagcctcacgcttacaatcacttgtgtattccctctggtagcaggagtcattttttgtttactttaatggtctttgagatgtaatcttatttttgaatttcataatggattttacagtgaatctactcatcattttcatgcaagcaatctaatattcaacaaaagtaaactagtcaaacatcaagttttacagtaccctcccgataatgataacttttgtgtgtgtgtgtgtgtgtgtgactggacgaattatttgaatattcatagcaaatcattttgcattattttcatctaatctcttgatagttttgttaacttatatttttcttttatcaggaaagagatgttagtgaggaatctggttggaagcttgtccatggagatgttttccggcctcctcgtagcttggtgtttctttctgcttttgttggtattggcactcagctggcggctcttattctgctcgtgattgtattggccattgttggcatgttatatgttgggtaagctctaaatcagctttcttagtatcctttttttctgcatcgcatgtgcacatgtattaggcatagaatacgcaccctttggattgaaaaatggaaatatgggcaatacgagtggagtctttggtagggcaatatgaaaggccccaagtgacaatacagttgaaggtacttttggagccattaatatgcttgtctggaacatcactaattgcacaaccctaatttctacaaggtgacggatactcgaatagatggacaatgacacaatagtataagcatggtatattttatacctagagatgcctttgaccccattattaattttgatttcaacctcattgctatataatatggcttatttgtttagtccgattacaacctctgttaaaactcatccacgctgccttctggagcagtggtctctttatatcagcgggctcaactctatctaccataagacattggtgaaataagtgtactgctttcattaccatatggaataatgttatagtcagataatatgactatgaatttccaatgtcatttttcctaactaaaatatcatactcaacttgccagacgtagcttaccattacatctgtattgtgtactacactgttttatctttcatttctggattgacaataatcagtaatgtttgttcagctagctagtatttctttgcaccctactaaatgctgtacttcttatttgtcagacgaggagctatcatcacgaccttcatcgtgtgctacgcccttacatctttcatttctggatatgttagtggtggcctctactcaaggaatggcggtatgtttctatatatatagtttttgttgttggacttgcccgttttattctactatcctgaaatagattattcagttttgaaatgtttcaatttctgtgtttcttatctactgttcactgaatccatttctgatccatggcaggcaaaaactggataaagtctatgatccttactgcatccctttttccgttcttgtgcttttcgattggattggtgttgaacaccattgctatcttctaccgttcactggcagccataccatttggcacaatggttgtcatatttgtcctgtgggctttcatctcttttcctttggttctattgggaactgtagttggtagaaattggagtggtgctcccaacaatccctgtcgtgttaagacaattccacgtcctattcctgagaagaagtggtatcttacaccctctgttatctcattgatgggtggactactccccttcggcagcatcttcatcgagatgtactttgtgtttacttcattctggaactacaaggtaaagaaaacatatcagtgaacactaatgtgcttctcattctcacttctcaacaaattattttgctagaacagatggcatttacagtagatgtgtaccaacctaaaactctttttaatttgatggatagatagtaaccctatttctttggtatttggcaggtttattatgtatatggtttcatgctgctggtttttgttatcctcataatagtcaccatatgtgtcactattgtgggtacttatttcttgttgaatgctgagaattaccattggcaatggacatcattcttctccgctgcatctactgccttgtatgtctacctatactcaatatactattatcacgtgaagacaaagatgtctggcttcttccagacaagcttctactttggctacaccttgatgttctgcctcggactaggaattctttgcggtgagcatttaaacttgtattcattgtatttcaaattgccacttggtctgttttgacaccacgtctttggtttaggtgctgttggctatctaggatctactctctttgtgaggagaatctacagaaacatcaaatgcgactaaattgctactctgaacatcaaatgtgaccaaagggctactccgttgccgatagatcctatcagcgaagtgtgtgttgctggcgcaggtccattgtggagtaatgctcataagattctgatcaacttttggaagctatacaggagattgttctccctttgttttaccttttctttttatgtttttcttttacttcatttttcttcttggagctggcctcataaatgtatacctcattagttcaggaattagtctcagtaccgggaagtacatttagattctcattttgtggtggcctcttttggccagtagtaggatatcattgatgaatattggtgcagtgtggatccaatccagtggctagaattgcccctcttatgaatcgctatacatccaattttggcatagccttgtagtatatgcaaactaatacattcaagttagatatatatggcctgaatgggtgaagttctatttcttcccctgcaggtactgttgaaacatgaattcgacatgattattatttagcctttggtctgagttttcatccttgctgaattgtctctgtgtttacagcatcagaaatcaagcgtacactgaaaatagacaaatgtgtcatccacatctgtaatgttttgcttgtttaggtaccttgctttatgatagtatcagcaaatgatttaagataagataaagatatgctgctaaccagatggacatcgtaacgtcgtatatctgcaggtttcattgtacaggtgtacagaatttatatacatattcgagtatataggtatatagacacactggtgttgaagacatcaacttattaagttattatgtttatctctacgcacattgagagcatatcaacgtgtcatatcactggacactggatgaccggccatagtagcactttctagcgatcaagcttagttgacgtttacgaagcaggcacgacgctccaagccactaagctactcccacgtgaccagctcacgtgtcaccatcctgcacgttcacggccccatccacagcacacgtggcacggcctcacgagccacctggacggccgaccagccggccggcgagctttaaaaagcagccccatgtcatttgctgatcgatcaactcatcaacccgtgcagcaatccatccatccatagccgatctcagcttttccattcgcatttctgcttaattagcttagcaagcaacgaattaactgcaagagagagcgatgccgtcgctgacgacggggaggtcgccgtggcggaggaggaagagggggacggcgacgacggcgaggaggaggaggacgccgacgtcgctccgggcgctgtggcgccggatagtgcccaggacgtcgacgacgacggcgccgcgcgtgcgcacgaggaagcccgggctgctgtcgcgcgcgttacgggtgctctcctgcggcggcgggaggaggtcgcgcgccgcacggcggtcgtgatcatgatatcatcgtcgccggcgccggcgaggttaactgctcctctagtcgcttgcgatactacgtggagtacgtgagactagtggtgactgtgccgtgtgtgtataatttactgcagtaacaagtgtgttctgtgttctgctttgctttaccgggagcaattacgtgttgtatgttgtacactactatcttcttgtttaatatgtgtatgttgtactatttcatcaagtgacaactatatgaaaccagtttgttttctctacacaccatgtatgtgtgtcgagttttcgctcgaaaaaaaattgaacttctatgtttttcggtgaaccaatttgagtataatttttaacaccgaggcgaaccctgaaagaattcacgctatattttcgtatctagcaaaagaaatacataaaagaaaagataatagtaggttaaaattaagcaagaataatataatagtgggctaaagtaaggataataataagctataaatttatgtggataagagataaaaaaatatggagtattgtaaagctagctaggagtgttgtagggctagctatacacgtgtatatgtttgaagatattttcattaaatttatagtgcgagtagttaacctattcataagggcgcgagaggaaacagagaagagaaaacctattcatagtggcgcaagagaaaacctattcatagtggcgcgcgaggaaaagagaagagagaaatagggttaataaatggttcgaccgcgaatgctaagtagcgcgcaccagctggtggcggtccctcctcagctggtttcgttctctcttcttttatctctttttctgatttttttttaattttcagcacacgtgtttttaaatattttgcattaaaaatttttaaatcatgatttgaaaattttcaaatattaactaaaaaattttaaatgtgaaattgaaaatatttatatctcaagttgaaagttttaaatctgagttaaaattttccaaaacttgagttgaaaattttaaatttaagttgaaagtttttaaatctgggtcaaaattttttccaaagttgagttaaaagtttttcaaatttgagtgcaaatttaaaggtttttaaaatttaacttaaaaaattaaaattttgagttgaaagttttcaaatctagatttaaatttttgaaaatttgtcttaagatatattttcctttttattattctttagttaaagaaaatatcgcggaaaaaatctcttatcttctaccattattatcttaaactattattatctaatacttcctccatcccaaaatatttaagtcgttgttttttttaaatgttcgaccagcggcgcgtacttgcgaactagcgatcgcgattcgcgcggccactccgttgggggatatgctacagtatcgggccgatgtggggctgtccatcatccaaccgacggtccaactgtccaactgtccagcccataacgatcccgaggcccatggactatctcacttctcacgactcccgatgcctccggcttccacgggttcttcctcgatgccttctccggcgccgtccggtcgctccggcgccgtccgacgacggaatccctcagctccggcggcgccggcacgccggcgccgcaggagctttccggcgcgtgggggaggggagcaattaattaattaattaattaattaatacaagttggcaacagcagaagcacaccacgagcgccccacgtggtcagtggtcggcctcactgactcctcctcacttcgcattgattcgatcactctgctctactctctactactactagcttctgctgcttcttctccgatgcttcgatcccgcgccgacctcgatccgcattaactgcccctcttccgtacggaggagagcgatcgagcgatcgatcgatgctcgccgtcgtcgcgggcggcgggttgaggaggtgtgctagctagcggcggcggcggcggcagtggaggaggatggtggaggaagggaggtcactggcggagacgccgacgtggtcggtggccaccgtcaccacgctcatggtcgccgcctgcttcctcgtcgagcgcggcatctcgcgcttcgccaaggtaaggtatcccaaacacacacactcgcttcgctttccccccggcttgatccgatgcattgcaagtaatcgcacgattgattggcttagagtactacttttctcgatcaccaaatttttctcccttcgcttgcttcatgtgttgtccagtggctgcgcaagacgaagcggaaggccatgctcgccgcgctcgagaagatccgcgaaggttagtatagtaacttagtaaccagccaatcaccaccttcagttgttcatctgcgtaaaagtaattcatgtaattttgcagactctgtaactgtcgtcttgatttagtaatttagtcgttcattcatgtgtgcttcctctagatttgcctgcccatcatagttgccatttcccttaattttatcctcatagtggagcaatgccatatttggaatggtaaaagtcttgcttcttgcaaggtgtttgattgtattcctcaccaagggaaacccatgcctgattgcagagctgatgctgctcggcgtcatctcgctgctgctgagccagacggcccgctggatatcggaaatctgcgtgccgtcgtcgctcttcacgagccgattctacatttgctcggagacagattacgaggatctggtggtaggagggaagcgctctaccatggagatgaaccagactgttgtgcctaatggcctgtttggtattcagtcacagaatgtttgcagtgaggtagtcggtctggttctattccatccaaggatggtcgattggacgttcgaggcatggcactttttggtgattcagctggtgttttctctgcttgcagggtcatgagccttttgtttcatatgaaggccttgaacagctgcatcggttcttgtttatccttggtatcacccatgtgttgtacacttttgtaactgttgttctgtccatgattaaggtaggtgtgttgattatcggtcaaacatcttggcacatgtttgtgtgttaatgcgtttcctttctgtctttgaagatatatagctggaggaaatttgaaacccaagcatgtcagctccctactgagcagttgcaaggttaggccgtcaattaaaccatatgcttgcattagcttggtacagttagtttgctctacctgaataacgttcatatctctcagctaggagaactaaggtgatgcagaggcagtctacctttgtgttccatcacacatctcatccatggagcaaaaataaaatacttatttggatggtaagtactattttcttcacaggcaagctgctgtttgctgcattgattcacattgcactgttttttagcttatcagcatattcaaaagtagaggattgaaaattactgttttcattcactggttgcttcacctagccatttctataaccttgagtgagttttctgttttctctaatttgtgttctacaaactgtgacaatggtgcagctatgctttctgcgtcaatttaggcgttccatcaagaagtcagactatatggcattaagattgggttttatcacagttagaactctgacttctattgattgtttcaattttccgttcagatgcatatttattttgagaaagtgtttaaatgcttttgatttcctacattcctctgcattgtgcttacttgtcaattttctcatcagtaccataagttgccacactcgtataatttccacaaatacatggtacggagcatggaagatgattataatggaagtgttggcatcaggtaaaacatattattttcctctgatgaattaggcattgaaatgagcttattaattccgaacagtgtgttcctgctctttccagtgactatataatatttgttctttttttttttcatttttttgactccctgtactgtataaatgtgtcaaactgcatattgaagccaaattaaccatttgcttgtcatcaagagatgtgatctgtttttaagccacacaacttcttttacattttgttctatgttttgctggcatatttctccatgttcttaacattttgtttgttgagcagttggccactgtgggcatatgcaataatatgcatttttgtcaatattcatggtactctttctctctctgtcagtcacatacacacatacagagtttttgttagcagctttgatcattgtttgatacacttaacccttttttgttatttgaaggtcttaatatatatttctggatatcctttgcccctgctattgtaagtatttcctgtatttcttgacctaacaacaagattaagttaaatgccctcttgtttcttgttatgtcttgtcataattttgtgtattgaatattttgaagctggtcctgctagtgggcactgagctgcagcatgtcattgctcagttggccttagaagttgttggggcaacagcaccatatgttgggacacaactgaagttgcgtgatgatctcttttggtttggaaaacctcgggtcctgtggtggcttatacaattcatttcatttcaggtgatattcttttgcttcactccatatgttatattttttttgaagacactccatatgttatattatgatgtttgtatgaacatcatcttcatcctaaccttactgttgctttcagaatgcttttgagatggcaacgtttgtgtggtctctggtgagaattgcctccttctatttatgattagtcctagatttaatttggttcatagtaacaaatattgcattagggcaagtctataaggagaatgagatggctcctgtattatgtaatattttcttgattagtatgttttcagcatgttaccactaaaacatgaatataactgtaaacttaagctatcaactagatgacttggtagtccacacagaaatgagccagttgtcatcagtcctctcttcctaatgaaaatttcctatggattattagatggatattttcatgtttatcctatagttatttacatagttgccttcatctttttcagttggaactgagtgcgcaatcctgtttcatgaagaaccattacatgattgttctccgtttgacttctgggtgagttttagacatcataggaaggtggcatctaaatacgttttatcattttcattttgagaaaaaagctggcacaaagaagcgaatttcagtatgaactatattagtcgacttgggactcaatgaacttcttccgatctttcaggattctagttcagttctggtgcagctacaacacattgccacttaatgtaatcattactcaggtattctggttattgaaccaacacatctcagagaatcccttgcctaatttctcagaactttttactactaatttcttgaacggaagggggtaaaatcatcttgtcttactgattaagagtcccttagtttgaatagtcttaatcttaccccctccgacacatcctatactagttttgtttttttatgggatggagagagtatctgactatgcagattcactatgtcattcatacatgaaaaattcttatcatatgctgtagaattgggaggatagctttattcacatttccttctctttctttttctttttttgaatctcagatgggatccaagttcaagaaatcactggtctcagagagtgtgagggagtcactccacagctggtgcaagagggtgaaagacaagaacaggcacaacctggcatcgagatccgtctgctccctcgacaccacatacgaggagactgatcatgagactgctacggttggcaccctgtcgagaaccgtgtctgcgacgtccctggacgaggagctgacggtggccaccgtcgaggacaacgacgacgacgaggagatgtctcgcatcgagcaagagattgatcgatcgttgtagctctcgtgaacttgtttgttaatcctcgttcacagaactacacctgtgcagaatgactgaagaggattctggtagagcacacgacacgctaacaatgacaaaatcgaagcccatctcgtggagttgtaaaatatagcaaactacagaattcgtaagatcgaattataagacatgttcagttgatgtaaaatggacatttgccataacttcgatgtgctgtgatctttgcactcgatgaaggtttttacaaagtgattttccggtctgattgcttgacgctaatccaaaaagtgaacggttatgcaaggtaccgttcctcctattgttcaatggcgagtcttttactactcccttcgtttcacaatgtaagtcattctagcatttctcacattcatatggattttaatgaatctagatagatatatatgtctagatttattaatatcgatatgaatgtggaaaatgctagaatgacttgtattgtgaaacggagggagtagtaagcaaaactttgtttctttctcatttcttcatgtaaattgtagtgctaatgagatgctcatctgttggctagaacgagggagtgtgtttcttatttaacttttcgacagtgtgttactggttttatccaggatattgtaatctctaaatgtttatgcaatgaatgagccagcctttgttataaaggaatataaactcatgaggtagccctttctattggaccgaaaaaggcccggcctactaggaatcaagcagcccaaaggaataagacgccaacacgcgtgcggtgcacgcgactgtatccagtttgcggctcaaactccggtaggctaccacccgaagccaagagaggaaccacgaaatttccacgaacaaacaccccaaattccaggcagtaatttttccggaatcaaaaatcgaatggaaaaacaaaaattaaaacaagagaaaaacaaggcgtaggcaaagtggcaaaccacgaatcgaagaagagcttctccttccctttcctcctccattccaaccttccaacccaacaacctcaaccctcctccctcagtatccccccaagaacgcgaggagccgagtccgtactaggcccaggtcatcttttgttgtagaggcgatgcagacggcggcggcggcggcggtggcgtgggcgccgagcccatcgccgtccacctccacctcatcgccgccccccttcaaggttagggttacgcctttttgctgtttgttgtttcagggggggaacccgatttccttggttctgccaagctgacgagttcttgatttggggtttatttacaggtggggatcgcgtcgccgtgtgggacggctgctcacgcctcctccgcgccgaggttggttgctgcggccactcaccgggggcggcggcggcagcagcaaggtgagagcaatttcttggtgtgtgtgtgttcttttcatgcttttcttcattttttgttaccttattgagaacttttggattggtaggggggctattagagctttaggaacatgagtgacagcttttttattgcctgttgtgcccactaatacatggttaattgattcgtatctttaagatgtgtcggggcaatgaattgtaagctacaagcacttacttactgatgaattcagtaatcgctaattagctgcaaacacttacttagtgatgaattcagtatttgctaagtagttatccataggccatagcgcacctcgcgtttagtaccaatccagcatggtttattctaatatgttctccaatctcaatgggattttattatactccagaaccaatttagtgggagcttagttttcatattgtctccagatggtgatgctctagcatacgaacatctcaaatcaattataagcaacaccaggtcggtaagtttggaccaagtaggatgtaggaacaccatctactgttgctataggttagacataggtacagtctagaccttttgcttgctgtactgttttttcaggggtaattaagatgctgggtgaattgggattcagtatgatgctaattctgtttggatgctgctcttgcagtggttaaggctattgccaacccagacccagcagttgagctgccattgacagctgaaaatgttgagattgtattggatgaagttcgaccataccttatggcagacggaggaaatgttgcattgcatgaaattgatgggaatgtggtgaggttgaagctgcaaggagcatgtggatcatgcccagcttcagtaacaacaatgaagatgggtattgagcgacgcttgatggagaaaattcctgaaattgttgctgtcgagcccattgctgatgaggagactggccttgagttgaaccaggagaatattgaaaaggtacttgcttatatttctggctaaataaaattatacgcaaaaggtctcttgtagagtacatcatgtcgaagtagcttaagctttaccgtggctaattgattaacttacataatagaagataaaaattcttctgaaaaatctttttgtgccacactaattactttaatagtgcaattgaaaaggatgttgggaacaataactgtatggcatttgctgatgtcctgctttatagttcatatttaaacaatttgcttctgatttcttgctctctggttctgttttatttaatttctgtattgtgataatcttctttgaaaatagctttgaagatgacaatttcctttgatccctagtcactgtataatgttccatcttttgagtctattttggttgggaaaaaaattgctgtgatggaaactaaactgctggagcatgctaaatttctttttacctttattaggtactcgatgagattaggccatacctttctggcacaggaggtggtgagcttgaattcgttgcgatcgaggaacctatcgtcaaggttaggcttacgggcccagctgctggtgtgatgacagttcgcgttgccctaactcagaagctcagagaaaagatacctaaaatcgcagctgtccagctattgtcgtaagcctgaaaacatttagaaaacaacccctgcaatgtaaatgtgccgctacaataatcgccaggaaagattgtaatgggcttaaagctttgtaacctgttactctattctacttgaactacgaatagtgatcatcaatatgaaatgttgtaagggtgttcctactggatttatttacaaaaggttttgggcttctatgattttgtctgtacaatttgtgaatatcactcttttatttggaagttcgttgaaatagaaaagggcactacaattttaatttcacttgatctcttattgagtatgaggccttcaagtatgggattagtggtagctggtgaggattgtattatcttctgtcaattcataattttggtttactagtgaacaagcacatgcatgaccaatcggaatgaaattcaacatggtagtagctgtaatgaggcatattaatgactgataatttcttctttattgtcacataagcagcacatagaagtcgtccttaccgtatgctgaacagtgacaccatttcagttaggctctgtttagttcgtgaaaagaaaattttttgtgttatatcggacgtttcaccggatgccgaaaggggttttcggacacgaatgaaaaaactaatttcataactcacttggaaaccgcgagacgaatcttttgagcctaattaagccatcattagcacatgtgggttactgtagcactttatagctaatcatggactaattaggtttaaaatattcgtctcgtgatttccatgcaaactgtgcaaatagtttttgtttttatctatatttagtgttttatgcatgtgtcaaaagattcgatataacgttttgggaaaaaaattttgaactaaaccggccttaagtctgacggtgagtttactgggtgtcaatcaccttattaaactaatacatatatcgatagtaaattccgaaattacatgaggcgcctgtggcctaatggataaggcgtctgacttctaatcagacgattgtgggttcgagtcccaccaggcgtgttttgttttttcttcttcttttttttctctacaagatcggagacagatggacggtcagggacaacgagcctattcaatatcagccgtccacgtgtctgatcgttggtcaccaagcacccactggccactcgtctctctatagtgaatagtctatcctcgcatcgcatactcgtgcaacacggcttgcgagcggcggcgcggatggggctctgggagtggccgtgggatcgccggcggcgaggcccgtcgggcttaggccccacctccaccgccgaagaggtcaccgccggcgtagacgccacccacctcaccgccatcgtcacaggcaaccaaccacaccttcccattgcagcagcagaatcctcttgatttggtgatttttatttattgatttggtgatggaaagaagaaaaaaacgaaatgcaggagcgacgaacgggatcgggagggagacggcccgagttctggcgaggaggggggcggaggtgatcatcccggcgaggacgatggagagcggcaacgcggtgaagcagagcatcgcggaggaggtcccggggtccaggctccacgtcatggagatggatctcgcctcgctcgactccgtccgccgcttcgccaccgcgttcgactcctcccacacccacctcaacatcctcatgtatgccacactcactcactcactcacatgattgcagtttgcaaaatgttcagaagatgaacagtttcgtgcaggggaaactcttttggtagctgggatatcagttcatttattgcatgtcaaatactacctccatattttaatgtatgacgccgttcacttttcgaccaacggacaaaaatacagagggagtaaatggttatggaaaaaaaatcaaaacaataagatagattagtacttaatatattatttaaaaaatgcaagtttaaatttgacttttaccggttgttataaaaaataataaatttgactgtaaatatgcatctactagttagagtttagttcgttattttcgttacaatttataaaaatcaaatttaaaattgcgcgtttgtggagtgataaattttatttataactatttagttaacatgtaataaatgggtagacgtctagccgggtgattgaaatccctctcctttggtgcagcacttatctgaaactgaactcccttacaaaagtctttttttcttttgctgtgcttgtctgaagaaacaatgcagggataatggggtgccctttcaagctatccaaggatgggattgagctgcagttcgcaacgaatcatgtcggtgagaatgacgcgtgaacactagttcgttgcaagtttgttacttattttttgagcatatgctgaattttacttacaagtacaggtcatttcttgcttacaaatcttctgctcgacaagatgaaatcgacggctaggaagaccggcgtgcagggcaggatcgtgaacgtatcgtctattgcgcacaagagaagtgatggttcttgctttgatctgaacaagctaaacgataagtctaggtcagcaatgtgttcatttttattgttaccgcgtacattatcacaatgtaagtatctaaaagtattgttcttgtcctgttccgaaatttataggtacaaaccactcattgcatatgcacattccaaattagctaatattcttcatgcaaatgagctagcaaagcgttttcaggtacacatttttttggccttttctcgtttatcttgttcatgatgattgatgactttgatcgttgaagaaagaattagagtttctgagaatgtcgaaaaacccgactagtagtattagcaacaattaagacaaaatgttagtgcaagcacagttgttcagtgcttgtacttgtgtggtagctaacccatttgatttactcttcattttttagtgatgaaataacagtgtggatatatcaccccttgggaaataacaatcttgattccattcaggaagaaggatgtaatttgactgcaaattccctgcatcctggagtgatcctcaccaatatcactcgttatgtcgtcacaaacagtaatgtcaacacaaacctttcttcagttattattacctgttccaacctccaaatcccatatcctctgaatatttcgcaggcgtgatggtttcaatcctttctgtgggaaacctctttctgaagaacacacaacaggtaatcgattccaatcttgttaccactcaacaatccaactgtaaaatcttcagtaactagctagtgtcacaaataagatatattttagctggcatgatgaacttcaatctaattttttacagggagctgcaaccacatgctatctggcactgcatcctgaactgaaggatgtctccggcaaatacttcgcggactgcaaggaagccacgccgaggcctgctgcgagagacgcagagctagcgaagaggctatgggatttcagcgaacagctcgtggatactaatcgtcgtggagaattcaacagacaaaaatgacactgtttagactgtctgaaattctgaacctgaccatgtctcaacctgagatccttcagatacagaattttattttttatttctattttttattttttttcaatggaatgatacagcttatataatatgaccatagagctgtttgtcagtactgttgtttgcatgtgtaaacaaattcaaatgcattaataatcagcctgctttttttgccatttcgtttcagaagaaaataattggtcaacctgtttttcttgaccgttctcgagctccatccatggatatggctaaggctcttccaagaatcgacgaaatggactaaacggagaagaaatgtcgctgccaatgataccaataactctggagtctgtagtacgaattgtctgctcacgtcagtgtcatttttgtccaatcaatcaatctagacacctctgaaaagtgaaaaccggttttccacaggtgatctctgaaaattccaagtgtgagatccttctgaacctgttgaaaaatcatctgatcagaaattcagaatcttcttcgccaaacaaaagcatcttcagacaaaaattcagaacactgcgaccggtgttgtcatgtgtgaagttgtgttacactgtgcgccacacaagtcactgtctcctcccagatggagaacggcaacaaatacttctgcttctgcacaattctgatttctctgaaacttcggctgctgaccagtttgtagttcaggagaacaaggaggaggaggaatggggtttagctggggatggctgtgtggacggcgcaatgggccatcgggcttcggcggggcatccactgccgacgaggtcaccgccggcgtcgacgccagccgcctgacggtcgtcgtcacaggtttgctcggcctgtcgccgtttcatgtctttgacaatgttcttgatttcctttttcccttcattttatcagcgtccgtatatataggactccgggattttgtccaacagtttattggataaatatgagtatgaaacttgaatttagaggtgaatttgtatagtttgtagattcatccggtaagaatgtagtgcagcactggtacacaccattctgaatttctgaaagcatggtgccaattccactcaaggttcagaaaacaattgaaaagaaaacaattcaatgaatcttcgcgctgtctgctgcggatcgttcaaaaaaaaaaaacaactgaaaactagctggtagcccaaacctggtaaactccattctcaatcagcttttgtaccaatagaattctagctgataccacaaattcaaatatctgagagaagaagaaaatcgaaaattcaaataccctgatcctacaaattttcatctttatttcattctttcttccatcatgtgatccatttggtacataccaggtgcaacaaatggcataggaaaggagacagctagggtccttgcactaaggggagcagaggtgatcttaccagcaaggacactggagagtggcatgaaggtgaaacagagccttgcagaggaaatccccagctcaaagctccatgtcatggagatggatcttagctccctcgactccgttcgcagcttcgcaaaatcgttcaactcgtcttataggcatctgaacgtcctcatgtatgtgtgaacagttcggcatcactgactgaattgcaaagtttcagtaatggaaaattgtgttactgaattcactgacaagtcattttttgttctgtgtttctctgaagaaataatgcaggggtaatgtcctgcccttttggactatccaaagatgggattgagcttcaatttgcaacgaatcatgttggtaagtatgttgtatagaagcttggcaacctgagataccgatttcttggagcaaagcgaagagataccggatgaattaatcacttctgaaattttactttgtaaacagggcatttcttgctgacaaatctccttctcgacaagatgaaagccacggctaaagagactggtttgcagggcaggatcataaacgtgtcttctatttcgcatcgaggaagcgatggttcatgctttgatctagataagctgaacgacaagtcgaagttagtaatttgcatttgtgttcttcaggctgactcagtacagcaaattgaaccaacgttcttactattttataaaactaggaaggtagcatgtatcgtaagttgtgttcaagaaatttataagattggaatattaaccagacagtatatgctacgcttcaaatttcaaaaaaagtatttctctacgattgtttttcaacgatattctttgataatttttataagctatttgttagttttatacaacaaaatatttaattcatccctatgagtaattatccatccagttatcgagaaagaaagtagacttatttttgttaataaatcatgtttaataaattaaattcaaattaaaattgaagtgttattaacaaaacaaacattatacactgatgatttgattcatcttcaccttggcaaatcagtattgctgcgacactcgtgatgaccttggtaaatcaccttagctgtcttaggtgtggtggttcatctcggatgttttacttttctctcagaatttcttggatttttctaatttattagagcgccacgttatggcttaggagcatttgtagaaagtttaatagacttttagtactgcctctgtcctagaatgtaacaacctaggataggatgagacccatcctatattctgggacgtaaagagtatatgatagatagatagatagatatagtattatgaaatttactctttttatttatataatgagttgctagctacaaaatagggaggagaaagtgagcaaggagagaggagcgaagatcatatatatgttattaatttaatatttaattactttttatttttcatgtaaaagataggatttttttccaaaagatatattcttgtatatccaaacatggccaatgtagataaataaaatataatataaaaattataatcatttagagaatttacttttatttacatattgaattttgctaggtagaaaattggtagattgaatggaaaatggcaagacaaaaggaagtacaggagaggaagagacgtatgtacgtacgtacgtcaggggagaggaggtctcgtacgtacttgagggccacctgagaggtggtgggttaggggtgggaggagattatggattgggttttaggatattttttaagataagatctaatggtgaagaataatgggtctaccatcttaaatgaaaattaacggtcggatgttttgcttttttcttagaatttcttggatttctctaatttattagagcgccacgtggcggtttggaagtgtttgtaggaagtttaatggatatataatagatatattttcaggtaccgtccgttcaaggcatatggacattccaaattagcgaatattctccatgcaaatgaactatccaggcgttttcaggtctgtaatctcggacatttcaatgattcatgaagaaaagaagcctccagaaaatttatattcattaaagcaaaccttcattaaaagtagtattagaaatgcactttccaacaattttctgcatcttgatttgctgctccagccgaacacaacttggcactcttattatctataactcagggagttcttgttatatttcaggaagaaggatgcaatctgactgcaaattccctgcatcctggagtaatcgccaccaacctccctcgccacatcctgacaaacagtaatgcaatcaaaaactcaacaaaaacttccatcaaccaactgtttgacacaccacaatgctccctctgcaggtctgattatatcaatcttctcagtcatgaaaccttttctgaagagcatacctcaggtaacgatagaaaagcaagcctgactaaacgaacaacagcattctctgcccaaatgatcaatgccaagaaatgatcaatatttcagggagctgcgacgaactgttatctagcattgcatcctggattgaaggacgtgtccggcaaatactttgccgactgcaacgaagctacgccgacggctgttgcaagagatgcagagctagcaaagaagctgtgggagttcagtgaagaacttaccagtggagatcagaagctgaaggagaagtgaaggtagcgacctgaacctgaagtcggcggcgacattggaaggagcgcagtgcgcagagtttggtggactggagctggagggatgcgacgcaatggaagtacgaaaccatgaaagcaatggcatcggttttaggctagactgaatatgtcactgaaaattttgcttgtcctaagtatactattagtatatgtcttgttctaaacttgttcggttgttcctttaggcaagactgaatatgtcttgttctaaactattagctatgtgagtgtgactatgtcatccgatgacgattgtacccctacattcaggggcgaatccacagggtataacactgttctaaactttataatcccattggtgttagctcatgttagcacgtaaagagtgtaatatactactccctccgtttcactatgtaagtcattttagcatttctcacatttatattgatgtcaatgaatgtgagaaatgcaacttacattgtgaaacggaggaagtatatatttgataggtatatgacacccggtatttttgtatttttcgttctagattcgccgccgcctacatttgtattcttttttttttctgacattaggtgtgaggtttgaggctttaagcagtgatatttattgtttttttaagagggcaagcatccttgaggctttaaaaaaaatactgtacataagtttttgggaaggttcatacaatggtatagtataccatagaattaaactagtatactcaccagttctgtagaattaaactttccttcaaaattttagaagttttatgagcctggtcatatgaaaggaagttacgagatatatctattctaagtattaatatgaaaataaactattaatttgtaattttacgcacaaaccttaccactatgagcatcttcaaagactaggccagcaaatccatcctgtagattgacgaagttacaataagcaccatcctagagattgcgatacattgcctaccactaaaagcacaaccatcctagagattgacgatacgttgcctaccactaaaagcacaaagccgttaaatcctggaaaattcgctcccatgaggagtcaaacccaggacctatggtgctactgaggctcttataaccattaggctacaggcattttcgctattaatttgtaattaatattgaataacgctgcgtgagtattattttaagatatgtaatataagtaaaccatcatagtaatcacttgcattatacttccttcaaatatttatatatggcaattttttaaaaaatatttaagattataccttttttttcaattatactttgctattgattcatcataaaatttttttattagatatactttgaaatatagacctattagcataattttttttacactaaataaaagtttgtatcggagtacaatttaaataatcattgctaaaatacactactattttcaaacttgtaaatttcctagcacaagattgtaatcctacttgtgagtaagaataaaaaataataataatacaatgaagaggtctttttctttctctctctctttcttataaaaaaaacttatcatcagttctgttatagagggtccaatgggcctccagtgggtgtaaaaaaaaaaaggccctccagtgggcctggggcatctgacgtgtcaaaaagtgcaacactaaccgcattgttttgtattagtagttaattaccgcgctctctaatacgcctgggaccgggactccgggagagagcaacactaagcactgggcactaagaacatggattaagcgcaagtaatcctgtaattaagctaagctagttaattaagcaatttggattctacgaagcagcggcgcggccaaaatcccccaaatcctctcggagcccgaggtcgcttggagtcggcgcggcggcgcacgcaatgcccgccctgcagcctccaccggcgtcgtctccggggcgggagcgggagcggggcgacgcggctgcttcctccgccggtgggcgccgccgctctcgctcgccgccttggagccctcgcgcgcggtccccgtccctctcgcggtcgccgccctcgtcgtcgtcgtcgtcctccgaggatgaacggtttgtgtgtgctgtctccgctgctcgctccattccttcctcccctcctcttcgccgatcctcgtatcgatcgtcttggggttttggtgggggtttcgtgcgggttttggttgggatttcgtgcacatcgtgctattgattctccattttttttaaccctgcagtgagaattgcgagacccaaactgaaactgcatggatggaattgggattctcaaattcagggcctcgaggtgtaactgagatcacttatcttctgaggtcccacgagctcaagatcagtgagttggagtcaaaagagcagatttactgcaacagcctggttcaactcgaagagagaatcgcatcactagaatattacaaggtctcttcttgtgttcagcaagaggatttctgaaacctagtttcatattgtacttttgtttcttatacatgagcatgagaaaaaacatattgcaggagaaattgcttacaagactttcatggacagaagaggccaattcgactttgagatctgacaattccaaattgaagaatttggcatacagtcttaaggaaagggtggacgagttagaaaaagacaacttcatgctagggctgaagatgaatgagtttgctcaagagatggaacgatttcagatgcaggtaagctagcgttgtagcttatgcttttatagttactagtaatcagttgcacgtattgataaatatgaactaattaaaccacttaaaaaaatgcccatatttaacatttaccttttcacatgcacagttagcagctatgactatcaatctgtagcttcaaggaacgcataatacatagacagtggagaaaccagaaaattgagaaccataggatatccttgaagagaaatctgtcagccttgcggtgatctttcctttgctatataagagtagcaatgtaccttagaaatctgtcagcattgtgctgatctttccattgctgtataagagtagcagtgtaccttagaaatctgccaatgaaaaaagtgaaaattatatgggagctgtatctctattatcaatttatcataaatttataagataccgttgtaacaatattattttgacaatatggtgcatctccaaggtgaacaaacgcaggtcctgttaagtactttgaaaactgagggctgatcatcttcagaaaattgcttctgcttaagaaaaaaaaggctgattatatgcaagttctttgattggggcactaatgcatgcatattgaaggggttttccgagaatcaaattgtaaacaaataaattgtggatttgaaaccacaaacatgatctcgtggaaattttgttagggataggccgcagattgaagtcgcactggtgatgtcacgtttctgttgccggtgacctcctaaagctgcatccaaattctagagctgcaatggtgtagttgtagcacacaagcaagaacctaaccctaggatccagaattcttattgactactgcatgtgacaatatcaaattcattatgtcatgaatctagaaaaaaaagaagaaagggtggttaattggatctcctcacaacctgacaatatataattagttcatagcttaggtttccctggtgagtataacagtgaatagcaaaaacatctatgaattttcttcattaactaagttattgattgtacacatagaatatttaggacatctgttcatgtagataaaagcaaaggaaagagtgacatcgccaatgtcacaatgagaaaaggctggaaataaaattcatatatgcgataccataggagctggaatgcacggggatttgaatcaatcgcaagatatctgaactgtgatcttcgaaattcagagcaaatgaattgtgcgagtcctgatggctgatacctctaattgccatacttttcagtccaggacagagcatttatggctagatgaagggcaaggatgtaatgctaatatgttatgtatcacttttatcttgttgttcccatgaaaatgcacttgctacttggctacttgcaacaaaaaatgtacttacaagttcagccatcaacccattgttagggtttgggtcacttagcagcaaaccaatgcttgtcaaaacagtagcaattttgagcaacggttgccaggcaccatgcacattagtacttgtacaatataacataaactaatgctggatatttatggttatttgttgaatacttgaatatgctgat

SEQ ID NO: 66124 - DNA, 763 bp, Oryza sativa
gcggttgtgatagcatgttggcattgtcctttatgaggtgatgtcgttgaggaggtcaaaacaagtggtgataggccttggtgacagcagcaattaacaagctagtgtgtcataagacatttcatttttatctcttgttggatatgctgatccttattttcttggcaggtaaaatcaaacaccagtcaactggaaaccaataataatgatcatcattcgcttgagaataggattcaagttttggaatcaacagaaaggcagaacgcttctagattggtgaaaatggaggagtctattatccatcagcatgaaagaaccataggagtagagcaagacttgagtgcaaatataactcaacatggtcagcaaattcaaacgctccagaacaaagtaagtaaattctgtttattatgcctaacattttgccctgtataatttttagaaattccttactgtataaaatgtgggccttggggcttgcaaatgtggtagtaacagggggcggacccaggggtgtgctgggtggggtcacagaaaatttctaggatcagttatgcagtccatatccttacagctgtaagaacaggtgtaagcaccgtggaaagctcattagatcattaattcaccatacgcctgtgtgcaaacattaagcacacgcaaatagcacatcaatgcagcactgtcatgacccaataagagctctagtgtcccatgggggagtagcaccgttgtgtgcttgtcagcctgtggcacctaggaggct

SEQ ID NO: 66125 - DNA, 6264 bp, Oryza sativa
  unsure (1)..(6264): unsure at all n locations
tcattattcggcatattttaatccaagaaattgaaacaatgatcatggcataagcagtgtagggtgatcttaacgtaaccagtagcatactatgcgcatcatgaatgtcagaaacatgaacataccagtaacgcgataacatgctagaggcatcatgtagaacaggaacaagaacatagcgcacatagtatagcgctaacaatgggaacaggaatagcgctaacagcagtagcaggaggagaagattataccccgagaatggccctccgctggatggtgaggcagaattgcctccgttgttgtagtcgttcacggcacctcctcctggcgcagcagctccggatctagatccagctcctgtcggtggcggcgtaccacctccgccagcagtggcggcagcaactccagacatggcgatgagcagtcgtgcgggaggcactccccaaaaacatgatcacccgcctacccggtgcagatctcaggcgaaggtgtggtttcggaggcactgctccttccaatctctcgtgcgcgcaagagatcagaagcggggaagcgagagcaactcaggcacggagaaggagaaactaacaccgggggagaagcgaagaagtcggatcggactcgcggcctccttatctatcaggagaaagaacgtggacgcgctgttgcggagggaatcgtgggaacgtgggttagtggctgcaaaaggatagtgacgtgacgcctcgcctcgcccacgcccacgcccacgcccacggcccggcgcgcgcgcgcgcgtgtggcattccgacccccacctcaactggtcaacagggagcctccaataactccctatttaggttgagatatttctcgcttaaatccagaggtggtattattatcctcaacatttattatgggcctttgagatttaatattataagttgggcctagcccaattattctaacaaaaacaagtggtgataggccttggtgatagcaacaacaagctagtgtgtcataaactgtactataagacctttcacttttttatctcttgctggatatgctgatccttattttcttggcaggtacaactgcaaaccaataatatgaagctcatttgcttgagaataggattcaagttttggaatcagcagaacggcagaacgcttctagattggtgaaaatggaagattctattatccatcagcatgaaagaatcataggagtagagcaagacatgagtgcaaatataactcaacatggtcagcaagttcaaacgctccagaacaaagtaagtaaattctgtttattatgcagataattttgcattatattcttttagaaattcactatattataaaattacatctcttgactgtcaatattgaaaataatcctttattttcgccaatctaaaaaataattatgtttttctcttaatttaactttgtagtggtaaaggataaatacatgttatttttataagtcaagaaaaaataataatttacactcttaattaaatttcaggaaaatgatgttcttatgaagtcttttcagtcgctgctcacttgtatggtaccatttattgttgcgtttctgctatcaatgcttagcagccaatctgatttcggtgaatatgagaaggatcttgtgattcaagtttcgttggtgtgtggattacctggcgtaatggctatggtctttgctcacttagcaagtggaccattttggacttctatcgtagcaagcttgacattatactttgtcatttatagcatcacattagtgtattatgcattcataagacttctaccatggagtccatggacaagattgcagttttatgctactgtcattcttcttgcaatattcctgatcgtggtccttaccatgctgattgtttgggggagttttgttaaaaaaccaaaggtacaactattgctggtgttctataatctattcaaatttatatgttatactaattatatgtttaattttcaacaatagttcacgcgttggattgcaagttacttttcatgttgtccagggcctgaatgatagatgtctattacaggaggtatgtacctctcaaacacaattagaagtctccaccctatatgcttaacatcgttaaatattatttatggctgtaggtaaacaagtgactactctggtgccttgcaaagtttatcattgaagacaagttgccaatgaagattcagaagcttgattgtgtcacatttgttgtacagatgttactactatgtctagaagttttacatacttaggataacgttgaagaacttttgctcatagctaatagaaagcgagagatatgctaacttggataaagtctagatatttctactgccttcaattccttttttttaatcaaccgtaaacgaagttatgcatggttaggaaatacttcacattattttttttttaaaaaaaacttatttcacagaattaaaacactgaagaaatttctcttttattagagaacttgagatgctaatatggatgatgctatgtttaaaagggaaataataccaagacaacgaagaagtaaaatataacatttccattgttttggtataatgtaacatttcgcttgtatatatggaatgtaaagattaatgtttgcacttagcagatgcgatgatatttttactccttggtgcgtgcgaatttcctataatagaactatccttcccaatgagtattgacatggatttattctatacctattaaaatttttagttaatccctttcttattgggattaactgaacaatctacttacctgaacctgggatttcagtaattcataacccatcaacaaaccagcgtcgttggatctccaatcccttttgcataaggattaaccgaacaatccccttactagagggtaggatttcagcaattaatcaacccaccaacaaccagcgtagttaatctccaatccctttatactcttttttatctcactatacaagacgtgcatgcattcactaccatagaacacctgataggcgtcggttgggaaacccccttagcccttattcggttaatcccatgagtgagggattgaaggggatttattctacacctattgcggtgtggagttattccccccaatcccctccaaaccgaacaaagccttagttgccgactttcctaactggtgccacggaggcggcaccgatgactcgagtgattggtgtcggtttcaaaaccgacacctttgagacgtacgcgagccaaaagaaaaaggctcgatacaccgagtgcatccaccccgcgttgccccgaaatctcaatccacaacatcatagaactccacatcacatatctataaacattgcagaacaagaccgacacggaaggagagaaggttgactccaccactgcttaccgtcgctgtacgccagatccgccgcgggaaaagccgacgccgccgccaccgtcggatccgccgactcctctattgctggcgagtgagaagagagggggaggggacgggggcgagagggagtgagagggagagagngnngagngngnaggnggggnggagggggggcgtccttatctacgcagtattttatctcgatgcccgccccgtgcgctaaaagaaaaaaaatggctctaagctcggctcagtttgttttatagggtgtcgttttttttaaaaaaacccagcacctataatatattatggatgttggtttttaattaactgacacctataatacgtcaaagatactgattttttttaaaacccggcacatatagtaaaggtgtatgtttttctctagaaccgatacctatagtatattcaaggtgtcttttttcttattttcagcctgtggaggtgggaataacactataggtgccggttttagctgttccggcacctttagtgccgacttgtattaggggttatggggtagtgattttaagatttaacatttaaaacatttgactaaaaaatataatataaattaaattttatttgctgaaaataatatcattgaattgatatttgaatttaatttacactagcaaaagtgccggtgcattgcaacgggaagtgtaaagacaagaaaattaaggaaaagttgaaatagatttacattatgtaattaattgaaatacaaatttccttaaaaatttggatattttttaagttggtaagtgtataattaaattatacaaacttgtataattaaattataattacactctttggaattttattgaaattttcagagcttaattgctaattttgataatacaaacatagttttagcatttattcttcagcctttttttttgacgggaaacagaaggagagactcctactgtgctatattataataataaataatttacaggggtatgtacaaatttacaagggaaaattaaagaaagttgtcaatccatgattgccagtttggaagatatgttacttttgctctgtacatatgcagggcaaattcttgatgaaagtcatgtttccacttgtcaaagctgtaggcgatgtttttgaatatttgttcatttcttctgttccaaatgtgtcagcatccaaatgctagaacttcaaagaaaaagctatgaggaaactggttgtgtgctgaggtgatcatgttcatgatgtctgactgcaagttccaatggattccaattttttgccaacattgttgagcagtcgggcatttgaaaaataagtgtatcatatcttcagtgaggctggcattacacatgacgcactgtatcccccctgaatgttaaaatttttcttctggagcatctccttagtgttaagtctgttcataagcaaaagccagaggaacacctttaatttcattacacacttgcttttccatatcaaagtaagaggtcgttcatgttgcagatggacaaagaacattttataaactttgttggcatgaaatcgatcagaattccagggtaagtccatttatccatattactgccattgtataagttctgcagtctgtctgtgagagtttcccattcctgcgttgcttggcttgaaagaggtatgtgaaagttttgactgagctctgatgcttgtaagaaactttgaatcgtggaatcttcgttccttgcaaaggaaaatagaatgggaaattcggattccagataactgtcagtccatttatctttccaaaacagagcagtatccccttgccccagggtgcattgagcgaacgctctaaagaagggaatcaatctgaagatatctttccaccaaaaagatcctttttccttgtgagcctgaggtggtttgtctgaattagaataatgtttgttccaaattaactgtacccaaggcaggttctttttgttaaaaaaatttgtccaaatgcttgagaagaagagctatgtactgaaactccagattgattactcccataccccctttcttttttggcctacagactagatcccaagctgccagggagtgagtttttgtttccatattagaattttttctccataaacaatgtcttctggctcgatcgatgtgttggataaccttttttggcaatttcagagtgcacatgtaataggttggaagtgatgagaactgaattaaccattgtaagtctttgtccatagtttaagtgaattgctatagatgggagtcttctttgtccatagtttcaattcttcagcctgcgaattgaaatttcccgttcgttctcttctgggtaaccgaagttgaagtgctatttgatgcggactctgtatgatttgttgtgtgttggactgcggatgttgcggacaaaaataggtgaggacgggcaaaaatttcactggaagattaggtataggtatatagaatgttagattagaggtagataacgtataaacgatgaaaccaaatagaaatcgaaattttttcgttcttttttttattttagacggaagatggaaacattttcaattttttgaagtatataagtagagatagagattagccattttcgttttcttagagagtactatcacgaaaaacgtggtagtttattaatctataattaattaagtattagtaaaaaatagattaatatgttttctaaaacaactttcgtatagataatttttgcgaaaaatgcgccttttagtagtcttagaaggaaacaacagccttaagggacctaaactgaacttattccgtgtggagcatacacgcggcccaagaggcggcatgggaatcgcggcccgacgcaggagcagccacagc

SEQ ID NO: 66126 - DNA, 24430 bp, Oryza sativa
atatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccttgggatcaaggatttcttcgttgatgaatcccatgagttgttcttgaaccactgcgataaattccttgtgtgtggtcaggttatccctcatgcgaataaactatatgaatgtatgaaattgattagtaattaaacaagaaatcgttacgtaataaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacctccgcctaagtctttctctccagttgccgcggaccaaatgacgtaaccgataccaagccctacatggagtttaaagatatgattcgtagtataaataattaacataacaagaatttcttaattaacagagaaacttatgccagtacctgtctataagttcgaaaaccttgtcaaacgtagactcttttttatccattgagtcatatacattgacggtgcaggccgacaggtcgaagaataaaagcacccagtggaatctgcaatgtgcgtgggatgcattacatatgaaacacttagcaagttcgtacgggaatgaaatttggtatgtaggaagacagtaaaattaaactaactctgtgttgtacggtaacagtatgaacgtcttgtaatgctgcgccttcaggagatggacgagattgtcctctgtttcctgtttcctgcggatattggtcgagcattgcaacgtttactctccgagggtcgatgaatccagtatcgaaaaccctccgccatcgggccctttgaatctccattctacaacgataaaagggagtattttattttatatagtctacttatatacaaggacctaattaattaaaggagacgtagtaattaagaattataattgaacaatatacttacaaagtccagcaactcataatagagacgtcgagggcgtccagctggtatacttcgtagattcccttgaaattgatccagagaatatcatctccttgcaagaagtccaagtccctgatcctcgctccgatcatctctctaccggtggcgctcatctccacgtacagctgatggaacctgtacatttgtgtgggtagggactgcaccagcttgggcttgacaagcgatttaccgagttcgtacatgtatttcaattccgccttttctattggttcaactcctagcaattgatccgtagttagaccggtgtcaataataaattcttctatcgtcatgtctttcccggtcaccaacggctcgatctcctggtttggttgctctccaagctgagggactggtttagactttccagaagatgctttcttcagcgttcgctcatagtccgatagcttgatggcctccttgacaggtgcagacatacccctgaagaagttcatgacactggggtctataggaatcttcttttctggacttcgaggcttgaattgtctcttgacttctgatgcaacgtgtcacaccctgaaaattcaaaatatataaattgttgtttaaatggaatttttagaatttattttaaaagtcttgaagagaagatctaattttaattaataaattccaatataaaatgggcccagataaaatttcattaaatactttgcttaattctataattcctagatttttctgggatttatttgagctaaggaagtatttttaacaaatggaattgcatttaagaaataatttaaattgaaaaaggttttaaaaagtctcttttggctttgggcccaaaacctttctctctctcctcggcccagtccggcccagtccgccgccgcgcgcgcgcgtccgcccgctgacaggtggggcccacctgtcggacctatcgtccaccttcggccaccgccgcccgaaactctagcgccgcgccgccgccgtctccttccaaatccggccgctcctttccgtttccggccgaattgatagaggggaaatgatcttctcgatctcctctacctcttctcctttggaaacatcggctaaatcggtttggaaatcgatggattcgagttggattcggattcgtttttcccgaagtttccttctcgtcgccggccgccgtgggccttcgccgtcgcctccgagtccctttaaaaggaccccccggtgtctcctctactcgtcgccaccctcgccttcgcctctcgtcgccggaaacgccctagcgccgtgagacctcgagccgccgtcgccgccgtcgctccagccgtgcgccgccgtcgttcccgtcgtcgtcatcgctcgggaaggccaccgtcttggtcgccgtagcgtcgccgtcttcgtccgccccttcgccgccgccggagaccgccggagcaccgtcgccgtcgtcaagccgaagagcgccgccgcttcttcttcgtcgccgtcgccgtccgttgatcttccgccgtcgctttggtcgccagtgagtccgccgtgccgtccgctactcgttggtgccctccgttcgtgccgaagcgccgccgttcgccggcgggcttgtgcgtccgagccgccgaaccgccaccgccggtggtgacgtcatcgctgacgtcatcggggccgttcgctgtgagccggtcgtggaccgatcgatctcggccgtccgttttggatcgattgatctcggccgtccgttcgtgtgaaccgccgccgtgcgcccggtccaccgaaaccctagcccgctgacgtaataatcctccttttccttttcaaaaataattcattattgcgtcataattcaattaaaatcaatttaagtgttttaatccgatttaatcttcaaaaattcataactaattcatcttagctccgttttagttggttcaagtctctaaatttttctaaaattgagatctacatgttaaaaatatccacatgtactgttcaagcttgtttatgtgctgttttggtgattttgcttctttttgtttagattccgtcgtttccggagagtccgttttcgcaggagaagagtttgaagagttccaaggccagcaaggcaagtcacacagatcccaaacaaccctttgagcatgttgatcctatttaaagctattgtttctattcaaatattgcatttgttttcgaatgtcattgggtggaattaacctattgtttgttatagcccttttgttcttgattaccttattccttgataccttgggttattataatttgactagttgagctttatttatattggttcaactagatattagatataattgcttagccctgcttagaaacattagctcacttctgggataaattatgactcactattgcttaatgatggcttaatgatagttcacgatggtcaatcgtgattggttaattaattaatgtgccaactaaaacctggtaatggtgggttgtgagcacatggttttgatggtcgtgctcatgacaattaaggaccagttcacgagtttcggttgtgaaacattaaccgtgccaaccacaagccagcatgggcaacggctttatcttttgtatagcatgtttcattgcggggcaccagactgagaagtggcggagataagcccaccggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgaggggttgtgtcttgtgggtacagtggtacacctctgatcagagtaaaactattcgaatagccgtgcccgcggttatgggcggtcaaacaatgtctttcgtgattagtctcacacttctcaccataatagaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattacttaactgttttattaaattctcaaatgtttgctaaatgttgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttatttttccgctgcttagatctttattgattgagatgaactatctacctctgtaatgacattttattcgtttattaattagagtaataattgtactctattatcaatttgttattgtgtacctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatctattactatattaatggctcattttccagcaaaagttttacaatgttgttttatttaatcttgctgcaacaaaataaatttagcaagttgattttataattttcttttatttcttttgaaacctgatgttcaaaagtacaaaatttgtaaccttgtttccaactgtttcaacttatcttgcaaagcttggtttactttatttacttacctttttactttgattttctaaactttattcaaatcaatccaaaaacttgtgctattaattggataaatgtcttaactccctcctttcacttgtctttagatgccgcgctacaagcctgagtacttgtttgatgttgagggttttgtccaggagtcgcgtacgatgtcctttgtcattggatttgggactgcccctttttatgcccagattcctcatgatcgtcatgaagagaagtgccaagtcaaagtcaccttgaacagtaatagtgaagatatcccctcagtgatgttcgaagctagaggaagaaactacatccatgcatgtcaggaggtggcaaggatcgccataggagagctccgtgatcgctacagtgatcagttggccgacactgagtatcgttaccatcctcgccaaccccagggaagtgaccgtggcagctaccttgagactgaaggaattgagaatgatgctactacaagacatttggttgagatgctgtgggctatggatgaaagtcgtgcggagactgtgttagcagctcaagatcgtgaagaccggaatcgtggtaagatttgcaagctagaagacaaggtggatcgtttggagaaggaactagccgcgttgaagggagaagcaccgccgcagaaggccaggattcgtctcaccgcaaggaagagagctctatttgtccctcgctatcaattggcgccaaaggtccgtgtggtggagaaagaagttgccccaaccctagcagattccccggtcaccatcataagtgatgatgaagaagaaggatccaagcgcaaccattccaagattgagtgggtagctacccaagatgatgaagacgagccgaacgagccttcaatcgacctccgatgctcggaagaactagagtgacttgttaagtcgttgtcttcgatcgttgtgttagcttgcttgttttaagtttggttgtgtgtgtctcgcatgtgatttacatcagtggtgggatgtaagtgcatgtgtttgttttcttttgagtgttaggaaggggggcagccgcctccgccggatctgggtggggcacggtcatccgccgctgagagcccgctgttccctgttgcccgccaccgcgagcccgcctctcctagtccactgccgctacgcgcctgtgccgtcgagcccgccgctcttggtcgcccgccgctgcatgcacgctgccgagccgcgtggtgccgccggctacgcccgcaccgtccacgcccgggagtgagaggtaagagagttagagaggatagagagatgagagagtgagagagagcgtagaaaggataaggatgaggatgggtggatgagatgaaattttgaagtgttgaggagggaaaagaggaggaaggatagacttgtaggcaggtttttaagaggcccgcatgtgaaaatcgattttcgcgtgcgggcattttaagaggcccataggcgaaaataggcttatttttttgtgcgcacccttacgaggccccttgcgaaaatcaattttctcgtgcgggcctcttaagggtccgcacacgaaaatgggaggccaatttttgcgtgcggacgtgaaaacggcctgtctgtaaactaagtagctcctcgtccaggaaaatcgtttctctaatactccctcaattccaaattgatctacatatagtttttaatgatctacatatttgtgttaatttattaggtctattcgttatttgtgcattggagtaaatgaacattgatgcatgcatccatgcacacaagtatttatagcacacatgtaatatcttgatttgctattggctaggaaatagtggggatggtgcatgtatcgagtttgttgctagagtaaatatagtattagagagttattagtttttcttgattttggtgtacctatgaaatatgttgatcaatttggaatggaggaagtagtgggcagtactgccgcagccaaactttgtttttggtgactggattatattcggtaaactattttcataccttaagtaacatccccttgtttttcatatcactaaaatagctatcaaataatttgaaaaaattaatatgatagatcaatatgaaatacaaatttaataaacaaaaataagtataactgagttctaaatgatattttggtcattttgtaaaaactacagacataatttcacgtttacctgatgtgatggcaaaaaagaaagagtattattgcacgtaagatggcatgttgttgaactattgtctatcaacggtattttacaatcgtacacttcagttctaattcaaaaaatttcacatacaaaaatttcttcaatggacacaactcacccgaatgtgaggctggtgttagttgattgagtcagcccattcccagagagttgattatagtgcacaagatcagtgacaaaggcgcctattgttgatccaccatcagcataggtcgcgatgaatggacaaagtaagcttgtgttgcattctggctgcacatccctatcgggcgaagtgcagaacatatcatcacatttcaccactttttaacttactgagctcctagggtcatataatgtcagctttttctgcacacaagaagatgtacgacaaaccatattatcattcagaatttcacatctataatgtacaaaaccctaaatggcaaaaagaatttttgcaaggtactgaaaaataaactctaaacctaccaatatatcgctcttgcgagggcattgcttgcaggggatgcagttaacccaaaatgcactgctgccagtgtccacctgcacatagtattccattgcgggtgtcccaatccctatctccgtgtagtatagtctgtgtcaaactctatcagatcgtaataagccaacctaccaagaagaaatggatagaaccaaaggaacattgaagcatataccctgtgctggatgtgctgatgccaccaaggccaccaagtgagaagtccgcagccacaaggcgactaagatggcggttcctatcgtgggtttgtaatgcacctatgtcactccccttacacccaccgcccatgatagagaatttgcggcgcacctggaataacccaatggccacggtaccacgagtagaggatgctaccaatagggccgaaaggattgctgatagaaacaaaggagccatctcttcagcaaagtatgtaccattcttttcctttatgtttttatgaagctttaaacagtaattcttggttcgtcatctggtcctcatccatcgcagtggactgttctatgagttttaatatgaaatggggtacgaacatggagccaaaaaatgcggggagccatgaacaggaaacatctagtggaagaagtcagcaattgttcgctgggagagtcagggaaaataggaaactacgtggtttttgcggttgagagtggaattgtgcatggggctacgggcattatgcaggccatccattatgtctgcaatttttgcacctattttgagaaaggctcccaggtctaagcttcttatctttaattatggttatgaaaatgccatgcatggctctctttctttttgggaaagaaactgctaatctatgataactaaagagtagtgattggctgcctaaactaaaatctaaacgtattactgcgtagtctatgaagttagaaaactaatcccaaaaaaactatgatcctggcaatctgactacctcaactgctagttggagagtggcttggctacctggactgctcaattctgttcagaccatcagcctagttaccatagacttgatgagaaaaaataattttctatgtcacaccatgccccaaaaattcacaaaccagaattccaagcagaacgtgcattaaaccactatccaggaacagctagggtagttgaactaagcatggctaagcaattcctaatccaacatctagtcatgttacatcccaagtttacaaaggaataaggtacaaaaataatagggctgagaacagtaggtacaacatcccatttagtaacattataaaacaatgcataacttaaaggaaaacatagagcatttgcaatatgggatcaatatattcaagtgacaaggatgacttgccttgctctgcggctagagggaccttggcgactatcttgaaatacaccggagcgttgggagagccgaaatctatgtgacatacaaggcaaacaatacaaataggttataagactactaaaacagataacaaaaccatttttaatggattcttcgctttttttttgatttactgagacttgaatgggcttaaatggagcacgaatgaattgtcaatgaattttagaaggttatctgtgtttttactataaacaaaaaaagccttaatcgatttattgcgcaataaaggtcctggatgatgtcatcggagaggggtggcgctgacaggtgggccccacatgtcaggctcataggtcataggctcatggtgaaccaagtccacggaaccggggatgggagcaccacgtggcgtcgacgtggcggccacgtggatggcctcgtgggcggcagccgaatggccccgatctaccgagtggtagatcggatggctgggaacgcatggcgatgcacgggcatggcttgagccagcccggtgggcatggcgcacgacggcgctagtgcggagcgggcagcggcaaccagcggcaagggatggcgcgcgacggcaccgcggctagcggtggcaccatggcgacatggcaccgcgatgcgacggcaacgcgcaagcggctagcggcggagcgacaaagagagaggagaggaaggggagggcctcaccgatcacaaacaaggatggtgagtgacggagggaggtcggcgaacagcggacgacgtcaggagagacctagtgtaacgccctgaaaatcgctctaaatttaaatcatgttttaatgaatttctagaaattttaaaagcctaaaagagcctccaacaattaaaattcaccaagatttatatcaaattggcttgtgggtattattaataaattccccatatctcaaaatgtttaaccaatttttacttgaattttcagagcatcctaaataattttaaggcaacaaaacaattaaagaattttataaaatggaaaagctaaaagaaatcctcttcctcctgttgggttgtttccagcccatctctccctctcttggcccagcccagccgccccctctccttccctctctcccctccccctcccaatccttgggccggcccagctgctctctctccctcggactcagagacaggggtgttccactcgatgacaggtgggtcccacccgtcatccctaacctccagccctctctctcctctccggccgaatctaccacatgtccacctccgattcgcctcctccactcgccgtttcatcaaattaattgaggggaattaattcccgccttatcctctccaatacccccataattttccactcaatccccgtttattcgtggtggattttgatgatgttctttaatggtgagctccaccatggcctgcgtcgggctcccatcggttgcccatttggcccaaaatagcttatttggcttattagaaaattaaaattaatttataagtaaaacttttgtagatttgttcgtagcaacttaaaagccaacattaaccaaaattacgttaaaagaatttcaaaatcaacttcaaagtcaagtttaaaaattcaaattttggcttattcttttactgtttaggccaaacgatggggctgtcgatcgccctacccggcgtctctctccctcccctccagcctataaaaggtacccccgactccctcctctctcccctcacaccgccgccctctccctctcctctctccgcgccgctctcttcttgtgccgccgccgtcgcaactccggccgcccctcgccggtggtcggaacctcattggagcccagcgtcgccaccatctgcttcgccgcttccttctcttccccgtcctcccctccgtcgagcacgaggaccgcgggaacgatgacgacaacgacgacccgaagcttctcgccgtttcttcctcaccgccagcaacaccgccgacctctcgccgccgcgtctgctcggtgagaaccgtcacctcctcccttttccgtttttcctcttcccgtgctccgttgcaccatcgccacgccgttggccgttgccggcgtgccgcctggctcgggtgcttctccttcctggccgtgcttgtgcgccgtgagccgccctcatggtgtaccgagcggctgccaaatgggacccgcccgtggaccccctctctctcttctctgtgcaataaatcaatttcctttagaaaaataattcacaaaattgcaaatttccatttaaacagcacctaaacttcaaatggccatatcttaaccgtttgaactccgaattaacctgttcaaatctctaatttctcctaaaaatgagtagatcccattgatgtgccttattgcttctgttcatatggtttttattagccttttttatttcttcgcgttggtcgtgtagatcctgccgttccagaagatcagctcttcatcgccgttgacgccgaagactttgtgagcgatcaaggcaagtcatatctatcttgaacatgttgaatcccatattgtgaaaattatgttgttttacttatattgcattgctttataaattataatgttcattattaatattgttttattggttattcctatgctctttgttatggccatgttattgatttcatatccatgattgttgtgaaccctagtaaaattataacttgactagtctagtgccctacatgatggactgactagttgctttaggtaaatgcttagtcctgcttagttccaacttagaacttttggataaactagactatggtggttaacaactaaaactggattagtattggactattgactggtttgtcaatagatgggtgataaaattctttgtgcaactaaaacatctttttgggctgggctcggggtgcaagctgattactttggtagtcgcaccccggctaatataagaaccggtctttgggcctctgttgcaaggcatcttcgtgcaaccacaagtctagtgggtaagacctgactggaagtttagatcttctcaaaacaaagaccattggttggaagggtgtggggccaagattaaggccgttttttcaccgggcgcaagggggggcctgtctcatcccgggggatccggcaacctttaccttgtcggggaccggcgggcggcgaaacctcagcaggttctcctgttttgggtagacctagatggatagtcttgtcacgacctctatccgagtaccgtggtggtacccggcgcgtggcaacgcgtgttgaggttgtgtcttgtgggtaaagttgtacacctctgatcagagttaaaaactattcgaatagccgcacccaaagttacttttgttttacaaaaccttgggagggtgaaatcatgatgatgtagtcatgtggtgattagcctgggttaaggcaggttcgttggctcatgagaccttgatgatattaaaatattggcttagaacaggatcgtgttttaaaatgagctttaacctgattaaaatgtttaaactatggctttctgcaaaataaaccctattaggccatttttcttgttttccctatgcattattattgcatttccggtgtgacttgttgagtacggtggtggtactcactcttgctcacaaaaataatccagaggatggacctgagaaagatgaaggcttggatctctagttcgctccgccgtcgagtgcctgtggctgctgctgttccgtagtcttccgctattttatttgtttatctttgagcgtgaggacctagagtcgcccatgaaataaagtacttcctttacgtttccgcaaataatcaacaatgctatgtgtacctcgcctcctgggacgaggattaatgcactgagcgtttggaaatggtgtatatttccgggcgtgacacctagggaacacaatgagaggggctagagggagattagaggtccgtggtaagctagggtgtgccgaccaaaggcggcggccatggagagctcaccgacgtgaggggagtgggctccggcgacgaaatttgacggcggaggggtggactatgtggccctcgggcttgcgaatccgacggcatcgacggcacggcccgacgcgacggctagcagcggctagcggcaaccggagtgtaggaaaagtggcagtaagtgggtgcgacggcgctagagcggaggaaggcacgagagcgatcagcggaaaaaggaaaaagggagaggaggaggaggggtccatttatataggggcgggaggtcaggaacggccgggagtggcgcggattcaccggcaaagtgggggaggtacgggaggagagagagaggtgggattcaaaaattgaatcctggccgtttccagcgcaggcgtgggccggagagggggtagtggggtgcggggagtgggtggcgtgcgcggggcgaggccattgtggtgcggtggaggctggacgtggccctagaacagcgggagcggcagttgtgggaggcggtggcggcctccggaggttgggggaggacccgacaggtgggccccacctgtcagcaaccccaggagacagaggaggggcgcgcgggctgttgggcctcggcctgaggccagcccagcgaatgggcgctggagggaaatgggccgaaggcccaagaagaagtaaaaaaggaggaaaatgaaaaagaaaaagggaaaaaggaatttccagggattctttaatgcttgtgctcgatttaaattgactagtcgccaacccgtgcgttgcacgggctcatattattgatagaataaatgataaaatttttaatcacacgctaaatagttggttacttacaaaattacagttgcttgatcattactaatttgatgttataaaatgaaattattaaaaatactaaatgagagtttgcgatttgtccaacttagtatttattaattttgaattttaaaattataacaatttatacaaactaaaaactaaacaatccatggtattttcagtttcatgttttatttaacacaaattcatgatacacatatggatgatcattacattccttaggtcatatacatacatatgcgttttaacttgcagttatattttgttgtgtcaagagcaaaactttcacaattcgaaattctctatatttataaattccaaaaagggattagaatgaactttatttcacaattttaaatactttatttagtatttcattacttaaattactttgtcaaagaagttcaatagcaaactattggtccaacagttaaagttttagacatattttttgcaagcatattaaaataatgttagaaaatactatattatttatacttaatatatatcttttaatccttatttagatgcattaattagctgctgttgtggaagtcggccttaattcaatgttttatttttgtgttgaaggataaaaaactaatgcaaacaataattattctagttgcatgtagaaaattcaagtatgttgaatccgtaaaagaaaaatatgaaaagattattgctatattccgatcgccctaaattagaggagagcagcagcagcagcatgggcaaaaatgcgagtatgttgttagtgtgaaaggaagagtagaagatatgatgagtatacttcagctgcatgaatattggcgtggcctaggccattcaaagtgcttgaaatttatgtacattttggagtgactgaaaaataggcagactcatatataaactattataaccgagtcaaaatcaaataaacacttggtgcactatcataagattcagtattgctaacttaatctccatgttttgaggtggctttgtatggctcgatctatctatgtgatcgatgttagcatttgccaataatcttttttaaacaaagtatgaagttaaaaaaaaaattgcacggactaaccttgttggattaagccttcaacatcttgatcctatacatgcaccatgtgtctgtcttagtccgtccatatgattcagccaggcaattagcttggctgatggatacggactgaaaaaaaaaaaagatagacatatatataacatcagggttaatcgataatcaatggccttaactgaaagcatgttgttaacaaattaagggtacatctctggcagggatagtcagccttgcgctgagcctctcatggtcaaatccatgattgtttttctatgcgctgaatcaatggggatacggagaaattactcacaatgaatcatgcatacatgcatttgcctgcaacaacagcctgcaaggacatggccgtgtggtcagcgtacatcgtcaccggcatatgaagcagcggcgccctaggctcgcaccgagatgccacagctttggcaggcgcggacattgcagcggcagaagccgaggcgactcggcgacatcgacgtcgagtggcgacttgatgtgagcatcggcgtaagctgcatcgatgctttccatagacgtgagcggcttgcctgaagaattaatcgtcttgccgcgctggctttgattccttttccatgtctctctattgacgcccaaggtgttgcatgcttcgttgattttcttctcttattgtgttgtgaattatagatagatctaatcatgtacttaacgctcaacagcaacagaaatattattgcctctcgcatatcctctcttatctgttccttcgtgaggtggtgttagattggtttaatttacacgtggcccacaaagttaaacacacatggaatttacaatctacagggatgataatatcatttatttaatcaatggccagatctttctgattaacgtgagagttcgtagaaagtgatttaatcaatggccagatctttctgattaacgtgagagttcgtagaaagtgcccaattagtataggtatagatggccagatctttctgattaacgtgagagttcgtagaaagtgatttaatcaatggccagatctttctgattaacgtgagagttcgtagaaagtgcccaattagtataggtatagatagatagatagatagatagattgtatccaatgcatacatagattaattaaatttaattgaacttactcaattcgaagcataatgtcacggatcttgcttatccaacaacttgtttgtgtttcttcgatttgtcctatgtaagatgctaagccaacaacatctgcaaaatgaaacggtgaaggttatgtatgtgttaattaatttggatgctagtaaataatgtaactaaacaacatattaccagataaatatgttttgctgtatactcttttggaaagactctcaatggttgaaaatctaaaggtttgttctagttttggtttgttttctagggttttgatctcctgaactttggcagtgttttgagaagttgagaattttgtcattgtgaactggacgatattctgctactgaagaaaccttgaaattagatatcatggacactgatccttcttgaatgccctgaacctattgacctgaaatttctttacagtagcatgcatcatggtgtcattcaataaataatataagtgagaaggcaaatgtaaatatcaacattatttgtgagaagaacagttatgctaacctcttcatcaatcagtatcatgtcaaggctaataagctcgttgctgttaggatttatggcaacccaaagtctaattacccattgttaacagctttccatgtttccttttcattgttaacagcttgaagcatatcacatgccattgtagttatccttcagttttgataaaaggaaaaataattttgaatcaggcaaccaatttatatgtcaatgggaccatgtagtaagtgagtctataatcagcaaaagttgatatgacgacaacggtttaagcaaatgaatataaaaaaatgaatattttcggttttgatgaaaaaaaaactctcaattaggctactatataatatctgtctatgggaccatctattaattaaactacttattaggaaaaaggtgatataaggatcataatccaaatatattttatctgcttcttctaccattaaacacaacctcaaaagtcagaagtgcgctttctttattaggcttttaacctagtagtttgttaatatagctcaacagcaatagtgatagtgtctttggtctattattgcgctattcagaaaattaccagtaaattttaacttctagtacaattagataactcgattcattgtcaaaatcacaatcggtaacatagcagtagaatatgttcgtcagaatagcaaacagtccattcaacaggcaaaagatcagcaaataattctttattaaaatcaaaatcacaaatcgagtcccagtttcgatgaaatacctttgtgtattacagatgcggcggagacggatgcaagtatgctcctttttgccaacgcaacgacaaatatgcgatagttgggaaaacggatgaactgtggaacaaacatactgatccctgaaatttataggattattaacgatggcgaaactgagtcttgtacggatcgtatcgttgcacatcagaaatcaaatttgattaacgaaaagaagcaccctatctggagttcaaatcggagtctagatcggtattgttaaatatgagaaactgatttagattagggaagagaagcaccagagttccagtcggagacggttcgctcgttgataaaagtcatcgccgcgagaaccgatgatctccaactcgcgctcgccgactatcccgcgaacggagagacggagagctggatgcggcgcgttgaagataaggtcgaccaatgcttctcctgcttcgttgaagataaggtctcagtcttatctgcctaaaatctagtaaatgtgcttgtatagttacgtagattttgatagaacccggcccacaaaacagtttttagacgcagctattaatccaagcccacatataactaaaactaataaaggcagatcacgtgaaaaatctacggtttagattaaatcacttatttaaccaacggtcaaaattctctgattaacgtgggagctcgtagaaagtgtccaattagtataggtatagattagaattatctccaaggttttgaaaattccattaaaaatcatgttagcctattttgacatgtagaactcaagaaatattccacatgccattttttattattatttgcatttattactttagagtttcactcttgccattaaacaattgattttcttgcaacaatttattaaattattttaggcttaggagaacaacttcagggtgtgacaacatcctaaccttattgcaatcagttatcattattcctaaaataaactaatatatgcaataacagtttaaataataatcgttagcgtctaaatttattaactacaatcttgatagatctaacctaactcagacaatatacactggtagagaagtagtttgtagtcccagtttgcaaccccaattagtcctgggttgcataccaggactacgaatccgggactaaacatcactatcttaagtcccagtagaaataatcgggaccaaaaaagcatcaacaccaactgggacaaagatagtagtgccatgtgaatggaaacgccaccgcactccccgcgcgacggccgcgccggcctccgtcgcctgccaccgccaggcgccgacctccgtgacgtagaggaaaagcagaaggggatgagggaatcggaggaggaggagaaggagatctcaagaaggagtggaggaggagaggggataaggaggagcggcgtgtgcacgggtggcgctcgtgtagataaaggaagagggagagagagcaagagatgcccaagatgtgggagagagatatttagtcccggttggtatcacccaaccgggagtaaagttcgttgaccgtgtgacatggtctgacggttattgaaccaatactaaaaatgatctttcatcccggttcccgattgttgttaccaaccaggataaaagatcaaaaagtacccctgggcttttgaatcgggagtaaagatattttttagtcctggttcctattctaactagggctaatgtggttttttgagtaaccaagcaaaaatggtttctccatgcagcaacagggccatgcaaaaaaaaaggtcagctcgatctttagtcccggttggtaacaccaaccgggaattctacatatgtattgaaacatatatatgcatacatatatatatgtatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttctacgtagtagtagtcgctgctagctcagaagctaaggaccggtgaattgtttttccgtcgtagtagaattcacccttgggatcaaggatttcttcgttgatgaatcccatgagttgttcttgaaccgccacgataaattccttgtgtatggtcaggttatccctcatgcgaataaactatatgaatgtatgaaattgattagtaattaaacaagaaatcgctacgtaatgaaattttgaatttatttgtacgtacatcgagctctcttgtggtgatgatttgttctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaataattaacataacaagattttcttaattaacaaaggaacttatgacggtacctgtctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcaggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggtaggcggtggagctgggggggcccttgactttgaaggtgccggaagaggagcttgcgggggagtaggtgtaggagcatgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacaccgcttgtcgcccagggaggatgatgtaccgcctgcgccatagaataatggcatggcatgtgtctcgtagatgcgtctcaccgtcttctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattattttttagtaatcaacatatataagcagcaactagcggaatggctaaatcttacctttattgataagttcttcaaaggaatatgcagctcacatggtgtccgctgagtgatgtcatcaacgggacaggtcgattcatcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcatagctcgatacccggaactctagctctgcaatcttcgcctcggtatctctcttgctcctcatccgactcctgtacgtgtggatgtcctccttgaaaccaatcttccaaggaatcacccctttcccccgtgttcatcctggatgctctggagtctgcagggcgagtgtcagctcgtctctatctctgtctggtcggaacgtgccctgagaggaggcttccactgcatctgttagtcgtcgtgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatatatcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgatgtacatagttcttggcggcttcggccggggcactaggacgtccatcttcttccacttccgttatgatgtgccgaccctcaagctttttcgctgcacctcgttgcccacgtgccctcttctgtccaacggagggttgactaccactagcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaacatctgttcctcatcgcggtcagccatctgttgatacaagaaacatctgctaagtcacgagacatttatgttttaacaatctaagtcatgtatgctaagtgtaaatgtcgtacattagaaccatacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttgtattaaaactcaaataatattacatgctaagactaaaatagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaacttaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattatgtcacttgcctactccaattccttctagggctagctcttccactcaggcttgacggacgactccgacaacacgtcttttctgcaagatacaaaaagatgtattaggataaatgcgaagtaacatatatatatatatatatatatatata

SEQ ID NO: 66127 - DNA, 25780 bp, Oryza sativa
  unsure (1)..(25780): unsure at all n locations
cttccagtaacagaagagatgaaaacaatccgttcattagattacagctaacaatggtgtgctgttgatacttgtgcagctgacaatggtgatccaggagacactccgattgtacccaccagcctccttcgtcgcccggggaagctctgaatgacatgaaacttgccggcatcgacataccgaaaggaactaacatctggatcccgatcgcgatggctcaccgggatccttcagtatggggtcctagtgccgacaagttcgatccggacaggttcgccaacggcatagcagggacctgcaaacctcctcatatgtacatgcccttcggcgttggggtccggacatgtgccggccagaatctagccatggttgagctcaaggttgttctgtcactcctgatgtccaagtttgaattcaagctttctccaaactatgtgcattgccctgcgttcagactgaccatcgaacctgggaaaggtgttccattaatttttagagagctctgacttgagattcttgaaggttatataaaatgtttcccttttccctttgttatatctgtttggtatgtgtttgcaacaatgctgcaactcgagtgtaaacagtagtatattctacagtctgcagttctgtacactgattgaagtgttacttatttgtggaatgcaacttttacttctcgtctgtcaattaatagtttacataacatcaggtgaaaaaaaaactgaggtcaggatggccgagtggtctaaggcgccagactcaagttctggtcctctaacgagggcgtgggttcaaatcccacttctgacattatatatatatatatatatattttaatataattttcattcatggactgataaacctacgtgcattgcccttcgtttatgtattacacacgaaaatagtatttatgtattacgcatggttttttacgtttggccatttgttttatcagttgacttttagacatacgtttaactatttattttattaaaaagattatgtaattattgaaaaggaggtgaaattaaatctttccaaatttccattaaccctatctcatctagtcatcccaattccaaatctaccgatcagagccgaaagcaaatactgcaaagatcgggacctcgaacatagatggcgtgaacgcttcgtgctatgttgcccatatttcttggatctcatttgatagtagttgatagcgatttttagtgtcaatttatctaaacaaaactgataaaaagcgtttgtcacacttttcttcaccaatttgaactagctaatggtgatatgtgcatatttttatttgttttgaagtatatttgcttgagtgtattttggaagtttgtgacaaatggaacactcgtggtatttggaagtttctaatgaatggtatactcgtgataatattgtaggcaataacttattatgttttaactagtccataactacgtactactcacgaatattctctatttattaaggaaattatgtgaaatacattttcggaagtttttgcactagaaagatgggcataaaccaacgaaaacagacaaagacccaacaagataggctaagactggtggagatgggtgaacgctgaggagagtggaggaagacttgtagatacgtgtgaagactcacggggacttcataggaggaccggcaaaggtggatgaagataaggtggaaattgaactagttacactaccaatagttttgagcgggcaaaaggcgcctaggtgaagcactaggcatggcctatgatagatacagttccatctattcgtcatgtaatttggcttaagtgtattctaataaaaacatgttgacaatagaaataaggaaatgacatatatcaaaatcatgatagggatatttatacctgcataaaaaaaatacttaaagcttccgggaattttttttgcccgccgtctagcttttgttcccgtgcatgtatttttgtcagattcccttcttccccgcgtacgtccggatcacgaagagtccacaatgttcccacggcaagcgcaatatgtccgctactgcatccaatccgttcgtggccggctcaaatgcttccaattcgttcatggccggctcaaaaccttcagagttcgaggaaaacaaacatgtccacatggtttccgatccaaaaccttcaaaatttgaggaacatgacaaaaaatcggcaacgagaatagatgaagctgcaaacactatccagttatacgagcttttcaccatagtagaagacgagaacttcataataaaataccaaaaattcaaacaactcaataaacacaagaaagtatagtacacttgtatcttagcaagccacctcatacacttgccatcgccgattagggtggacggggagcactgccgtcctcaccgcctatggaggctgctggcgtcaccattgtcgtctactaaggacagaggagcaccgttgcccttgctgcctagggctaggtgagcactgctaccccgcgctaagggaggacgtccatcgtgctgaggggggttggttggctacgggagcaccgccaccatccctcgcgagttgcaatgagagaggctggataatgcctccaccatcactggacggattccatctatgtgtattagatgataaaatatctcggattcatcatcaatctttcatttttaaccctttcattttgttaatattacgaaaagttattcatttaattatttttatgtctgccctcgagtttatatgtatttcacataaacttctttatactggtagaattaggtatcaaaatctcacaggattattctttaacctcacttgtgtgtttcatatgaagagataaatgacagaacaaacgtatgtttattctttggcctcattgacgcgtttcatacgaagagatgaatggcggaacaaggtatgtaaagttataattgtgatcttcacccgtcgtgaaacttaggtattgcaagaaacttgggtattttgcttgcaatagataaattccagtaaacaagaaaaatagaaaattaactgtctcttaatcattatggtctttgataacctgcaaactggcctcaagccctcaacgtagtatacacatcaaacccacttagtttatgattatttgcacctataaatttcagagtgatcacaaccattattttttttcctaaaaaagaactcatttttcacccaaatgatgatatgtataggggtggacgaaaagctcgtgactcgttagctcgctcggctcgttacattttcttaatgagccgagctaacatcttagcgagcagctcacgagctcaacgagctgggcgcatagggagcaaaatcaaacttcagcagataggaggccaacttggtggcagccccatggtccatctcgcccgtggcaagcccaaagacaattagaaacacatgaccagtcatcggtttctccactctcccgtcggctgcatccccttctcttcccgatccacatctagagcgccgcattgagccgccacccgtggccccgccatgccgtcgcgtagatgcgctgttgttcgcgccgctcacaccaacccgtggcgccatagagtctcgcgttgcagcggccggccggcaacgcgctctgctccctccatcctatggcgccggcgtcgacctcgctccccatgcccgtggtccgtggagaagggagaggaggtcgtgctcgtgcacgcgtccatgtatgtatgcatggacggatggaactatcttgttgcttgatactttgaatctgtgagtttgtgaagaatttagtgctagttgcttgatttcttgtttgaactgagacctccacctttaggattttaattttatagtgatataggtgatgttttaagcttctttttttttgtttttggaatttatgataatatgattaaaccagataagatgacccatttacctcatctgattgctgaacggttgttttcagaatgcgttcttgtctgtctgctatctttgaagcgatgaaatggctgtattagctcgcgagatcaacgagctggctcgagtttcttaccgagctgccatttgagctcgttagccataacgagccagctcgagctggctcgttaacctaccgagccagagcgagtcgagccgagccgagctggctcgatatccaaccctagatatgtactactccgtcccaaaaagaatccaatcctagcaacgaatctggacacacatgtgtctagattcattgctagagtttgtctttttttggacggagggggtatagtataggcacacctattccgcgggaaggatctgctatattgctacacgcgcgccaaggttgcccgcccaaattagttttccctcctttggtgcattttactcttcaacccactgattctttatttttcacatatattcctcagtggtgcagctgagctcgctggatgttgtacaaaggaatagaattagcaaatgatacattctatggggtgttttgtgaaaactttgttttattttatggggtgttttgtgaaaactttgttttattttaatagggggaattgttttggcggcaggaggcctcatcccaatcgcggtcggtgccgcccaaaccaatctcgcgcccctatccagagctgctgcgaggtattttctttcttcccattttcttaaccatttctactcctcaatctttctctcacacagatccaaaaagctcctcttctttctatggatttttttttatggtttttcacatgttagggttctagcgagctttatctctttttcctgtgatttttcggctttcctcacctcttaaagccctaaatctgcttcttttaccatgtgattctgatttccaggtgcgccaacaaggaactcacatccggtttgctccccttctcaatctcatctattcggttgaactggaagatccatccgggcttggattggattggattgatttcttcttttgttggtaagtaactattaagttgcatgcaccagccagttgcacctaaaagcctaagctgatagggaaagatgggcaattcactttatacactccaacactccccctcacgcgagaccccctcaagtctcaagcgtggaatattggagtgggctgcaattattttatttnnnnnnnnnnnnnnnnnnnnnnnnnnnnnnnnnnnncggctttgataccatattaagttgcatgcaccagccagttgcacctaaaagcctaagctgatagggaaagatgggcaattcactttatacactccaacagtaaccctattttccttgattagatatctgttgtagtcttgtcccttttgttcatggtgtgggggatcaaatccaaactttttagcagcgccacgccaccatcgagcgagcgctcgggtaaggtttatggttttgttcagcggcggcgcgcgcaagatttgtctcagccaagacacccaatagggctacaataggtctcggtgtagagaccacacatatttggcatttgggtgcctattactctagattggtaccactaatagcaactttgagtatttcgctatggtgttcagtttaacgctggctatagagaatatttttaatcttttatgtatctgccatagctgcatataaacccttgatacatatatagtaggtaaaaagtgtgggtgaaggtcttccaaggagctatgcatagaaagcattttaccttttagttttcccattttacaattagacggtgctttataaaatagatgttgatggttaattgatttctttttacagaagtaaagaaatatatataattgctgtatatatacttggactcagagtgatggttgaacagtttgaaatgtggccaaaaaaaagggttatcgacaaaaacggcttcggttatattagatcagatgatttcactcggcttctaacaagagttctgcttattagtggctgacgactaccttggcgccttgcatagtcttttagaacacattttacattcatagcagttgcagttacatttggggctagtgttttgtcgataaccacttaattttgctttagtttctcttattgaccctttttgccttattttctcctagaaaccttttggactcttcttgggtgtcccttgtttgtttcggtgatcattttctgttatgtcctggttagtttgcggtatttaatttttctattccttatttcattgtaggttttcattttgcaagttacaggagaggttgagtccacattactcccaaatagatcaaggggtggataagaatgttactgataattcgctagtttcaaactgtgatttccctgttgtaaaaaagttggaaaagtgtgtggatgaagaagtttctgtgcaatctccctttgaaaataaggacacaagatcccttggcatggtatatgatcatgaaaataacaagagtggtgttgctgaggtgattagaccagacaaggaagcaattgaatcatctagctcaatgaatgttgcagatgaagatcctttgtatggctgtcagacaccgcgtgaaagcatctttgatccttttgctccgggaccagaggagttagcttgtgcaccaaagaagaatatgatcaaggcaccagaacttcctccacgaaggcagctaagttttgattcaggtgattaccctattaaaaggttaagttttgaattcgatgatgctgaggaggatgatcagtttcttgaacggatctgcaagatgtttattgatctgattgtctcaaatcaagcactagagacgattggaaaggatctgataggttctaattcacctggaagctgtgagaccccttcttcagagcctctacttacaggcattgcagacacctgcccagatgcaccactgaggcgacctcttaaagcagtacagctcagcccaagcatttgtcgaaagctcgactttgattcagtcagtccaaggtgtttattcgttaaagagaataagtgatatcttgacacccttttgatctgcccaggaacagcattttggggcagtttttggctaccaatttcagttgccctgtgccaatatggtaactttgctaactgaaacgtgtaggtagtgatgctaaaggagtaggaggcagtttaataagttatacatgtaagctttaatcagtcttccttttaggtgggttagtcatatacattaggagctgtggtctgtgaccatgtaccttttgtaaatcttaaaatggatagttgtgtctggttgaactagtgagtctgttgcaggttcatgatgtggatcgtctgaatgctattcaatagtagttcatttttccttcacaagaactgggagatggtgtgccgtgcttaaatattttcatttatgtgatgaatgcagtggagcagtgaaaatcatgattgataatgtaaagtgctgcttgcttgatgcgactgttagtgatgaggttaaacagaactgctggaaatggccgtttggtttatacatgtggcttcattatatgttttgaaacctgtaacaatgtttagtatgtttgtcgtttgatcatgtgaggatcctaaatcctagcaactcagtatttgctggtgaaaaaagaagtcagcagcatatgctgttttctgtcctttttttctttctttctttctttttttttttttgcgccgggcctagttttgtgtgtgctggcagtttgccgctgtgggcatgctgtggagaaaggtctgttaaagttaaactgaagtttggtgctttggattaggaatttttggattagtagctagtaaacatgagaatagtgaaatactgtatatgtacgtatatgtcaaaactgacacaccgtgttatatacatgaatcgaatcaatcccaacacccatcaagaaatactgaagaaaatcggaagtcctgaatcctgaattcctgatcttatactatctgtaataacgaactaatgtgccacccgtgtagaatatagtaatactctatgtacttctagtagcagttgcgtggtgtaaacaaaacaacaaaatatggcttctcgtcttgtcccacgtcgcgatgtggcatgcccaccttacgttgcgtgcttggaaacttgcaaattaagttggaatcacatgatcaatcagagcttggtgcggtcgctgcactgctggctacgcacggccatctccgtgacgccgaacacgaaatggcaatccgagtacgccaccgcgtggcgcttgaacacgcccaggatggccaccctcccggggatccgagtgctcgcctccagcgccaccgacccgcccatcacgtccgtcacgagctgcgtgaggtcgccggcgaagcggtcggcctggagggtgagcgccatggtgacgttggcgtccccacggctcgggattcggcccgggtcgatctcggcgtcgccgacgtgggcgcccctgtaggtgaggtcggtgtggccccccgtggcgtaggtgaaggaggccgggttggggttgtgcaccgccacggtgatgaggagcgtgacgttgagctggaccgacatggccgggaaggagaggcgcggggagaggccgatgaggcgggtggagacgaggcgggtggtggggtcgcggacgcggagcaccgtgaggaagaggaccaggagggtgatggccagcacgagtagtaccaccagggtgacgagcaggcagcagcacaggcagcgtcgccggcgccgtcgcctcctggattccaggtcggcgtccttgtgggttctgaagggtggcgccgtggcggcgatggtgtgggtggggaggatgctgccgctgccgttgccggcggcggcggcggtggtggaggccatgtctcgatcgatagaggattgggtgcgtgtgcgtggcgtggaagagaggctagtaatttgattcgattggattggattcaagtagtgtgcggttggctctctctctctctctctctctctcgtgtctcgtcccgcggaagaagttaatgaggagagtattgctggtgtttggaattggttggcgtaataaatgggagtgttgacgcgaatgcgcagcacaaatcagcctgcaactgcaagcatagcatgacgccattgcattgcgtctcagaatttggcatgtccactgctcgcggttaaacaacgacgacatggaatttttttggtaagatgcggccagtgcgtccgctatcatggacacttcatcagtttaattcttcttattttttaatcgaaacggctaaacagaatttgcatcactacagaattactactcttttgctctatcaatagaaattcgtaccgtcgttaaaaaaaaaaagaattactacaagcacaagtacaatcggaagggagtgctttagcattttagtcggcaaagcgtcaccgtctgtcgggttcgactaggcacagacagaccacacataaggctcagctctcaagtcctcatgttccgtttcctgtcaccatccagcactaactatgaacgcctgcctgcgtccacactcatccctcccgcaatcaactccccatccttcattagcacaaaccatcatgggacagtagctgccccaaccacatccatacttcccttccatatcatactttttcgcaactcagcagcatccagcactagtgtttcttcacaacatagtactgcactactcgccgctcagattctccaatcaaaaacacccactaatagcatccgctcaagagtttggagcacgatttatacacaatagtttttaccaaacaagttcatgcaatcagctcaattaccctgcatggtcaatataccttctgcacaaccaaacagctgaattatctgattactatagtttgttacaaacagggctgtctttgttcagctcttcatgttcaagcaaatctgccttccaagttccaaccacatcaaggaaaacaaaggaacagaaacaactgctacagacttcaatttggtgaggactgttagttcaataattctactctagtatcatagtaatactagtttggataaaactccttttcaacaacgctaagacattttggcatttctgcctcagtcaatcagtttacaataacatatctgaaagggagttctctgtaggtgtttgattttacttcagcctacagcctcccaagcgtcaagcacatcaaataaaatatttttgtcaagttctaagggtccctttcaaatttcaattgaaaagatgaattggcaccaatacctcctgtataccataatcaggtgcagcatcactttgacattagtgacccaactaatcattaggaccagtcagctgaaaggttcaggagttagacctatccttcatcaatgtttcgacaagaaagggaattctacagcttcatgtattctgaccaaatggttcacccgcatctatagcaaattagcaacatggaaggacctctagcaactgaagatttgttttccttcttcggctagcaaaatgtgtcggcattccaaatatacttggcacatattgtactagctgcagtttttgtggcatgtcaggcattgcctaacctttgttatgaaaagattgggcaccaatcaaattaacataccataaatcctagcacaatatttgcaaggatgtaagaatgaaatcttgtagctctaacaagtcagtcattcactcagactacagcaagctaaactatcaagtgtacataattgtaaccgataaaacaagaaccatttcacaaacaacttattcacaaggcaaaaccaaaggtaataactgaaggagtagcttctacaaactgtagcagacctctcgtcatagaattatgtagctttgatcccatccccaatgaacaaaaataaaagagaagaaacttaaaggcttactttaagcattcctcaattccttgatgaaatcgagaccgagctatcaaatgcagatcccatgtgattgatgacgaacccgtaaatcttgcacttcaactgctcaaccttatccttagttgtagcctcttctgcaatcttgcctactccatccaaccagtcactgatcttcttgaactgggacagtaccattgttatgtggctgctctgctttcccctacttgcaacattctgatcttcaaaaaggtggaaacccaaatccattgcctcgtccacaaatttcaggaaccacgtatgcatctcacggcacaaggtcgtggcaagctcagccgtctcattcacgccctgagttttgttccatgcgcagctcgctgtagaggtcggtaagacctttgactggacctttgcagaagtcccatgtgattgcctcttggatatggttgttcttggagcttctaccaccgagggagcctttggcttatcagcaccccttttccgagagagcgattcaggtgccttattcatcaactttaggacttcaagatcagttgccaatgctgcttcaacccaatgagtagctgaattctcccatgatgcagtttcagttctattggtggatatagactcagcaattttcttccatttgagagtatcctcatagacagcaaggaagatatcaactgttggaaggggattggaggtcttcgatgctgaagtaagttcagaaaatttactgtggacaatagcaagctgagtgttaggaaaaaccacttttgtgctgaatgaaattccggggacacaagtcggcttttaattaccttaggttcctgattacggattcagtgattaatgcctcctggagagcatcagctgcagcaattgctgctgcgtctcttcgttcagtggcttcctgcaaattcagagaagaggtggtgtttcaaggatcaatgaactgcgacttgatcattgctaacaaagatgaattgggagtgcttacctttcccatctttgaaagcacatcagaaactccatccaatggaatgcttccatcggtccatttaggatcatgaagcataatttttggagccattgctttcgtctttactgcaggtgactctatcttcttccgtggctttggcttctcatctacagatgaatcatcatcgttactggatagttctgttgtaacatcactcagtcgtcttgccattgcttcctgcagttacacaaaaaggtgatgatggtcgcgaagggcacctacatgactccaattcaaagataacaactagctgccattgcatatggaaagaaaataaataccagtattttaaattctctctttcctcaataaacttataaatattttaagtaactgcaagaaaatcatgccatttctcatatatgtactgaatcaagcatttgaagtaaccactgttttcactacgattagcctgttcaaagtagagttgtactatttgtctgttcactacaacaagatgaatgtgcagtgcatgtacaagtatatagcaatagtagcatagcaagcacatttccaagattgcaattgcaacacaaatgtaaaaatgatactgacctgtgtcctcagaatagtactcttatccaccttgaccttcgatttcatcacagagccagccgctgctgcgattgaggtattgtcccagctcttcctccccggcttaacagccgacccattcgtcaaatccgtcatcttggagataccagccaccaacaccccgaccttcttcttgctgctaccttccccggacagcctccgggagctaggagacagtgacgcgcgcctcccaccgggtgcgggcgacgccgcccctctcctccctcctaccggtgacggctgcctgtacctcgatggcacgataatcgctggctccctcgccgtgcggcgattctcctccttggccgaaacaaggctgggcaccacgcatttggaaggcgctggtgacgtcgccctgggcgtgcccctgaccgcaggtgaggacgctcgggaagcgcccttcaccgagggcgacgaaggccgtgacgcgccgcccttgaccgaaggcgacggatctcgctgcttggacggcgccggagacgagaaccgcctcttggcggctgaaacggcgggcggcggcgcggcctcggagacgctcttgggcgcgagaacaatcctcttgacggcatccgttgcatcggactgcaccgcattgccggaactggatggcatgagcggcggcgcggagtcggagtgggacccgggctggatgacgtagccgcgggagcacgcggcggggcgggcgacgagcggctccgggtttcctacgaaggagacgctgcgggaggacgggacggggcggatcccgacggcgcggggcaccgggcgggcgaagcggaggcggtcgaggtggacgaggtggccgacgagttgcgggcgcgcggagacgagggcgtcggcgtcggcggaggatggctggacgtaggtggagtggaggccgtcggagagctggaggaggaagccgttggagggccagagggagtcggcggtggaggcggtgagggcggggactacggccgtgacctggaggacgggggagcggtggtcgccggcgacgcggtcgtcggtgtgcatcgcctgcagcagcttgagcagcacccccggcgtgaccgtggccatggctggctgccggaggaggagcggcggcagcgccgcgatggggaggagggatttgggggaagagtagacgttgggagtggtgaggaggaggatttgaaacggttggtgttttcgaatttcgaaatgccgccttgagttgtgttgagctctgctgcgtgaggcatgtgacaggtggggacaggtaaggcaattgtatatgggctttcagaggccgagatttcggcccatgttgagcccactgtttagtagggcctgaaatggtttgagccaccgtaccattaatcacgatcagaaacagcgatttacatccataaatcgggatccctcgacacggcgccgcggcggcggcggcggcggcggaggcaaattgcactcggaatagtaatttcttcctctacacaatcaagatcacaagacacgtttttctcctctccatacgttgtacgagccccaagagggaatattaggtatcctggctgactggcttgtctcgagtaatcttccttgatcagctctctcctctgtactggaggaatcacgcctcacgcatgactcacaattccaggacttttgggccatttcgctgtggtttatttagacgccaaaccaaccatcccaattgctatctcttcaattcctcttagccaagcatatgaccccatttccacaacatctttgctttccatgcagaaacagaacaattctagatgaagagcaagcaagtctgtttctcaactagtatcgccatcatacaggtacaatagtgtactatataaacaaaaccacccatcgcgcgcgcatgttaattgtggaaggcatcaaagaaaagtgcgcacaaagtgataattaaagagcacaaccagtcagcaaaaaacacaagggaaaaggatggttacgatgattatttctcaacatatcatcatgcaagaaggaccaatctagctaggttttgcgcaaatggttttttttttttgaagggagcaaatggtcttcgaacgtctccatattttctatcttgttaatgcatcttgattaggagatcgaatatgcagtgactgatcttgtaatagcataccctatacccatagtattgagtttactgtctggtttgagaacgtcaccaccagattactgacatcacgtagcatgacgatgtttactcaggagtacttcgtatgtagcatgtaaatatattatcagtgaagatgtaaccatgaatatgataactactaattcctccgtttcatattataagtcactttaatttttttgaagactcgaaactaagagttgacttacagaagggcacgtactatggtactagtacgtatttgtatggtatggcagcttccttgattgctttgttcgtgtgcttttgttgtaagggcattcccaacccaatgactagaatggtgttcatagcattaaataagttgtcacctaggacaaaaaaaaatgatgtagcaagtgaataaatgaggaaagagaaggaaaccatgtcttacatgagacatgatttctacacaacatccaagacatcatgtgagataagtagcattaaattgaaatatgaaatagtggtgtttgcattggaagagttgtgtctagtactagtttcttgatgatgtggagtttatggaaaccatgtctagtgttatgggttgggactgccctaatcacgcacatgaaatgagcagatcgaggataacaataagatgactttggcccctccttaaaacgtactgcaagcgaacgttttctctggagagttgggcaatttcggcggctaaaagcgcaaaagttcaccaaaggtcagatgcacgtacagtggcgcatgcaggactgaaaatgacactgatcaatattggatgagtgagcagagaaattaagtctagcagccatgcatgcatccattatgtttctatacagcaagtacttcgatgaatttgcctaaatttttcggtacgaaaaagccgtgctaccatctctcaaaaccgtcatttcttgcctctgtttatgtaggtaattgttggcttgttggaaacttggaatggcactccctctgaagtctgacccgtgaattagtagtccatatcagtatcgccaatcaagtcaacatacgtatatgtatcaaacgaatggatcgagtactaaaccaagtagtcgaacgctgaaaaagtgcacgatcctctgttcatcgtcatgtagaaagcgctgaaaaagtgcagagttatctgtttatcgtctgaaaaagtgcacaagaaacgatctggagcatttggttgcaaataaatggcaggatcttcaacagtgtctacggtacggttgaagatgtagtagcaaatttggcaaaggagttgttccaaacgagaggagaagcacgactagccccagccccagagtaatcactttggaccactcgtcaaattagttgggctagctgctcgatcagcttcttggctgttcagcttgtaataatttgttttcctctagtgctctaagctcttttcacctcctgtaattatattgaatggctgagttccttccctttcccttgaataaaataagtgcacatatccagaaaaagttacacatgaaattaccatttaatactttgaagaaattaagcaccctcggtctgcagtcagcaaaagttacacatgaagactgatatattcagggatagctcggtagtctgcatcatgtccatgtgttttgtgttttgcaagggggcggggacactgcatgcgtttgtttttctctctgtacgatgagatgatgacgatgttgagtttgattttctcagctgcatgcacagtctatagacaaaattatttcgtctaattttccatctagctctcatactgtagtactactgtattacgcggaagtgatgaatttctagcgcaaacaaattaaggatcacaccacacggccggaagaaagatgcatgtgtctctgttcatcgagctataagctactctagttgggacagagcatcgacaaggatgtcctcgatcagtcgtccttgaggcatctactgccttttctctctttcatcgtctcaaacaagaatgaatggtgattaaaacgtgatagatactctagatcggttggtagtactagctccaccgcgagatgaacaaggcagatcgagtggctctacagtacagcacagtgaatgagacctgaaacaaacgaactgggattaatttcaagaaatatcagctggcacaagtctgggactaacagtagcaagtcaagtgcatgttagctgctaacatcttgtatgttcagctgaataatgttctgttgtttataatgtgtgttactcatctctgtcaagtgttacgcacttccaagctaagctctgctccatccatcatcgatctgtgtcatatcaaagcgtggtatagcaatatgatactagcagaagaatagcctaataataaaggattcccacttctaaacaaaataaaatattgctggagataggatctgtttgctactcacatcaggtgtgtttagttcatgctaaaattaaaagtttggttgaaattgaaacgatgtgacgaaaaagttaaaattttatgtgtgtagaaaaattttgatgtgataaagaagttaaaagtttaaagaaaacttttgtaactaaactcggcctaacacagaaatggtctcaagtcgctcggatagacggtcaagtactcacaaactgaacatgctgctgtatgggctagccgtctataaaaaaatactctctccgtttcttaatagatgacgccgttaattttttctcacatatttgaccattcatcttattcaaaaattttatgcaaatgtataagatataaatcacacttaaaatactataaattataaaacaactcataataaaataaattataattacataattttttttaataaaacgaacggtcaaacatgtgagaaaaagtcaacggcgtcatctattaaaaaaacggaggtagtaggaaggaaaaggagaagcagttccatttctccatctaataataaacaataatctttgtaatattacatccggggaagaaaaaaatgaactcccctgtagctgtatatatgtactgtcctacttgtgctttactttcacaagcctgtattaatcctgcttaattttcctattaacatggatgattcttaaccaaccagtagctagctacaactaaacaagatatagatgtaaattcctctgttgtttgcctgggtgtttagtgctttgcatctaggtagactctgctgctgagtcgctgacaggtgggaccccgagcttcttatcccagcaagcaaggaaaggaagagatgtggtctaggcggagcaagtcctccgtagcagcgagctgccgccgcggaacatctcgtcgatggcgatgacgatggccatggcgagcggcgcgcccaggcggggctgcgccacgaggcggaacacgtcgtccccgaccgactccttccgcctcacctccgccacggcgtccccgcgcgcgtcgcgcaccgcgcagctccggcgcccgtacgagccctccaccacgtaggcctccgggagcggcagggaggaggagagcggcgtgacgtgcgcgatggccttggacttggaggcgcggaggccgacgcggcggcggcgcacggagaggagcggcgtggcggtggaggtggcggcgccgtcgccgtcgtagatgatccagctgtcggagaggctcatcctcttgcggcggatggtgaggagcggcttgccggcggcgtccatgaggacgaggtcggcgcgccttgagctggtggagtcgtagcagtcgaggcggaaggcgaggttgcccttggcgtcgaagacggtgaagccgtggcagttgaagaggagagacttgcgccacaccgtgagcaccaccgggggctcctcttcttcttgttgttgggagacgatgctgctaatgcagggtggctgtggcgcggcggcgacgttaggatgcaccttggcggccattcttgcttgtaaatttcttcttgtcgattcgatggacagaagaagagaaggagcaagtgcagaggaggtgtgttgtttagaaataggaatggttggggttggggaatggaatgagtggagggcgcggggaatttataccgcgcgaggtggtgcgtgcttacgtggtttgtgcgtggacggcagccgctagtgcgtgggcggggaggggggagcacatgaatgaatgaagccgaaaccgatcgaacgatgcagacaaatgctgcgcccgcggctaacactaacagcggatcgagtattattagctttggatccgcttaattcgctgtggtgggattgggtgccggcgcatcttcatctgcgtgtacatcagatgcagattttagctttgatttttgtttcttgtaaaagcttgtatataaagttaatttaaaatatcaattaatctatttttaaaatttgtaataatctatttttaataatatcaaataaaaacatattttttaaagtttatatataaactgttgtttccatgtggcatgcaacgcgcgagcggcacgtaggatccgaatggagcgtggtaattagggatcggaatgataattctatagtatgtaattaacttataatatacggagtaacttgtttgtatgtaagtactgaaaaatatataattttattcattagagattacaatgtagttatattataattacattacagtatattatatttatatttaaaagtttttacccgaaaacgtacactaattttttagcagttttacacgtatattctatctcttagaaacaagatcaaaatgtatcaaagtcacgacagaagtcttgcggtcacgataaactaacctcatcaccacacttgactagcacaaatttttttctctgattgatgattttatttgcatatctctaccggtttttaatcttttgtttaaggtttaaggagccggttttctcggttggacgcatggggcagcggcaagatcaggatggatatatgcgtcataggcggcggtggacgaacatattctttgcatgcctagataagacttagccacacaccgacttaatccacttttacttctacaatcaactcaaagttattcccccacagtcttctaaagtgttaaagagcatgtaaagctataataattgaatggcctactgccaaaaataccaaagcaccggcttgtcaaactacatctcgcacatactacgtactcaattcgacatctctaatctattatataattaaagaaatagaaaaagaagcctccacgttcgctctcatggtctagaaattctcacattaatcggagaaaaagaaaaagacagagtccatatagaaatacaatttaaaatagctgaaattcggaattaaaaaataagaaatattagaagaggagactagagtctatatagaaatacaatttagaaatagttgaaattcggaattaaaaaataaggaatattagaagaggagactagagtccatatagaaatacaattaggaaataactgaaattcggaattaaaaataatgaatattaaaagtagagtatagaggccatatagaaatataattaggaaataactgaaattcggaattaaaaataaggaatattagaagtagagtatagagtccatatagaaatacaattagaaaataactgaaaatcgaaattaaaaataaggaatatttgaagcagagtatagagtccatatagaaatacaattaagaaaaaaagaaattcggaattaaaaaataaataatattaaaagtagagtatagagtccatatagaaatacaattaagaaaaaaaatagaaattcggaattaaaaaataaggaatattagaagtagagtatagagtccatataggaatttaaaactaactaaaatatagaataaacataataaaattaaaagtagagtttagagttcgtataaaaatacaatttacaaataactaaaattcgaaattaagaaaaatatgggaataagagtttaaagtcaatacagaaatacaatttagaagtaactgaaattcgaaattaaaaattaaagaatattgaaagatgagtttagtgtccacatagaaataaaattagaaataataaaaattcagaaataaaaacaaatagtattggaagaagagcatagagtctatatagaaatacaatttatagaaaattcgaaattaaaaaaagaaatattaaaagatgagtctagagtccatataggaaatatataatttacaaataactaaaatttgatattaaaaataattaataactaacatgtatataaaatacaatatgaatattacacattagtagttttgtaaagttattgcaaaatttaaaattatgttgtcattttaatatatttgaataatataatgagaaaacatatatactattatatgagagaaaatataatgctgctagccgcgcaatctgcgcgggccaccatgctagttaaatataatattttaagcctttacaaatatattgctatattctgataacatgttgatttctcttaattaattgctattcgctaagcacataatttgtactaatttatatttagaccttctaatcttcattctcgttgccgattaagatctaccttgatttgtacaaataaccatatttaaaccggaaacacatcatgtgtatattagtttcacgtgtaaactaactaacaaatgtgaaaaaataaagaagaaatacttaaatagtgttacatctaaagtcttaatcttaaattcattatattttagccataattaaaaattatgatatttttaagactataaatatgtcggttttgtttattttgttgttctctatgtacgatgaatttaaagatgggaatttacacgtagatgtaatactataaattatagtgaaattacatgcatgtataattttttatgatatttgttaattggtatgcatgatatgtacatatgacgacttgtatgtataggatacgtttatatttaaacccatctagacaaattttagtagcactgattacatagttgtattttcgaatgtttttctttcaataaatatactgatctatgctctatacccaagttttattaatgtgatgtagacgtatgataagacttgtatgtatatatgtacagtaaaacatggataaaaaaatagaaccatctatacattgcgtaatccctctcccttcttaaaaaaaaataagtcacccctctgccatcttctccatcttcccatgcaaccatcctcatggagccacaaattaaatccgccttcaccttccattctctctcctaaccctcatcttctgtattctcgccttctcggacttcattgatcgtatctccatcctccttcgactccggcttttcccgctgccggatccgtcagtccgtcaccacactcaaaagacacaagagcttcctccccgtcagcgggcccaaactgtcccacactagtgatgagctgcaattatccaggatatttatctaagcaagggaacacctccaattagctcattagagttcgctggagctgcaaaattaaggttgtgaagcacgaatcttgaaacggatcgatctgaaggttaattagacattaacgtgatttcttctcttaaatcacacgtgtgaggtagtattttcacatgaaaattgatatggatgaagctagagtactggaaactaaaaacagatattcccaagtgattaacagtttttttttttacaaaatatggttagctcggcaagatttataggtggagaaaaagtgtatctattgtttcggatgtatccaagtccttgcaacaaatgacattcatcctaattctttggttaagatgcgcacaaataaatcttggaagatgcatggtgcatctagaacaaatgcttcatgatcagctagcagctggtccggcatatgctggcaaaataattcaatttgattcagatgagatgattcagggagatatgccggccggggacatcctatactttggaacaattgaatagttcacacaagtagctactagatcagaatatttctacatcttaaataaccatgtgagccttatggatactgtccacgaaacaagtacgtatggttaataagctagccagccagccaaccagccatatatgttcttttcgcttgactaccatattattcttatttttttaaaagaatatattttaaatgtctatatatattaattatgcagtaatggagtgcatgtcttctccggtaagccatagcccatagggctataattgctctaacaactaaatcgaacatagcctacttgctttgcactgtataggtcctgttagtttccactcagtggatgtaattttgaattttcatggcacgtttttcaaactactaaacagtacgttttgtgtgaaaaatttctatataaaagttgttctaaaatatcagattagtctatttttcaagtttgtaataattaaaactcaattaaacaccaacatactccatgactccatctacaaataattaaatccatatatatcgcgtaattgataattttaggttttctctcctcaaagttttgaggttaatttataactatactcctcatactcatacttaaaatatacctctaaaaataagtaaaaaaataatcttacaggtttaaataggatcaggaaacatatattgataacttcttgcattttttaggtgtatagatatttgtgttaattaagacagctatataccttcaccttggagctatacacctctgacctccgaacgaacaatatgaggtgacgataaaagaaaattcttggtattgccaatcataaacttgctttttaatggtttaattttttagctctcagacaatgagagtatatacctctcaaggatgaaagaaaacctctaaagattattggatgcatttggaagaatattgacaattgacatatcgtgtagtcagagtcacttgcagtagtgtggtgggcaaatgagaactattctatatatactattaatctattcctgagaatatagatggtaaaataacgcgtacaattatttattcttgtttataaactgctggtgcctatatttccactagcgttaatcggttatgtttgtccgtatataccatactaatttgttcgtgtgagatatactatggtcagctagcatctgtcgctgttgctatgggcatatatatgcattacatgtttgatcgatgcaacatatatactacacattttgtatgtttagacattaaatcatataaataccagtcgtggatcgatgcaaggggtgggttggctacagagttcgaggtaattaaccggagtccaatgatttgtatgggttaggcaaattcagagaactcagacacatgaagtaaccagaagatgtgtatatatgcagtatgcatgtgcaactcttggcagtatgttaactaattgccttctcgatatgatccagttaacatatactagtgagtagacattggaatggagttcgacaatagtatatcctggatagcttgttcctctgcaaggggggcaaaagcagagttcttctccttctatacactggctgcatgcctgtgttgaaggcaaagatggagacagttacctaacaatttcgttcatgtgtgtctgatcactcaagtcatgtgctttgctaagcatacatctctcgttgatacttcctatgtcctaaaataaaaaaaagagtaaaactagataggatatttcctaatacagatttatagtactatagaatatcatattcgatcctaggtacttatattttaggacggaaagagtgatatttattgttttgaatgagtttgatatcaaattataatttttttaactataaataatttttaaaatatttatcttataaatatgaagactaggtatatatagattcgtcttaaaatgtacttcaataaaatcatatatttaataatttttctatatgtattataataaaaaaacagtgactgaagttgttttttagaccgtgtttttctctcaaagcaataagtattagtattaacctagagggagcagtacctaaattgtcttcgcaaacggcttaaaatccttatcataacacatgtaatggcagtgtgtattagctcctaaaactaacataccattagctttctgatctggaagtgaagaggcacgcatctacagctccctgcccccacatgaagtttttgggcttatttggtttgataccaatttactaccctaccaaaattttggcaacttcaatagtagcaagtggatgtttggtttgctaccaaattttacccaccatagttcaaattgaatactatctaatttggtagtgccaaaatttgccaatgttttggtactatccagattttggtagggcaaaaattggctccaaaccaaacaagccctttgtttttcctcttgaaagattgtagtactgaaacaccatgcatatcgtatcgttttgatatgcttttgaagtattccatccacgctatgtagctatcttttttgcaaactgcatatgcatggttcgccacatgcatgtcatggtcgaatgatatttcgctgccgaacaaattaacccaaactctaactgtagcttaaagctagattgattttggactgcacgggggctgtctcctgcagagatcttggcattttctaggtcatgcatgcatatggacaactttgattcatggttgatatttatttggaatgttgcaattgctcattgctcatgtgctagctgctcaattagttgcttgtccaaggtgcttaagacacagaataggcatgcatgcagctttgcaggtttgggagggaacaaataacgccatcaaaagcacaccatccaaactgggccatgtggtcactccagcttagctgagtgtatatagttaaatatccagcaaaatcttttctttttcggttgtgatgatcgatcagtagtggtagtgaagctgcaatataatgtcccaatagcttttccacaactgtcaggttatatttctactatatgctacatgtgcttgcacagttcacccctatcattccggttacagtgcaattaggctagaagccacactgtcatattttagtacttcctgtttgtttccgggggggggggggggg

SEQ ID NO: 66128 - DNA, 72504 bp, Oryza sativa
  unsure (1)..(72504): unsure at all n locations
agaccgtttcaatgcaccttgctgacatcttctgcagttcttggatcctatttaggaacattagtcaggaagccacatctagctccactgaatattctaaaatggaatgacaaattttttataagaatatatcatcaaaaaatgattactgaagttaaggtatttatgtttagtttaccatgtttttaaaatcatactgttatggtgatcccagtataattccattggctcttttttttatgcactagagaaagtttgcaattgatgggagagctaagagttggcttctccatcagttagatggtaaatggaggcaatacaagggaaaactgaaaggaaaatattacaagcctaacttacctatggaacgagtattgcaaacggtgcccaacactgttgatgaatctcgatggcctacactagtttcctactggtactcaaaggactctaaggtaaatatatgttgggactttttagtgagtggctgtcattttgaattatctcagctcatttaaatgatgatatatattgtattgttagaaaatcagtgacagaaaccaagagaatgcactcaagcatccacacactttaggaagaaagagttttacaagaaagagaaaagaactggtaagtcatttagcacttttatttgttaattcattcttctatttcctcatgcgtttgagatttataactataggaagttaatggggtggaggtggaccgagaaaccttctttgatgaatgccataagacaaaagatggtagatatgttactgatgctactcaagaaaaaatggtactaacatatctttttttaactgtttgtacaacaaaatacactatgctaagagtatgatttttccaatgtagaatgaggtatacatgaaattggctgagaaaagagtagatagtcaacaactcactgaagctgattttgaacaagctatgttagatatgtttggaaaggatcatagtggtagagttagaggcatgggtccaaccattactcctacaaactattatggtggaaggtttctgaatatatcagcaatcaatgaacaaggaaccagctccagtaatgtcaatgctttcataagttagttttatggtctcatatatggcagagaaatatcccgaggacaatttgttggctaggctgccaccatcccttactaggctcatcccaacaagtgaggtatgggcccaagattactagttttaaatgtagcaacttatatgggcatatgcataagcttggaaaataatgcattcatggattcattttcaggttaatcaaaaccaagaagttcaggcaccaaatactgcgccatctcccagtcagagagcatcttctcagccttcaactgaagaagagtgaagttatagatttacagtggcaactatatcattccatactacttgctgcattaggattttttttagttatcttgtttaacaagctactgtttcactgttatcggaaataatgtttaagcattttcattgggaacaatgtatggatattacttgtttgtttcaatacgaagtactggtgctaaaaatcttgttgtgatctaatggtaatttaatctggtgatattgttttatgaattttatgaataaagttgtattaattattctcgtgtaaccaacactgctaaggacggtattaaagtagagatggttttccatgtgtctagaaatttgatttgaatttcgagttatctatgtagcgacggttccgaccgtctctaactatacgtatggcttttcaaaccgtctctaatcatttgacacaggagcaatggcaatgcctctaacacggttgctaaaaccatctctaccacaattagagatgggtatagccgtctctacagtgtataaaaacccgtctctagagactgtttgtgctgtaatggtttaggaaccttgatgacagtacaaatttagggaccgcctgtacaattcaatctttaaagtttatgggggctatatgaactctttcagtttgcattattgctattgcctatatatatttcttttttagatgattggcaattgatctaaccgctatgtacatcctcttgcgccacaaatagtatgcgatatgtatagcgtataacacaatgaatccctccaaaatctcaaggtcgtcgttcacaatggctcatacataccatgatgttttggactaggaggcatcaagaataggttatgccctttgcaattaatcggctgctacaggtatcccaatagtacatattccacggcgcaagcagtttaactgatttgacaattgttgtggcagtctgccaacaaattgctatctattgatatgccatgtcacgtcattatgcaaacatctaaaaattctcaccattggaatggcgttatgagcaatgatcgtcgtactccttcgctgtcctgtcactttatttcagatacttgtaaccgtataatctaacgcagagaaggacgacggtcgcccaggtgaagaccagcgtcccaagggcgttgcctaacctctcggtcatcacaaccaagtgaacaaagcgattcagctgcttctctggcacgaccatcttgttgccgccgccttcgaattcgccctgtacgtcgtcgtctaccactcgaatccgggcgctctgctgctcgccatgtctacggctatagtcacatgtcttccatgcttctgctaattggcagtagaaatcgtcgacaatctattatgtatatgatgcgtaactaattcaaattttccctttaatatgtgaccccgttgactttttatccaacgtttgatcattcgtcttattcaaaaaatttatataattatcatttattttattgtgatttgattcatcatcaaatgttctttaagtatgatataaatattttttatatttgcacaaaatttttgaataaaatgaatggttaaacgttggtcgaaaagtcaacagcgtcatatattaaaatacggagggggtactattcatgttctttctcgagatacaaaagtattggacaataatactgtagtgacagcagttagacctgcgtggttaacatgtcttggagactagctttgtaaaacacaaattacatgtatgtgcaaggaaaacctgtgccattttttcctgactcatgtagtaggacatgaagcctcatgctcttacgtgcaattgagctaaaccataaatggggatttaaatagtgctgagtcatagagaaacatatactcaatttgaaagtgctgatgaatatggctggaaccacacaaaagcttaagtgcctatagcagtttgcttgctactagcgccgttctctacgatccttaaaatatcatacactttgtgcacaatcctatatttccaaaacttgtgtagaattaggacccatcaggattggggtggctccagatatccattccactcgaacggtcacacagggatcgctggaaaaaatggcacgatgttgagaacacctaattatgttggtatggtaggaaaatgatgttcgaagaagatgatgaaacagaagatgactgaccatagcgaaacacatcaatcgatcggcactcatcatctggaagacgcggcgcggtgacaaccagaatcgtagcattgatcatgctcagaccattaaacgattatacaccgtggggtcaccatacagctatgcaagagatgatcaattggatttaaaccatgaaatttcatatggcagtagaacaatgattttgaaggagcaaactatataagattactccacgatcgagtacaaaaccgtggtgagagcgttgaagagcaaagcaagctacttttgtgaagagattaattaatgttgagaagagttaattgcattttcatatactactattttagtcgctcaatcgctgaagacgttgtgccattgagacattatcacatcgttccacatgttgtcgtttggtaatttgatcagtacaactttaccaattgtgtataaaagaatggcattccaatttttgaacccactattttttttatgtaatcatggcacacgaatgtaaaatggcctacatttatacttcctccgtttaacaatataagtcattctaacatttcccacattcatattggtgctaatgaatctagatagatatgtatgtctagattcattagcaccaatataaatgtggaaaatgctagaatgactttcattgtgaaacggagggaataactagtatatatgtaataattaagatacgtgaccatatataaactacgtaaacaaacagccaacttcacaaatagctcgagggccttctacacataagcacttcactcttgtcacacaaaacatgcaacgctaggagcatcctcatatacatccatctttatttccttaagacaatttgcaacttactagcttaggattgggaagtctctagaattttcatatatatacctgcacagaatatgccacagagctgcaatttcatcatgagaagcaaatcatcaatgtcactatccaagagtggttgaccatcaattactcccacagatggaggaaagtgagtagtatcttgtggttttggagcaaacaatacaaactggccattggtcagtttttcatcaaaatgaatgttcatcatcaaaatggatagcctgaaacgagtgcagtccttaagagctggtttggtttgagacctaaattaggcttaccaatatttggcaattttaatagtgtttagtgtctatttggtttgaagccaaatttcggcatgcctaagaaaataggccatttcaatagtgaacttaggctattttgacttcaatccaaacacaactttgccttatcaaaattagttaatgccaaaacttaccaaaatttagcactgacaaaatttggtaaagtctatttaggctacaaattaaaccaaaccaatcctaagttacagtcaccactgtggctagctgcatgtttggagagaaaaaaattaaattttttttcctctccaaacaaaatggcacgcccagtgggacatggttctcctcctatctttgctgcgcacaaatggtcgtcgagttcttcttcgctttcttctccgacaaacatgatggttgatgaagacctttggttagagctatttgtttttcttcttatggaacggctcccatcaagaaaggggaatccagtgaagacaacctggttgcacttgtttgtgattttgaatgcagctcatggaagtgctcaagttatcaacaagctcaattgggggcaatcgaggaatttcttacaaatatttcttcttttgggaagtgagagtttctagcccaatggagctaacaaccacggtgtggacactagcattttctagctgcaaagctggtcatggtgattgctggtgatgttaatttggagtcatcaatttgggctcatgtcagtagcgaatatactgccatagtgctacagtttcatttcaccggttctcctcccatctttgatgcacagaaatgaccgttgagttgtccttcgtgttctttctccgacacacatgatggttgatgaaatgctctggttaagagctactttcttctgtaatgataacaacccggtggcacttgcgatttcgaaagcagcctcataggttgtgaagtgctcaagaaatcgagaattcaagatgctcaaccggggcaagcgaattcgtacttaaatttgtgccggggagcatgtcaaaattctctgaacttactaccatgacatgaacaccggagtatttagttggacaactggccatgcatatatcgataaagccatgcatgcagctggctgtgaaccatctcatctccactgtaaaagggaggccatctcactatacagagagggcagaggtagaacacagtggcaagagaactgatccatctactcatccatagctggtgcgcttgcacatcaccggcgcccggccctgcagggaggtagaggccaaaggaggagaaagccatctgcggcgcacgcgcacacgccggtggctagtagaccatcaactttggcattcatatacaaccaacacatccatccatccatctattcctatccagccgcaccaacaatacacaccgaccgacggcggagcaacaacatgtacacagccggagcacatcggccatggcgagcgacctcggccgaagcaccgcgtccggcaggaggatgagcgccctgaccatcagcaagcacgaaagtgagatcaatggctgcacagggtaaagctaattaagattgtttcctcctccttttatccatggcacacgtacatgcataggccgatctatatacacacaccgttgttgccggaggagtcgccgtggacgattcatctacacgccacagaatgtcgtcatgccgcccatccgagtcgacgagatgctactcgtccttggagtcgacatcgcccgttcaagtccttggcgacgtcatcgagaggccagacgtcctcgctatggtgaggcgaacttgccacgttggagttgtcgtcgtgctgctcgtcaggggaacctgcccttcgtcacatcggagtttttttttttctccccatcatgtcaagagcgaagctatctgtccatgatgcacgctctctccattgtcgctaccctgctgtactacgtcgagggtcgttggagccgatgtggacgtcaccgagctgcttgcatccacaatacatgagaccttattgccattgtcgagcggatgaggcactgtcgaccgatcatcatccgtaggaggaggatgtcgttacgccgccctaccggagcagctgcagatgtcgccaagccatctccctcctcgtagctatgttgtccacagcaccgtggtcaccgagtccgccgctaacaagcgggcctcgatcttcttgtcgtggctagcccacggacatcacaatgtcgcttgcaacaagcctctaggatgcatatatagcatcggcagtgttcaactcgacatgtctgagtccactgctacatcatcaaggccaacttgcttctttcatctccactgaacagagaccctcaatggtcatgccaccgctgacatccatgttcgccatagaatcaatggtgacttcgtcacactcgccaaccccacggtgtgcaatcctcacactcctgttgttgcaggtttattagctactgctagcatcaacctcatactcgagatagtgcctcactttgatcacttagcatgccactgcccacacatgtgctgctgccaacagctcacggaagccgttggtgatgctcacaaattaatcaccaccaaaatcgtcctgacagccagcatcatttatatatgcaccaaggcatcgacatcttggctgctgcctgtgatatactcaagcgtctcaccgctgtcagcgccgtcaccacacttgagccattgctggtattcacatgaccgcctcaactgaagagttcaaacctgtcatagtatccggccttgacctccatgatatcctcgtggtcgccaactctgccgacgccatcaccggcgtctccacgactgcctccgatttcgacctcaagattgtcatcgctgccggtacagtcgctgtgctgctggcaatgtttccatgctcgtgaactcaactagagcgcacgtgttgcagctggtgtctgcaagatttccaccggtggttcctatcgctattctacgaggcgtatttactttgctatgtgttggcaaggcaaaggcaatccataaggcagaagagtatatttattttgtagcagtgaggtcaaattccttgtgctaaacatcagcaaagcaaagtcatgctgctcttctaacccgagatgacgtcgttcatgtgagttggatggtttgcaaactatgtattgccaaccaatgcaagttaccaaagtcatatggaagctaaatgctcatgcctgtgtattttccatcaaaggtataataaaagtgacacatcaatactccaccaatgtcaggaaggctttctcccatacaactctcagtttgtctgagctacatgtgaatggctccatcccattctctatatatgtacaaatataagagcaatgcaggactccatcaaacaatccagggttctgaaccaagacgattgactcacattttcttttaaaaaatgattaatcaaatgatctgtcattgtttccatgctttctgctcaattcatcatatgagttgctgaaagcatatactagaacggttttgatcgtgaggtgcaaaaatttgactgctttgggcctcaaaaaaaactgtcgacagcccaatagctagttccatactagaaaggttgccatttggttgtactatctaagagaaactgttgatgccgtgctatgcgtatacacttgcaactatcactctagcagtgccatcattgagacacatctattgattttgtgtctcttctaacgaagcctgattcccatacgttcataccactgttcaaaccatatacacggagaccatgacactatgtaatggcaatgaaacacataacaacctcattctcaagcatttcaagattattcaagctatcatatactcgctgctgggtggccacagtttttttcagtacctagcttgtgctaaagccaagctctctctcattcaccacccaaggcattgaacatatctactcaagaatatcgcccaatccccatgaaaatgcagaattgtagaccaatgctcattttttttgtccaatatattctcctcagacaatggcggaagcgctatgcaattatagccttcattttctaaaaaaggttcttttacaacattccattcagttcccatatgaaacaggggcaactggctttctctatatcatgccatgctcacgactgaagatttggttgccctaggacttgtccaaaactaatcaagaaaaagaatcaatctactttcatcacacaacacacatgtcaagcagtggctaccgggggcaatggaaataattgctcggataactaccgattagcgagtttaacatgtccctcgttttctcaatgcgtctcagaccggtggagacacaaaaccccaggggaagactatagagataaagagcatgaaagggctacctgtcccaacataagttgtagtgcagtgtgcagccacttgccaaccctgcgaggtgataataagggaccaaaaaaaaaagcctgtgaggggttctttagtcacaaaattgaatggctactctctgatttcccaaggggatggttctccgacatgtcatatgaagaagtacaattattgaaagaaattttacaatcaagctatgaccatcaaacaatattttagatgggatcattcaatcttcaagcaagaagtatcaaggatatcaaaaaaaaaagagggaagaagaagataagaagctcttgatgtttaagtctccagaatatcaaagtagcgaatcaagcatatcacacatttgatccgaagaaggagagtagccatgtaacacccttcagcaaaagtaatggcattattccatagccgatgtcctaaaaaaaccattcctaatcttagcccaccctagtctctaggttcgatgagacaagcattgggaggtctattgtcaactggtagccttgccaaaacatgttttcctacacatacaatcacaaaacattttgtgttgctatattcgtcatggtttttcgacgatattcaatgactaagtcctttggcagcctatctgatgtcactctatagctggcagccaatggaaaagctaacactagcttcaaaaaacatttcgtctagtaaaagttttttttttgttttgttaagctaatatgtttctcgactacaatctccaatataaggagtgatacgacacctatctttgatgatggcctttacctttaattgaagcaatggttaattctgctttgattgtatggtgtccggattgaccctgttacttcgaaacaaaatttcatcgttccattattggagtcaactaaataccatgttaaatccccattgattccaagtgatgtttaattccgcttgattctcatcgatgattcattccgcttgattcccagtgatggtttattccacttggattacctagcatctgttttgtggagctattccttttattacctacatggtcaattcaaattgatgcctagcaatggttcattctgatagtactatatgcatctaccttatgccacactatcattttgtataagtgatggtctattccgctttaaatcatccatgatggtaatttatttatacctatagtgatggtggttctgctatcgataaatgagagcagtgtagcacgccagcgcggctagtgtgaatctgtgaaacccttcgatcaagttggctggcaccgtggagtttaaatggtcccgacttgattgataagacccttcaagaaatggcatgttctttcgccatggattgggaaaggcatggatttacgcctcacacatgttttctttagtagtggcatgaattttcgccacacaattctttagaccatcattaatctgatgtcaggttcaaagaatgaatcccattttcggcatggatttgcgccacaatattcttgagacagttcatcatcattggtcttgagaaatatatatatgtttacagggggcatgtagtgttgcctcaccattctttacactggtattaatctacagccaggccggtttaaagaataaatcatcattttggcatggactttcgcctcaaatattcttaaaaccattcgcgaagggttttaagaatataattgtttatcgaaggcacgtattttcgcctcacaattcttcagactaacatgtgccatccgtctagttggaagaatgaatttgcggcatggaccttggcctgtcattgtcttaacaaatagtataattttttttctggggcatacacttttgccgcgcaattctgcatgctggtatcgatcccttgaagaataaatttttggcatggatttccttcttaaatattcttgagaccatttgtacctggtcttagaaattatattttatcgatggcactaatttaagcctcaaatattcttaattccttatacccctggcattaatatgtgtctcgggcctgaaaatcgatttcttattccttgggcatgaactttagtctcacttgttcttaaaagaactttagactccggtatcaatatgtctcctagatgactattgatttctggtaaatagtgatggatatgccgctatgaatattttgggagcagtgaaacacgccagtacggctagtgtgaatctgtgaaacccttcaactcattcagctgacatcgtggaattttgacgatcgtgtgggttgataaaattctctcaggacacggcacttttttttcccgctgtggccaggacatattatggcatggatttttgcctcatgtatttactctggaccccatctagaatatacaggtctgaggagtattttgttaataatggcatggttgttcgcctaattcatttactttggaccttatcactaatacacaggtccgagggatgtttgttaacaatggcatggccgttcgcctaactaacttactttagaccttatcatcaatatacaggtctgaagaattttttttttcgacaatggcatggattttcgccttatagtatgttaattcatgagtcgctggcatggatttattttgcctcagtacatcctggtggactatataccatagtgaaaaaaaatcacatagccctttattgcaaaatttggtggcataatctacagctaccgtgagatatgctagaagggattaaatgtattttaagcagtatggcggcagctacatgcgcttcttcaacatagaaaaaaccaccaagttcgtcttggttgtttattcggtgcttgaactctgcttgcagttatgaaattaaaaaaaaaatgctgtggtacttaatttattgttcctcaggaaatggaaaattttcaccaagttaattccgagccgctccatgctcgaatttaacttggtgagggggcattttgttcgatgatattttgtacaccttttttttattttataagaaatagggtgcgtcaaaatattaatttcggaaataacagtataataataaaattagtgattaattatcactaatggtacaatctgacatacacgagcatatatgcatgaatgttctgtgacacgtgccaatatctgctctagtgcctagagtacagacgtgtatatgctcatggtattgcttcaggtgataatatgaattttctttttattaatctgaatggaagcatgccactgtagcatcgtcattagaggatgctaatcacgtgatttgccggcagtggattgcttgcatggaaaaccatgtacgtgcttgcatagaaactcaagaaatataaaggcaatgtagctctgtctagagaatcccttgccatatgcagtgtgcacgcatatacgaatacaaggaagccggtataatttggatggaatcatattgagtatgatcctggctaattggaagaaatcataacatatggaaggaattgcaaaatcgtagaatcaactgattggcttgccatccatatgtgagccatgcatgcactgggcagagaactgcatccccttcacgctataaaagaaccagccatttcacggagcagagggagagacgggggcgacggaggcagcggagagaggtcgaggaccgaggcaggagccgagagcctgcgcgttcacgctgcggcagccgccgccgtcaggcgctgcaccatgtctagccttggcagtagtcagtagagcccaacatatacaggggaggaagagaacacacagaaacggaggaacacacacagacagaacacacaccattttggctggagaatctcggcgtccagcgagaacacgggcgctcggcggtcggtgacgttggccgcagtgcctcggcgtccggcgaggaggcgcgcggaggagaagacggtcgccggagcacgtacccagccattgccattgtacagcttattagttttcttttgttttcctgctctttctgttcagatcgtcatgcatgcacaacacggcgaggaggcgagtttctgatgctgctcggcccgccggatatagcgtcctctccgcctgtcggacgcaccgccggccggagatcgcgtcactccctctcatcggagacgtcggtcgccggtgacacatctacctgctgccacgacgtccttgcctcgccggccgcaacctctatcccacgacgccttgtgatgtcgccgagacgctggacgttgtcaccttcccggtcgcagcctcctcttcgcgacatcactgacgttcgctcgctctcgtcgacgttaccatcttcttcgaactcatcggctggttgctcgaggagaacgccggccggagtgccactactcggtgcccgcaaggcgtcaccagctccagctacgtcgtaagccatctcgtcggagttgccggggacatcgccgagccgcctgagtccgtagatgacgcaacgctgccaagcgatgctcgtcatcatccgctgctcgccggagaaggttttttttttgtcattttgcctcactggagcacgccaaagggagtcgaggcagccgccagggcgctacgctgcggagccgtcccatgtcgcggatgctgactgacttgtgcatgttattgtatacggtgacgagccaacaaaacaagacatgcatgcatgctactgtacatagtgacaagcaaaaatgagtttgcagattcatactcatttggggctgctgcgtattaaacttcccagccatgaccaattcggctatcattcacgttgatcattttacttttataatctaattctgatgtaattcctacgtcgtcgggtcatccgggctacactattccatgcatgtcttcaataacaatataaaccaacatgccgtccaagaccgatgaggctaaaacggcaaggtgaaccgagtcgacatcaagacgacgtcaccaacaccgcgtgtggaccgatgaggccgcgaacaccgccagcgcccactcacacacatctgcaccaccatcaccatcatgcatgggagaacgtgaagcgaagacagacgacgacaactagcgtagcttaatcggaggtatctcacgggtttaacccgcgagagtaattaaccgagtgtctttcgagaccccgggaaccaggagatcacaatcgccaagtcagatccaccttgcttatgggccatggagcgtatttgaccaaggattctgtatttttgtaattcttcgagaattataataaaatgcatttttccttcgtccactttatttttttttacttagtacactggcacgcctacatatttttattttatttccctgtgcggagggataaaaatttaatttttttttctctccaaacaaaatggcatgcccagtgggttctgggcgtgccattttgtaatttttttctctccaaacactgcacttgatctgaatttgaaactccgctcctcggtaatatatttcatacaataggggcatattcatacatactagtatatccatccttgaaatctggaatcctaacatagctccacacaaaatgttaatagccagctatgaacatatgcagtaaaacttggggtagcagctaggaatgccattgagatagaggtgaaaagttcaaagagatgtgacaactggatgagccttccctcgtgcagtaggctctctatataagttctaataaaagtacagagaaaaaggttacataaattgcgagtaaaccaataaaataaagtatgatgatatggataaagtagaagtacactggccacctatcttacacctctattacagttctctaagccatcacataattattgtttaactcttgttcgggcattgtgccatctgcagagtggatatgcccaagtttctgggtttctaaattgtcaagcaagatattttcatacaactgtagataaattaagctgtgagtaccagttgtacatttgttaacattcaatatcagctatatttctccttcgagtgtcatatattatcattcgaaacggagaattatgaaaatcgaaaataatggcaaagttaatcactaaaagtttgtacaggcaagtaatttgaaaatgatggcaatagaaaatggtggccccagaactcgtcgtccggcaaaaaaaaattaacttgtggagctatcatgctctcggttggtctcagtaggacaaggtgactttactttctatggcaatttacttttttttttacagtgatccatgacacttttgttgagatgttacttggctctttggcatcttttaagctattggactaggagtgtgtaccggccgataattcacacaaaggttacaagatgcttccacaatgaaaaataataataactgcgtgtctatattgctagctgaaaattgctgcaaagacaatgcgagaaaacattagcatttttatgtgttacgcacattacttcagtagtcacaacaattatactttggaggcactcggagtacttaaaaaggaactgaaggatggataaatagtcagtcatatttgctgttgggcgtgttagagtatatagctgctgctgccaaatggcaatcgtgagcaaggccatccccagttgtagcctgggaatgacactgatcttaccagtctctgagaatctgacaacccagtctaagagtggaaggtgttccgaatttcaccatgtttttacccttacgatctgtgttttgttcttttgctggccttgctatccatgtaccatgtagaagactgatttgtcttggatgtttgatgtcacgcccagaaattcacgaaccagaatttctaagctgaatgtgcattaaatccctgtccaggaccagccagggtatacaaacaacaattgttgacatacagatccacgacttataaaaatataaaagattacaaatgcagcggaaaagataaaagcgagctaaaccgggatagcttgacttcagcagcggggcgactccactccacaggcaatccttgacggcagcgacgaaaccaacttcgacaaaacagctcccactaggaagatcttcagctctggtgtggagaaaaagagagcaagactgggtactacccattgtactcagcaagtcataccggaagaggaggtatgatgcaggatataaccaaaggaggctaaaggttcttttgcataaagctagcatttaaaagcagaagttgaaagcagtaaaacagttgtagtaattaatcaatattaaccaatcactgtccaacgctacaccacgttgcaacaggctcaaccaaccacctgaactacaccagttcattaaggttaactagggtgagactaatcacggtgaatctggttgatcgcccataactgcgggcacagctattcgaatagttttactctggccagaggtgtacaactgtacccacaagacacaattccacaaatgtcgccatgccccgaagtatcaccatgatactgcaaagggggaaatcgtgacaagaccctccgcataaccctcccctaacatccacaccacgctaaggtttcacccccacccctcaaaaggcaatgggcggtcccctcttgcgccgtggtgaatccggcagctggacaaccggacaccccggccgacccaactccatcacgcccaccctcaccaccggtgcctaggaaagggtccagctatacttcagatcaagcagttacccactcccgcttatggtaagcacggtaagtctcccagggtttcccgtgaaccggtccttaattgccatgggtgtgaccagcaaaaccatgcacccacagcccaccattcagtgtattttaattaactaacaccattgcggtggcaccaatccaaagctatgctaatagccaaaatctatgtaataatgggatccccatttgtgtacttattgaactaagcatggctaagcatttcctaaaccagcatctaatcattttgataccccagttatcaatggcatatggtaaacaatatatggctgagtaataggacccatcccacatgacattgaaaaagaatgcaacatttaatagaaatgtgggatatttgtaaatagggtacaatatgatcaaatataatgcatgacttgccttgctctcgcactgataagacctcagcaaggtcttcgagaaaccgcggatcgacgaaacggccgaaatctacgcgacaaacaaggcacacaagcaaaatatgctataagactactgaaacagggaacaaaaccatttttaatggattctttgcatttttatgaatttactgagacttgaatggacttaaacggagctcggatgaatttcttatgaattttagaagataaactgtgtttttactaacaaagaaaaagtccttaattatttattgcgcaataaatccatagggctgatgtcacccaggggggcggcaccgacggccctgcttgtcagtggcacaaggggagagggagggggcattggggtggtccaccagctggtggggcccaccgagcagcggcacaaggcaggagggggagtggatggtggtttggcacggctcaagccggctgaccatggcaggccgacgacgacggcacgcggcctccgacgatgaccggcggacgacgagacggcggcgcccggagcgaagccgacggcgcacggccggaatgacggtgtggctcggcgctcgcgggaaggggaaggaaaggagggggagggaaggggtcctcaccggcgatgcgagtgaatcgggttccggcggcggcggatggcaaccgaatggtgatcgaggtgcaggcgacactggcgagcgcgacggcgacggtttcagggcgcggcggcggctttagcggtggtggcgcgcggccagagccggtagtagccgccggcgcgtgggaagaacggtacggcggtggcgaacggaaagcgagcggcggccgaggtagctctcgcggcggcgaagctagcggcggtgattgcccggtgaggtgacggctcttgcgacgacggcgtgcggccggaggcgacggcaaacggcggcgctaacggcgagcggcgcgggctcggtaggaggcacgggagggggcagtgagagcggaaaggggaagaggaggctcgggggagcaatttataggtggagggggaagcggacgtggccgggaaagcctctgatttcgccggcgacgtggggtgtagagagagagaatgggggggattcaaattcgaatcccgccccttgcgagcgcgcgcgcgggccgggagacgcgggagagagggcggcgacgtggggaggacgcgggagcggcgcggcgtaggcgcaggaggagcggaggaggtgggcgcggcggtttcggcggtggctgccgacgtggggcggtcggctggaggaaggggacgaccccgacaggtggggcccacttgtcggcgtcccggagagagagggagtgagggaggacttcggggagggtaagggaggagcgggccggcccatcaaggggcgcgcgggaggagaaaggtgggccgatgacccaagaagaggaaaaaggaggaaaaagaaaaggaaaaagaagaaaggatttttcttgagatttaaaattgcacttgctcatttttaattggttaaaattaattttaaggctctgaaaattctattaaaaatcttgttaatgtattggagcatggggaacctaagaaaaattccacaataccatttccaattattaattgcattcattagataggaaattagctctaggttaattcaaaccatttcttcgcacaatttatttaaccatttttttaaagcaaggaaaagggggaaatttccgggcgtgacatttgaccaacatcttagctggcagattgcagtctattgcaaggtcctgcgtgttagtgtgtgactgtgtgaaaatttgtaaataagaatgcaccatatagcgaaaatgttaggagcccgggtatcaaaatttacctctttgattatattccttctttattcttgcctcgtgtatctttttgtacgtaagatatgcgaggttttacagtgtttacgagctatttagagttatcgagaggtggggcaatgtggaccattgatcaagagagaaaaaaggtatgaaagaaaaaatattgtaaccaatggcagtagagtaattaactactgaaatattggcattacgttgaatcgaaatttgctcctcgctagttgcacctgatctgaattcgaaactttgctcctcgctaataaatttcatacacatattcttacatagtagtatatccatccatggaatctgaaatcctagcatagctccatgcaagatgtcaacagcctgctatgaacatatgcagtaaaaagttggggtggctgcttggaactccattgagatagaggtgaaaagttggaggagatgtgataactggatgaactttccctcgtgcagtaggctctctgtaatttctaataaaagtacagagaaaaaggtaagataaattgtgagtaaaccaataaaataaagtatgatgatacggataaagtagaagtatactggccacctctattacagttgctttaagccgtcgcataattattgttgtttaattcttgttcacgcattgtgccatctgtcaagcaagttattttcatacaactgtggatagattaaagttgttgtgagtaccagttcactacaagaatgaagaatcagtaaattttcttagcggccaaatgatttctttgacggtcaaaaaaacagccgccaaatttaaatatattcttggtggttctaactagctgccaaacatagacatttgtcaccattcaattacagctatatttctcctttgagtgccgcatattatcattcgaaacggagagttgtggaaattgaaaatattggcaaagttaatcgctaaaagtttttacaggtcaataatttgaaagtaatggcaatagaaaatggtggccctatgactcgttttctagctaaaaaaccgccacgtggagctatcatgcttgagcaatgatctctcagttggactcagtaggacaaggtggttttactttctatgacaatttacattcttttactgtgatccatcagaccatgacacatttgtttgtaaaattaaaggtgtttttgattattattctgtgatgaacaattggcattggagattattggttttgatatttggaatttatttacgaagtggttttggagaagattggatttcacaggtgatctacaggtgctgctgttttgggaccggtcagaccggacatgggttgccgatcagaccggcgcagcccgcggtctgaccggctgacgctgtgtcggtttcggtttcgcgttgtttgtttggatatccgtgattgtttcatgattatggcttctagatggatactatacgtatgtaatactgttgtttgctactaatgagtcaagttggagatagcttggtctcggaatatggttttctttgtttatttcatgtgtaggtgacttgatgcctcgggagagtatttgcggtgatggaccgggagtcggcttgggataagacgacgtccgtggtggttagagatcatgtgggatacctaggctagagttgatgcacgtggttggtgaagattccatatggcatacgatggaggtattgtgtgcgtatgggatgcggagtcgaatttggaatgagtccaaatttggtatgagtggttatgtaaagtttgtttcttgtactagagggtttcctaaggtgtttaggacttctagtatgagtttggttcgtggctttaggctgcctacctcgggtataaatagagggggagcgtgagggttcccggtatcgctttttgagagcaattgagttgagagttgagttagggtttcgagtttagtcgaaatttttgtaaggagtgctgttggtgcactttgtaaacacagagagaatcaataaagttgtcatccactttaagagttcttcgatttgtgtttcaccgggtttcgacggtctaaccggcgacacgtcggcggtcagaccggcggcatcgcggcggtcagaccggcatcggcaacaggagctgatctcggcggttagaccggaaattcaatctcggtcagaccgacggcaaccaggcggtcagactggcgcaattacttcggtcagaccgcgatccgtcgaatttgagggtaacttttatttctgctaaaaattttcggtttttgggtataccaaccattcacccccctctggttggcttagttagttgttgtgattcgatagtacattgttgagatgttacttggctctttggcatcttcttagctattggactggtgtgtgtaccgacaattcacacaatggttacaagatgttttcacaatgagaaataataataactgatatcctgtgcaaaacccaggacagtatctgcacatccatattgctacctgaaaattgccgcaaagacaatgcgagaagtacttgaaaaggaactaaaggatgcataaatagtcggtcatatttgctgctgggattgctgagtacatagcagcagctgccaaatggtaatcgtgagcaaggccattcacagttgtaggcttgtagcctggggaatgacactgatcttaccagtctctgagaatctgacaacccggtctaagagtgggaggtgttcggaatttcaccatgtttttacccttacgatttgtgttttgttcttttgctgaccttgctatccatgtatcatgtagaagacagactgatctaaattgttttaccaccatcttaggtggcagattgcagtctattgcaaggtgctgaatgtttctgtgatggtgatgggacaaatggcatgagtgtgtgactgcgtcacagagctgaaaaattgtaaataagaatacaccatttagcgaaaatgtcaggagcctgggtatcaaaattaagcttattgatttcattgcagaaatctatatttcttctttattcgtgcctcttgtatctttgtgtcccattgttgatcgcgtacagatcattttgtaccaaatataagagaggttgcaatggaccattaatcaagagaggggtaagctatggaataaaagatattgtaacaaatggcagtagagtaattaactagctagtgaaatattcggattatcgttgactcaaatacttaaaatgtaaatcttctgaggtattgatttaggcatcgattagatctacacgggaaaaaagatcaggttgtgtcttctttctcttcttccacatcgcttcattctcgttctagggtatgaattgcggttcaccaggaaaaaaaagagggagaagcgttggaatggttgagaattgaacaggagatgagatcagctcgacaatggcaaggggaagcgcatcggccaaacatgaggtaaatcaggaagattattaattttggatcaatattaaaatctaggtgcatgtattatagaataagttatttaattcctaaaacatgtaatttttttgttaattaatgaattctacaaagcatgtaaatcacttaatggaggttcactgagcgaacatgtacttaagaagaaaaatgtaaatgataaaaaataacacgtagaaaataaggtactgatgtggtacctacgtacttatcggcgggccaattccctacatgcccatgtgatttcacccaattccttctacgcctctaaaatttgtttgatctcttatatatcgctgagtttttatttggatcccttacatacccatttcgttagttgaccattagtttgaccattagttattgtagaaattattttattgtccttggtatattgttaaaagctagaaatgttttatgtgtaaattatttgagttgtgaaaaccaataaggaataaattaataaatatttgttatgaatatttaaaaataaaacattatttcattaaaataaaaaagatttattgtaaaaaaagttctgcataaaatttgaaaattacttttcaacaaatatttagtgaaaaaagattcgttgtgaaaaaacaaaggggatgtaattagtttatcacaaattagaaaataaatttaaaaatttttaaataaatttcagatcaaatttgatgaatttcgtatatcttcccaaaaatttaaacctaaataacatttagtttttgctcttaattttctggtgaaactaatgtatggatttaatcataatttttaaaaaataaaaaataataagttttattttttaagttgagcattaaatgattatattgcttgtattttgtataagttaatttttttgatatgaaaatttattgggtaggtaccacatatcgcaggagggccggccgtctgcctgtaagcaaacgactatgaagattgccgatcttcgtaggcaggacggccgtccgcttgcgaagacaattttcgcaggcggacgttagctagtcaggtccgtctgtgaaaataggaagtggccgcctgcaaaaaaaaaacttccgcctgcaaagataggtagaaaattttaaattttgatacaataataatttgcccaaaaattactttttaattatttaatagaaattgatgcaggaagattattagtaattatcaaacatatggtacttagaaatctacatatattgcataagtgaaaagtgttgtcaaaatatatatattacaatatttttttacattgtcacttaaaatacgccatctagttacattatggcatagcagtgttccactcctgaagttcttgaattcgtcacttgtagctcgggcaccctctgggttgaagaattctcctcgcacatgacagcactcacggtggatgaagtggcacagatcgcgctggacatttgtgatgcctgtatcgtcaaagcttgttcgaagttctattcttggcaactgcatgcattgaagaaaaataatatattagtattataaatatgtgaagctgtctagtccatagtctagagatttacatcctctgcgttaaccctgtacctcccattaaccctgaggaattcgcacgcataatacctgcagaggacaatgcctctaggttgcttgtgatacttcacgacatatcatagaagaaaatagttaaattttgcaattagtgaaataattggaatacattaagtgagtgaagtcttaccggctaatatgtatgtactagcagcttctcccttgtttgggtctgttctccaccctagaacttgtagtagttgtatgcactgtatggatgtcgtaccatttcgcattaaggaggatatttaattataatacattcatataaaaaatgcaagagtccgaatcacttattactgtaagattattagaaattctttgtataagtggtgactgtaatcgagactggtcctggactccgagttacactcgaagtcaacttggtttcttttctttcgcccaagctagtatctctgcaaacgaatacacacaaaactcattgtgtagcaacgtttattcgaatatataacaagtaaatctaatgtagaacatatgcacctttggtggaataatatataaggtagtcatggttatatccgagcgagttgtgtcctcatcagctagccaactgatgaaccgcaaaaacaatatcaagtcttgtgcaattggctaaatacattagtgctccaatggcatttaagtagggaattttgggtcccattatttcctcattatcttccttgggttttaatgtgtccttataagcttctatggatcgaactaccatgggggttttcaaaggatggcatttgttcatattgaagttaccaaggactgtctttgtgtagggagatcggtgcataaatactcctccatggaggtgctcgagttgctggcccaagcaaaacttggttttccccaagtccttcaatcaagctcgatattaagacaagccattgcttatttaggagagaatctattctatactgctgagtttgttcgagttcagcgatttgccatcgacattgtcttttatttaatgtcctctatggtggcaatgatatttagatcatagacatagaccgagatgatatacaaaatccattcagggatttctttgaaaacacatgtggacaatcataattgtttgaataacctctcttctagagatatctacttaactctttgaaccacaaccttccggattgtttcaatccataccatgatcgctgcatgtgcacactatacatgttgcagtttccttttgaatttgtgatcttgtgtcctttagggactctcatataaaattccaaatctaacgacccataaaagtatgccgtcaatacatccatcaactgcatgcatgggtccacatccttcatgaacagaacatatggaggtgattaattctcattgttctaagctaaaaaaaagtagagaagagatgggatcacatagctaatttttgggaggcctgcatgccgtaggctagcgaaacaaccaggaccacccaattagcatctatttatagcaactgtataagagcccctcgacgaaaaagtctaccaacgatctccatgctgcaccgtgcatctatgcctagttttcttaccctccctccaccataaatacgcacccatctgcaacatagatcaccaaacatatcgaccaatccctcttccagtcaagaaaaaaggaagattacaccaacaaacaaactagctagccaatggcctccttgtcatcttttccggctcgccgtggcggtggcggcactattggttgttggctcatgtgccactgagctcaccttcaaggtcgctaagggctctagcgccaaaagtctagagcttgtcactaatgttgccatctctaaggtggaggtcaaggagaagggcggcaaggactgggtggcgctcaaggaatcgtcgtctaacacctggacgctcaaaagtgagtcgccgctcaagggccccttctctgtccgcttccttgtcaagaatagcggctaccgtgtcgtcgacgatatcatccctgaaagctttacagctggctctgagtacaagagtggaatccaactctaagtaacagacatgtgtactcttgttgggtcacatgcgaaatatgaacatctaaataatcctctcttaaaagagatcgtgtcatgtttgagtgagcaaataattattatttttggttattttgttgtaataggccgatggcaacataaggcatacatgtgtccttccaaaatattgctgcggagctgtatgtgagcattgtttggaatatatgtcatttatataagatatatggaaaaaagtatatttggtcaactttcattaagatgattgcatctgtttgattttccaaagttttagtacatacttatgtccaaaccaatgtaatccatttcacttattttagcttgtcaaaaaatttgtaaagtcacatctacacttttttttcattttctaaaaacaaatagttgaattgactatactatgacctaaaactataagcattaagcatactggtacatcgtttaccttacgagagaatacattatataccactgtgtttgtcacaggtctatagtttgctattgactttgtcacgttctacaatatgccatcgacttttccttaacttctacgacttaccatcaccatctggttatccttcgtgagaaatgtataattttatccaatgaccaaaatacccctataacagatacttccaaaatttggaaaaaaaatttgaaatatcatattgtaaacatccaaaatttggccaaaaacttaaaatctgatattttagaatttttgtctacattttggaagtttttgtcctggaggtattttggtcattagaacaaaattgtacagtactaatggaggctaaccggacagcaatggtaaatcatagaagataagcaaaagtcgatggtatattatataatgtgacaaagtcagtggcaaatcttagacatgcaataaactcaatggcattgccggtctgattggcagagtccgagtcagactccattttcatcgggtctctggtttccttacttgggaaggcatgtttcggatttccattggtttctatcccgagttggacatggagaagggcttatagagggcaagaccaacccctatataaggaacaaggccggttcaattgttacctgacaaacacacaatcaatagaatcgttcttttactttaattttagccatgttttctactttaccctaattttagttcatctttatcgatttgcaccgtttgcccataaagaggtgccgtactcaaaaaatcaggtttgtcctaaaaaccttccgtttgcccacaagatggatagttatcctcatattgatttaaatcggcctagaggctgattttgatctctaaatcggcttcgctagccggtctagctttctttttacaaaacccatcttgatttggttgtttggctagatcggggtagttgctgactccatatccccgtaaggcatttaggtgctgcgatcgtgcttgttgacttctcacaaaaagttgccaacagtaacaacaaagataaataatgtgatggaagaggggaatgtgcagcacaccgtttcaaaattgatgattgatagttggtgacgatttcatggctacaacatctccaatgttgtactctctccatcctataatataagaaattttagagagatatgacacattttaagacaacgaatctagatgtgtcatatcccttataatataggatggagggagtataagtgaatgttatccaataaattcaaccaactttcgtaatcatacgtgtacctttttaacttttttatgcacacacgcacaaaaaaaaaagtggttacgtgtaaacaactatagacaccacgatcgatttgaactagagcagatggagtgaaggactccatatgtccaccacctacctctgaaatcgagtcaaaaagatatgcgctaattcagatatgacaacctattgtaactattaagcagagtaaataatgtattatcacctcaggatttaagcatattaaacagggcagcaaatcatcacatcatagctatgttctcaaacatctcaagattctatgaaaaatactctgttcttcctatgatatgtgtcatgcaatgcaatccatgggcttgtaaagacctttctctattatttattgcagcatatatgataataagtggtgtaaacaaacaaccaacttctccaaaagttcgagggcctttcactatatatatacatgagtttctctgcatttcaaataagctgtacaccaaggacatcgtctctctcatttaccaatatgtttagttctctagatactataactagattaagattaccggattaacttaaaaatctggtatgctgatgtcacgagagcttgcaattaagaaatacagatattaaactagtgttcgaccatagaagtacaagccattcatggactatataaataggccaaggctagtgctcagccaaaagctgaagatactttaactcgtattctaatatttatcatattgaaaacccttccaacatgcatgtgctgccttgtgtataaacatcttcagatacgtacacatgattaacttaactagtttaggcttaagaggcattgggaatccgggtgtagctactcccacatagtgcattacgtaagttgcattcttcacttgttcgcagtgagtttggtgttgtttcaggattcacgctggaccattcctattaaaaacaacaaacattcattcatattgatgtgtatatcagagttgccagagtaagtggtttggcatgcatctacaaagtattgtttacacagaaattttgcaactcctaggcaaagttctcatatccatcagactctttggtgatttccaaaaaactagaattccaagcgtgctgggggatttcgtatataccagaatttccattcttaaatcaaaccttgtagtcaatttattttattaaagcagatagcttgagatttggtcgatggataaataccacaacaggctaatctgtcagaaaaatggcactgcgagccgacatctagtatgcaaatataatgcttttttcatttaatttggcttggctagcatcatgctaattaggccagggaaacactaggagcatttcactagatcgatacgtggccggggggaagatcaaccatgaagatgaagcgaggccgaagggattgatactgaaccaaaacgaattaataccacttatttctggaaaaaaacgacttgcactttataattatctgcagtatatgtatatattctggctcttgtgctattattcaggtttgttcaacgttttggaccattgtccattagatgattggtgatggactgtttggaatctagccgattcatcaagcgcgagttcccccgcttcgcccccaaaatcaatcacagcaacgacatcatcatcgcataaacagaacaatacaaacaacacaaacaagaaatctaccggatccgtccgcgggtcgccgccgcggccgttagatccgacggagaagtcatcgccatcgccagatctgcgggagaaggttggggcgaagggggagatcactagatctgctcgccggaaacgccgtcgccgcctcctccgcaggatatgcccatgggagcaccgatgcaaccgccgctgctacggtagaagcttgggcgcggaggatgaggaggagggggtagagaaccgccagattcagtcgccgaaaacgccaccactatcgcctccgccggatctgcccgtcggaaacgccaccgccgccaactccgcaagatccgctagcgggagctaccgacgccactgccactgccttcactggatccacccatcggatatgccaccgccaccgatggatctgcgggagggggctgaggaacgccgaatctggcccgcaggagctgctgacaccattaccaccacgaggggaggaaaggggtgactgagtgagagggggagagagacgggtgagagtagggcagcgaatgataaggtcgccccccgtcacctcccacgcgtgcctttatccactcgcgtgcggctctctcttggctcggctcgtttgataggtgcgttttttttaaataccggcaccgataatatattatagctggcggtttttaatatattataattgtcggtttttttaaaaaaaatagcacgtatagtataggtattggtttttctattaaaccggcacctatattcacttaaaggtgatggattttttttttgtattttcagcctgtggaggtgggcaaaatactataggtgctagttttagctgttccggtgcctatagtgccaatatgtatgtgcttttttatactagtgatgctgagggtttcataccagaacttccattctaaaatcaatccttccagtcaatttattttattaaagcagacagcttgaggtttggggcaaggataaataccacaccaggctaannnnnnnnnnnnnnnnnnnnntgaacctacatctatatagtatgctaatataatgcttttctctttggcatagctagcatcatgttaattaggcctggaaagcaccaggacgttcacttgcaccatggaaagaagtcaacagccttcactgtatggttatgccgattcggttttttttacgtgtctacttggtgggtaaggatcgatagggtgctccggagaggaagcattccacgaagatgctagatgaatgctccggttaaattgctggatgaggatatccatctttgctaatctctatcattagtaattatttgcaataattaatatattttgttgttaattggtaattaacttgtcaaaaatagtattgataagatataattagtctattttgttgttaattagtataaactatgactatattaatgataattaatatattttattattaattaatatgttcaatccattcttatccacccaatcaaacaagaaattggatcatcatatctattagaaaaaaactgaccatatctgtgtaaatatggatgaccaaacgtggccggggaagatcaacgatgaagatgatgtgaggccgaagggattgatgctgaaccaaaacgaacccacttatctcaggaaaaaacggcttgcactagataattatctgtagactatgtatatattccgactgctgcttgtgttggtatgccggtttgttcaacgtttacagattaattattgtttcgtaccattgtccattagatgattggtgatggaatgtttggtacgtataaacttttataccttcaaatatatttttgacaaacagctaacttcaaatatttaaccaatgttttatgaatgaggcatcccaattattttttagataatggaaatggattatatctccggcttcggtcataacacacaaagtcataagtttaatacaaaaggtaaagataaaaataaatcaaaatgagaaataagatgatgggacaattccccaacccctttattattaactagcgttaaaccacacagatttctagctagcaattctaatggaactacgccacccatagtgaaataagagacccttggctactgattgcaaaaatatagcaccattacgcgtggtatcatgttcctcttgtggtagcatcgtagaccaaaaatggatccaattggaagacatgaagataatctacatagggttagacaattatttagcattaaaaactttatcattacgacaactcataattggccaacttacaacactagctccgattagaatcaattttttaatggacctaggtacccctttaagccaattaccaaaaaatatttttgacgttaccgggtgaagggatattaaaaacaaaaaatacacatatgtaacaaactgagcaacttgatacttgtcaacggtggatacccgtagactggataaattgagtattggagacaagaaacaaggattatactggttcaggcccctcgtgatgtaatagccctaatccagtttatacgagattaatatagaaaaccacatagtacaaagggtatagatgaatccaatgataccgacgagatccttgttgagattgatcaacgtgatctcccggcgacttcgccttgagttctttggcttcgtaaactatggtgggtgtgttggcgttatgatttgatgatcccgagcccttccgggagtgtgccttttataccataagttgccttagtctccaagtagaactcggagacaatgaaccctgcacgatatagaataatctctatcctctcctagtaggactctgataatctacatgctgtgaggatattttccataataccttgcatatttctttatcgcatagggaaacatatcgtaggatatgagatatgccaatccggcatatttggtaaattgtaggataggaggtatgtcttatccgtaaccctgaaaatactcaaagaaaagatgttggattatctcttgtggataacagaaagaacaatgtttcttcctccccccccacccttttcttatggccaggttttatttcgttagaattactttcttatgaaaaaaccacatacacacctttatctttagtggaacctttaagtctcatataattccttttatccaaacattagagttcataatcatatagatttgactgaaaattggccattcttatggagcgaccatacgaaacagtccttttcatttttgtttgacggagtcatacaaattagctagcctgaggatcccaattacttaatccacaattttcttagagattaacacaaatgtaaaatggcctatattacatatagtacgtagggcatgttcactttgatgacattttcaaccttaccaaattttggtaaagttgccaaaaaagtggctacatttagtttgttgccaaaatttggtaactatataagaaatcctaccaaaatttttggcaagttgtcaaaattttggtaatgccaaaatttagtaaggtttttttagcatcaaagtgaacagacccgtaatgactatgagatatcaatatatatacatatatatatatatatgtatatatatatatatatatgtatatgtatatatatataggagttggataatatgaacctaggtgcatctgcacctcaatcccacatgtgacacgtgtctatttttcgttgtagctgatcatcattttcaccaaagctcctacaacttgtacctacccagcccaaactcttatagggaaaattttaggcaggtacacaatgatgctgtagtcatgcatttctcacccacccatgtactagtactagtctgcaactgtattcatgtcttttcactaatgtgaccgtgagagagaatgagagagagagagagagagatgaacatgtagttttaatagatctcttggctacaatcacattactccatgtgattagccatcaaatatacgttgatttttttaattaatctgaccaccttgttttgtatgtccggaaattaatctatatctggttttattcggacatgatatatcaagatgaatgtccaatcaccaaacaaatacaatatatccgatgtccaagaatgacattgtgaaaataatatatcatttggcataaattaaaataaaaaatacatgatttttatttttacagatatatgctacataacaaagtataatttcattaattgacaaagaaaataatatacactgcaatttgttgacaccgaaaatgaaatacaacgaaaatatcattttgaaaagtcatgtctaaaaaaaagatgtcgcaaaatgataacatataacttgacatgtattgaaattaaaaaaaaaatcacatgcgtgttatttccaaaatggtcatgtgtactaaatttccatggataacaagagaaaagaaacaatattcaaatgatgagtaaatactacatgatgtgtggtcaactacctctcatctgttctttctctctctttgctcaggaagtacatgtcccatgtcagagcaacacatgcattacgtacctccctgacattttctcgtgtagacaatcttcattagtgaaaggtccatttagaaagcacgcatcttggaacgattgaatggttgtgattctgggtgcagatgaacctcggttcatatctgcttttatatatatatataaactgtgcaaacgaatagaaaacttctaacaaatctcgatggccttgctagctaggtgaatcatcatatacttccatctttttttttcctttgacaatttacagcttactagcttacaggattgggaaatctctggaattttcatatagctgcacaaattgtggcacagagctgcattcacagttctagaagcaaatcatcatagtcaatatgcaagagtggccgattagcagttactccgacagttggaagtagggtactagtacattctggtttttgagcaaacagttctaattggccattggtcagttctttttttgttcatgttgttactgtagctagaaatccaaaacgccaccaaaatggatatataccaaaaaaaatgtgcaattcttaagttgcagtcaccactgaatctgaagtcaactaaacttcatacactaggctcatattcttgctaatatacttcatacaaaataggggcacattcttacataggagtagccatttttaattcaactaggaagatagcccgtgtattcacgcgggcatgtgtcgtacattatgtttgaacatctacaatatatgatttctccataaattgttttcattagcattgctttcataattgtctaacctagttattagttatctttatagcatatcatatttaattaattcctacaagcaattatttataatattcttcatcatctactaagtaggtagacatattttgtgttagaaaacatgtatagaaaattaagtgtaaaatgaaaagtaagatgttttttaattgaatataggttgtcattgtttattgacggatgaattgggtgggatatgaggctctactaaatgcatgggtttatattattgtttaatttgagaaagaacccatatgtgaacattccatgtagagagtgtgtgagactccatgcaacctagcgcaaataatattggatgaagaaatatggttgtgcaatatattattttgatagatgatgtattatgaatacacgcttgtcttttaagatgagatagaactaatggttggaaataatgggcttatcggtttaaaaggcctaggaggatttatggggtaataggtggcgactttatataaaaaagaaaccattatctaaaattgattagatgatatataaaataaaattatcagtgtagcttaaaattatgctctttttaatatttgtttctctctatagttttgtagctgaaaatagggaggagactggagagaaacgaatagcgtagaactcaaatcagatatgagaaagggttcgcagtgcaatggtgttatgtgaatatgattggagagggaggtggatggtacattgtttttttttaataaaaaatcttcgtaaacaatctaagtgagaacctatgatttgttgttttctcattataaggatctttaagacatgacatgtggtggcttaagtttttttataaagagaaaggcaatctaatagttaaaaataatgggtcatcaaattaagtggaaaccgatggatagatatatactttattttctcttggaatttcaattttttcaaagttttaaaatatcatacatggtgacttgagagtgctacagagcacgcttaatcgatctttactatgtaaaacgattcaagaatatataatatacgttttcatgtttttcaatgtttcgttgttatttggtaaggagattttatttttattgaggtatatttaatgccttcatcagtttgaaatatttatgtctttaaatccaattgttaaattataactcgactgatttaaatgaaaattgatgaaattataagtctgccaatttaattgaaaattgatggttagatttgttttcttcggatcgccggccgagtctcccccaggcccacggctcggaccgggccccctggagccaccacccctgccggagccgccggtccgactgccgcccgtggtggcgccgctgctacccgtgccgtcgccaccgccaccaccggaggcgcctcggcgggaccgacccctacagcaccgacggccgacatcacagccaggatattctcccggtcgcggtcgctgcagagggggaggatcccgtccggaatcagcatttgctcgacggtgtccaggcccagcaccgccgaaccaccgtctttgcgtcctcctcgccccaatcccagcgctcacctacgtgggtgcacatgggatcgttatacctggtgtactcccacgcgccgcgggactgctcctggagaggcgtgatgcgacggcggaagtagtcgccgaacaccatcgccgccgttaagccctagcttcccaggcccttgaggcggtcccgcaccgcgtcgtactcctcgcccagctctgaaactgccaaccacgcggcagatcgttcgggagggccggtagggagccgaagtcgcggacgatccggcagcgcagtgtagaaccaatccttcttccaatcctcccacttcttgcggaggtcactatcgatgtactgccccgccacgcctggccggggctggaagtagcatcctccccctaccgcgccttgcagcagctgtgggacgaggaaggactggaacagccgcattgtcggccgcaccccgacgaacatcttgcacaagtgcgcgaagatggccagcgtcatcatagcattgggggcgagatgcaaggcatgaatttcgtagaaatccaagacctcgtggaagaacctggagaatggcaggatcaaccccaccatggtgaaggataggaggtgcacggatcgctctgggtaccgtggctgcggccgcgtctcccctaccctcacggcggcatcctctggaatgatcttgcggatgaggctaaggtgcctctccgccgtaatgcgcgatgccgggaggacggcgtcgccagcatcttgggccatgatggccagcgggaaacggcgaggagtttggcgtacggaataggatggagggagagaagcactagggcttgaggggcgagtatgcgggtgtgcagtcggcgagaggaaggagacgaactctccgcctcccttcccttttatccccacctcggccgcgctcgcctcctcgtttcacgcccctgcggttgccccatcgattcctgcgcctacggttgcctccttgattctcgcgtccactcatcacgtcgccccactgaacccgcgccccgcggttagtgcgcttgtcagtggcgcactcggcgcgggacatgcggtgttcacgagcacggctaggcgggcccgccgtcggtcccttcgcgtgcctagcaggcgggggagttgaggcggcgttgggtgacgattctgggtgtgatctggcagaccccccgacttttgcgccctaagtgccccagtgaacggcgcacttagtggcggtcaaatcgccattatggctgatgcgccagcctggccacccgacggcggctgcctagtttccccgccggacccacaaccacagcacgggaactcatgaggaaccacgccagaccgccctcagggggccaatgtccgacgcggtgccgggggctactgtcggtgatatgggcccgggggtatgcaaagtacgggggagttaccttcaaatgcagccacgtggccctacaacttggccctccccccacacctcggaagacgcaaaagcagccagggggcctcggggtgccacgtcacgcccctcgggccctcgcgctgccacgccccgaggccctcgcccagctgccatgtggcgaggggagcgcgcggggaggagactcaggctgaacccccatcaatgcgcggcgccccaaccgtttgtcaccgcatttaatgcggtaagggcggacgtgcggtgcggcctgattgacctacgtcaatcaggcatgaccagactgtgaccagcccgtcgccggtcacgtccggtcggacgggcagccgtgtccccacgttcgcccctgtacccggcggagtggaggcaggtatgccccgtcccatcaaggcatcatccggagctccctccacgtgagaaggaccgtcacaagtcttcgttcatttaagagggaatgacagagctgtcctccgtgtcaggcgggaggtggcgctgggtcccactcgaggacggacggccgcttagcttctgggcgaaggcacagatcgtggtccggtctgagtagagtgggtccccctcccgtgatagagtaggtagaagcggtgcatgtagtatccccttgaactataaaaggaggaccttgcccaccgagaaaaagggacgactcctagtaggcctaaaccctaggagaagaagagcgagagtgctctccagagtttaggaacctttgtaacactcaaccataaatcccatccataggagtagggtattacgctccatagcggcccgaacctgtataatcttgacaccgtgcacgatctcgaagcactcagggcagataaacgatttcgtcaagcgtgccttttcccccggccaaactcacaaaagggggatctcactgtcacccgctagagaggatcattcctcgacagcactagacctctactcctccctgagcatagtcccggtcctcactattgaccaaggctgacctcaagtcacctgcacacaatcagacaaaacaaccgttcctgggcacagatatcacaacctgacccacattagtcacacgcactcacaccaacattcacataaattctcaaaccaattcattgattaaatcatctgcacagccaattgttcatcacaaatatattaatcatgacaatgatttcattaatcaatcatccccgaattgcctccaaatacacaaatcgatcatatcaaatacatcacaaaatcttaaaaaaattacatcacaacttctacaaaattcatcacaaatccacatcgcatacaaatcaaatacatcacacaacaatctcagatccaatcaaatacatcacacaacaatatcagattctcccaaaaaaaaaaccgccaaagtaggcgccgcctcgccgcgcgccgcgccgctgccgcgctggccggccctccacgccccgctgccctcgcgccggcctggcatcctcgccctgccgcttcactccggcctggcatcctcgccccaccactgcagtagagaggagaaggagaggagaaggagaggaatagataaggagaggaacagataaggttgaggagaggaggagagaggagttaaaggagaggaggagatacctcgatctgatcggcacgcctctccgatctccgcgttgatcttttttcccggttggtaacaccaaccgggactacaaatagatttttagtcccggttaccaaccgggagtaaagcgtatggcgatcttttttcccggttggtgttatcaaccgggactacaaatagatctttagtcccggttggtaacaccaaccggtacttaaagattggaaagtacccctggagtttttaaaccgggactaaagatatttatagtcccaatttttaatacaaccgagactattgtgaaatctggtcgaccgaccaaagatggtttctccaccagtgtcaagcacaccctccaaatctccatcagcgcttgcccaaggacatcctctcacctgtagctctcatgttgcatgactgtaacaacatgtgcacctgccaattaaaattaaattgaatttaaagtgcactcttgtttgaagcacgatctacaccgacttgtaggattatttctcccaaggccatgtgctcctttccacctatgcctcatcaattcgccatctcttattcctgtcaaatttatttcatcgactgccaccaccgttcgatatccagctaggggcgcactaccataataattagcatcagcaccatctagccatgtatgcaaacccatgtcccagatatagagccacaacggggcagcacctgggaccctccatcaccgccatggtgccatcaacattgaactgttgattgcccctctgccaagaatactatatatgcatgccacacggtgcccctcagtgccttgctcatcattcctaaccattttctcggccacccatctatcttccactggcatatccacccccctcccaatttgatcatgcatgggtccacatgctcaatgaacggatcatgaggaggtgactaattctcattatctataagttaaaatggctgctttttgggaggcctgcatgccctacgctagcgaaacaaccgggactaccaaccttgcatctatttaaagcaattgtataagagtccttcaacgaaaatggctgccaacgatctccatgctgcaccacacattttcttaccaccccctcccccctccaccataaatatgcacccagctgcaacatggatcaccgaacacatcgatccatccctctaccaagcaagaaacaagaaacattacaccaaaaaactagctagctagccaatggcctccatgtcctccttccgacttgccgtggcggtggctgcactattggtcattggctcacatgccacagagctcaccttcaaggttgctgagggctctagcgccactagtctagagctcgtcaccaacgtcgccatctctgaggtggaggtcaaggagaaaggcggcaaggactgggtggggctcaaggagtcgggctctaacacctggacactcaaaagtgatgcaccactcaagggccccttctccgttcgcttccttgtcaagaacggtggctaccgtgtcgtcgatgatgtcatccctgaaagctttactgccggctctgaatataagagtggcatccaactctaagtaacaggcgtgcatactcttgtgttgggtcatattggaattatgaacctctaaataattatgtcttaaaagagatcgctccatgttcgagcgaaccattaattaattttctattaattaattttctgtggttatttttttgtaatgggctagtggcaaaataaggcatacatgtgtactccaaaatattgctgtggagctatatgcaaagcatggttttgaatatatgttatttatataagatatatgggaaaaagtatatttggtcaactttcattaagatgattgggtgcattatttgattttccaaagttttagtacataggtatgtccaaaccaatgtgttcctttcaccattttagcgtgtcaaaaatattgtagagtgacatctatacttgtttttttttttcctttctgaaaacaaattgttgattctcagccatactatgaactgaaactataagcactagccatcaacccatactatctaattatatcatcataaatattaatactttagttgcaaatgaatatttgttttttgtaattacaatagctcttatgttaaattaaaataagattttatatgaattatatataccttgttaattagtgattcctaattaatagaatacttagtggataaaattcatgatttttaattcgttttgactatgacttccaatggcatgttttcttaatacaatgtcccaatatattattgtttgtattataaataaaacaattttagtcatttttatccctcaacattggtaaaagaaaagtaatttcactgaatttgttggaggaatcatgtattttctgaagcaacgactattaatagaaacataagttattgaactgggtgaagcatatgcaacagataatatattatagtaataggataacacacctatacttatcgtgaaaacctgacataaaggatcaaaatcaaataacatataaacattataacatatagtgagaggacaccatgcactagtaggtatgaatggattcttctaggagccaaatcaagaactcttctatactgtcctatcctaatgcatatgaaatcagttattatgattcttaacattacttgttttggcccataataaaaatatcgcttataaattttaaaataatagaaaaaactgtaggatacattagtttttcctttgatcaccattggggaattgcaataatcatctattaatttggaaaatctattattttaaacaaaaaatatataatcattctctcttccatgatctagggaaataggaacaaaaataagccatgtctcgccacataccatttggaaaataatctattagtttggaaaaatcattataaacaaaatatttataatgattctctcttgcatgcatatatgtatgtatattactcctacttcactaaagccacgcatgcatcattagtggaaaaacctgctagatgcatgcatatttattgatttttttccttgccccagaccatgcatgaccgcctttataatgcaaattttccagtgcataaactaaatactatatatacagatagtttcagaaggtctgaacattttttcgaacataaatttgaaaatttttacaaaataaaaataaggatagaaaattcataaaacatagaaaaaatacattgtaatatattatatactcccttcgtccaaaaatataatcagtcatagacttcaaattttatccacaaatactagtatgtagagagttgcgcgtttgcgcggccgtaacatccctgtatattaaatgtgttatttgttatttacagtaatcaatttaattttacaataataattaacactctagatgtaggtgtgtggaccaaaattgtcggacactgaagtgacaatattatcatgacaaccaataatttaacatgctttcatgcgaccatatcacctttgtatttatactaatattgtaaacaggtaattagagaaacatatggtacatagtttagtattattgttctaaaataaacaatgttattgttacaataaatgattacaaatgaactatctagaacatatttcataagttttagtagtgtggctggcgggatggaaggccggtcagctggcagcaaagccagagacagaaggtttggatgcagttttttttttttaattaaaagaaaaatcaacgtatctatctagactatccagttgtttctctgggccatgatttttttttatttctctaactttttttaagcatcaatttgattggatggctatgatcttttcttctactttgtccttttctgaatcaaatggttcatattatcctgatcatgtggaggatttcagtaaagttaagttttggttttaactttcacttagagagatgagcatttaagtgtacaacatccatcactcaaccacctctcacttaatatttttcgataaaccttattgctaataataaatgttcatgttcctacactgtcgatgaatgatactcgtataccggatgattagggtattagggtatgttagaatgatgatctacgtaatacgacatcaagcaaacagaagacaagaattatactggttcaggccccttatcaggtaatagtactagtccagtttatatgggattgatgattgaaaaccgcatatttcaatgggagtagaaaaattcgacgataccggcaagatcgtagttgatgtattcgacgagatctcccggtgacttggctccgtgtattccggcttcgtaaactatggtgggtgtgttagcaatgagattcgatgccttgcaccccttcccaggggtctcttttataccgtgaatcatcttgatctctatgtaagactcggaaacatcggatcccgtacgatacaatataaattttatcccctccaagtaggactttggaaatcacttaactcgtagagatattttccataatttgtaacggattcctactacatgtatagatacaccggtcagaccggcggtacagcagcggtcagaccagtggtacaactattttggagtatagactcgggaacatcagatctacaatataaactttatccccttcaagtaggactttggaaatcacttgactcgtatagataatttacatattttgtaatggattcctactatgtgtatagatacaacctgtgtacgtgaaggtataccatacacgtatattctataagtcgtaagataggaggtatatatgccttatccgtaaccataacactctcttatttaaatttgtcttatttttgcgttccttcctaatctctaaagaaacttgacatcccatatatttaaggatgtacaggtgaatataaatataagaagaataataaaagtagatcaaatatagataaaaaagttagactatgcaaattgatggaatactacttgaattgtacgaggctaccacactatggacctttctaaatgccagaaaaatttgtaaaagcaaatagatggaacacttttatgaattatgggtacgatgacaacggattggcttcttaggtgcaagcaaacttgtcgatcaattttaaatcaaacatctgaacatcaaaaaaatatatatggtaaggtgatgacgtaggttaacactcctatatattagacgtgttgtgacagatgagaaacatgcatgtaaagagaactgaactggaaattagaagttagaatcaaaccttaataattgatagaaaatagcaatagcgttcacctgtcgctgtgtgcatggccatgccgtgccctcccatgtttgccattgcgtctatctgatcagatcgatatgcagtactacattcgtctcattttaagtgtagtcatgatttttcatgcgcaacgtttgaccattcgtcatgtttgaaaatttcatgaaaaaattaaaagaataaatcatgcataaagtattatttatgtcttatcatctaataacaacaaagatactaacaataaaaattttaaataagacggataatcaaacatttgacacagaaactcacaactgcacttaaaattaaagtgcattggcggtccttaatcttgtagggttgtgtcatatagatccctaaactttcaaaatgcatatccagatcccagaacttgtcaaagtgtatcatctaggtcccaaatcgacgcatcccctctaagatcctacgtggtgctgaggacgtgacgtgtccttttctttttttttcttcttttatttttctttttcttttccgttttcttctcattcttctttttttcctttcttctgctcgggtcacaaagaaaggagaataaaggggaaaaagagaagaaaaaaagaaaaaaaaattaaatgggtcctatttatcagtaaaataatgccatgtcatgtccgtgtggcatgtcacatcaacgccacgtaggatcctaaaggggttgtggtaatttgggacgtagatgacacactatgacaagttctgagatttggatatacattttaagagtttaggaatctaaatgacacaccccaacaaatataaggactgtccgtacacattactctaaaattaaaatggaacggagagagtagtacgtgcaagctgtggaaaatcataaaaggactgttgtagagctattaattaacgtagatgtttctgtaatgtatgttcgttgtagtgcatgcttaatacgagatgttttggaaaaaaaaagagatatcagtagcatcccagtaaatatggatggccctgtataccaccaccgattttagactgcttgatcgatcggtttagaaaaaaaaaagattacgcactttcataaaaaggaaaaaaaatattgtacttaaacggatcgggtcaatgggcttggcaataggttagatggattttaaagagacccacaccacatagaatgtggattcaaatttcaacggttgacatattacaatctgtttaatcaacggttagatcacatgagaggttctaaaaaagtgtctaattaatatataggtatagataaaacatcagtacattgtatagtttattgagatgtcaaaacaaactgcagtacgactgagtggtaataggtaggatggaaatgaagccagctttgagaggagcaaaattaagcttcatatcatatagttggccaatgccccaagctacagtcaacaagaaagtttgtacccccgtcgttttttaatagatgatgccgttgactttttcacatgttggatcattcgtcttattcaaaaattttatgcaaatatataagatataaattccacttaaagtactatgagtgataaaacaactcataacaaaataaattataattacctaaattttttgaataagacgaatggtcaaacatgtgagaaaaagtcaacggcatcatctattaaaaaacaaaggtaatataatactattagaataccaatttattgcaaggatataaaataaataaaccattagttacaaactttaaatagaaatatttttgcactactagtataccgttagttccaaacatttgaacgcaaagaactagtaaatctttcacgtgaaaaaaatgtagtggtggtttacattctatagtccatcgtgtaagcacaacctcactcccacgccctctcgagcgactcctagctgcacacatgatgtctgcatgatgtcctttcccaggcgcttgcccatgaacttcctgtgacctgtagctctcatgtcgtatggatgtaacagcatgtgcatccgtgtcacgtgcaattccaaaattaatttgtgtattaaatcctcgtcaaaaatcagtcaaggtacacaaacttattatttgatcatacaatagaaaaactaaaacaataaattcttagtcctcaccatgacaaaaaggtaacaaaaaggaaaaactaacaaagctttaaatccactccgacaggtagctcaactgaggcatactcctttttcaactgagattgatgattattgcaaggtgggtatataacgtagtccataggccacacaacaaattaacgaatgatctaacagagccatcataaagtcatagctagtgaattcataaccccgggaaacaaggaataaggttaccagtgcaaattggtcataacaaaggaataggtgcacaccacaaataaatacatgtttgaaataaataaagaatttaaatataggatcaacctgctcaaagggaagtttgagatatgtccgacttgccatgcaaacaaatgacttcaattcgtattctgaaacacttccgacaaacttgtgatcctccgaaatgatagaactacactatagcatgcaaaacaaagaaaaagactaataagaaaaaaagctatagcgtacaagagttttcaaggtaatttttttgtgaaaatctttaaagtcgttgttcgtccttcttttgaattggagcctcccaatccatttatttattttattcattgagtttcacccccccccccataatctgatccattttcccttcgaaaccaaaattccaaatttcaagaattctccaaacgatctctgtgaaaatcattccatcaattcatgtctataaactcatatggaagttctattcaaaatcacataaaaattgaatgaccactatatctctccctgggccaaaatcaaccacaatccaacccgtcaccctctgtgtcacttcctccaccatctccctagctctgtcctgcacctttccagcccactgccactgcaccccaacaaaggcagctgccccaaccgagtttattacgtgtgccacacaatgcccctaggtgccttgccatcgctcctcccgaccattcgctcgaccacccctctatcttccactagcatatccccccggcccctaatttgtttgtgtatgggtccatatcctcaatgaacggaacatgaggaggtgactaattctcataattattaataagttaaaaaattacgtggagaagagatgggaccgcatagatgtcgtacgctagcgaaacaaccaggaccgtcaaacttgcatctacttaaagcaatagtatgagtccctcgatgaaaatgcctaccaaagatctccatgctgcaccgcacatccatgctaggttttcataccggtccataaacactcctttagggagatgcttgagcaataggcccaagcagaactaggctttccccaagtccttcatctcaagctcaatattaagataagccattgcttgtttaatgtcctgtgtggtgccaaggatatttagataattgacatagaccgagatgatacaaaatgcattcagggatttctttataaacacagggggacaatcataattgtttgggaaacctctctttaggagatatctatttaattgattgaatcacatccttccggattgttttgatccgtacattgatcgctgcaggcgaacaatatagatgttgcaatttcctttcggatttgggatcttgagtccttcagggactctcagataaagttccaaatctaatgccccatacaagtatgcggtcaatagatccatcaaccgcatgtgtcggttcacatgctccatgaacagatcatgaggaggtgattaattatcattattctaagttttaaaaaaaataagtagagaagaaatgggaccacatagctgatttttgggaggcctgcatgccctaggctagcgaaacaaccgggaccacccaactagcatctgtttatagcaattgtataagaacccctcaatgaaaaagtctaccaacgatctccacgctgcaccgtgcatctatgcctagtttgcttaccctccctccaccataaatacgcacccaactgtaacatgtatcaccaaacatatcgatccatccctctaccagtcaagaaacaaggaagattacaccaacaaataaactagctagccaatggcctcgttgtcctctttccggcttgccgtggcggtggcagcactgttggttgttggctcatgtgccactgagctcaccttcaaggtcgctgagggctctagcgccagtagtctagagcttgtcaccaacgtcgccatctctgaggtggagatcaaggagaagggtggcaaggactgggtggcgctcaaggagtcatcatctaacacctggacgatcaaaagtgaggcgccgctcaagggccccttctctgtccgcttccttgtcaagaatggcggctaccgcgtcgtcgatgatgtcatccccgaaagcttcactgctggctctgaatataagagtggcatccaactctaagtaagaggcatgcatactcttgtgttgggtcacatgagaattatgaacctctaaataattatctcttaaaagagatcacgccacgtttgagcgagcgaataattaattttctgtggttagttttttgtaataggctggtgttaaaataaggcatacatgtgtactccaaaatattgttgtggagctatatgcgagcatggttttgaatatatgttatttatataagatactaggtgattccccgcgctttgctgccgaaatttctaagtaacttttaatattttttttaataatcgatctaaaagtaaaatttatattagttattagcaacaaataaaaatggtttgtcaaactatgttcagagagaaatatgatatgtatgagattgtagatgaaatatgatatcccacactttgattatatgaatgaatataaatgttaaaaatattgtgaaaaataatgtgaaggaagatgattggatgttgatttgtataattcaataaattatagatgatgttgcatgcttgcataagttttgcatgtatttattgctagtggatgatgaggtggcatgtttgcatgttgagctttagggttagtgggtcataactttatagtaagataggatatgggaaaaagtatatttcatcaactttcatcaagatgattgggtgcatttgattttccaaagttttagtatatacgtatgtcctaaccaatgtagctcatttcacctttttagcatgtaaaaaatattgtaaagtcacacctacacgtgtattttttttcttttctgaaaacagattgttgtatcaaccatactatgacctgaaactataagcataaagcatcggtacatcgtttagtatattcagatatcagaacaaactgcaagtcacattaatctcacatatccaacacgaatgagtgataatcggagtagaatggaaatgaggtcagctttgagaggagcaaaattaagcttcatatcatatagttgggccaggcccagagctatactcaacaacaaagtttatatactactatgagaataccaatctattggaaagaatctaaaataaatatgccattagttccaaactttaaatcatttttttttacattaccagtgtgttacaaaggatctaaaaaacataccgtttaattccaaacattcaacataaagaacaaataaatctttcactcctaaaaaatgtagtggtggtttatgatctgtcctccatcatgtatgcctaacctcacgcccatgccctctcgagcaactcccgcacgcatgatgtccctttaccctatgccaatggaaacagacccccaacccccaccaccagatcaaattatacttcctacgtgcttgaccatggacctccactcacctgtaggctgtagctctcatgctgcatggatgtaacaacatgtgcatcccgaactaacttgtgcattaaatcgtcgtctaggaaagtaggaattagctgaggtatacaaactgacaatttaactatatagtaccaagaaaactaaagcaattaatacttacaaaagaggctattagtcctcaccacgaagacaattgcagcgaaaaaagaaaaaactactgaagctttgtttaggtgatgattggattcactattattttatgttttgattattattctgtgatgaacaattggcatatgtgattattggttttgatatttggagattatcgtcgaagtggttttggagataatcaatttttaggtgatgattggattcactattattttatgtgaccggtccgaccgggctgtgtatgccggtcagaccggcggtgatcgagcagtcagaccggacggcccgcggtctgaccggccgacagtgtatcggtttcggtttcgggttgttccataggatatccgtgattgtttcatagctatggcttttagatggatactataaatatgtaatactggtgtttgctaacaatgagtcgagttggggatagtttggtctcggaatatggtttttttgtttgtttcatgtgtaggtgactcgatgcctcgggagagtatttgcagtgatggactgggagtcggcttggtggtaagacgatgtccgtggtggtcagatatcatgcgggatactaaggctagagttgatgcacgtggttagtgaagattccatatggcatatgatggaggtattatgtgcatatgggatgcggagtcgaatttggaaggagtccaaatttgatacaattggttatgttaagtttgtgtcttgtactagagggtttcctgaggtgtttaggactcttagtatgagtttggttcgtggctttaggctgcctacctcatgtataaatagagggggagcgtgaggcttcccggtatcgtttttgtatcgcttttaagagcaattgagttgatagtttagttagggtttcgagtttagtagagatttttgtaaggagtgttgttgttgcactttgtaaacacagagagaagcaataaagttgtcatctactttaagagttcttcgatttgtgtttcaccgggtttcgacggtctaaccggcgactcactggcggtcagaccggcgaagcaccgacggttagaccggctagggcgaggcggtcagactggcggcgacatcaggcgcggcagggattccagggcggtccaaccggaagatcaataccggtcagaccggcggctacgcttcggtcagaccgacagatcaatctcggtcagaccgatctccatcgatttcgagggtaacttttatttctgctaaaagttttcggtttttgggtataccaatcattcacccccccccctctagttggcttagttcttgtgattcgatcctacaacatcgaacgtttaaactcctgcatgaagtattaaatataggctaaaaaaataactaattgcacagattgcgactactttgcgagacaaatcttttaagcctaattgctccatgatttgacaatgtagtgctgcagtaaatatgtgctaatataatgatggattaattaggctcaataaattcgtctcatgatttactgacggatagtgtaattagtttttttattactgtgcgaacaccccatgcgacaccctgtataatatccgatgtgacacgctaaaactttacacacctggatctaaacaccccctaagtagagaatcgcttagttatttttatgcatttactatttacaaaattatttggcatatccgtgaatagtgtggatgactgacaaacctgacacacagccggataagctgcccaattgaggagcttctgtaccatagaaaaatacatgtcaccaattgcgacgagccaaaaaaattcaaaaaaccgaggaaaacgtgaacaaatttattgcccaagttgggtgaaaagttttatatgagaaggtcaacaaatttgttgcccaaattctaatgcctgctgttaatataaaatttaattcactgctaatttttttgtcacgaatttcatagtcaaaatagataggaaaaacaaaaagaaaatagaataaaagagaccaggagcccgtttgtgtgttaggaatttccagtaattcattaactcatgcatatataacactaccacaatagctatcctgcttcagttttgctggtaggaagaaaatggaaatattccaaaacactagaggggcagtgtattcgcgtcagattttcaaggtttggaatgcgaagctttggggattctagaatgtaaagaaagcacaaagagtcttggatatttaagaccttgcaactatttaagaccatgttggggttcctagaatgaagagattaaatgggatcgagaggattagttccaaacctcaataggtatggaatacttttcctccaaattaataacctttaatcccagggtgacatgaacgtagtaacaatgcaaaccattgtccaaatcatacagacatgaacataggtgacaatgcaaaccattgtccaaatcatacagatgtcaaaagacaggtagcaactcgttcagtcttcataatcttcgaagaacaaacagtagcaccatacagtgagaaatatcagatttgctctgcagcatcagttggatggaaataaccacactggaaaaatcaatgatttcctcaggaacgccaatgttgcaaggtaacaatttgagagcaaagggcttcatcataccatttcttgtgttgtagagtacaaatctatcatgccacaccacgatgttgcaacttactgaaccacttacaataatactaagcagaatgggatgagggcaacaacgacgatttggttcatcctcatctctcatatcttcatgaacaatatcaaatgtgaacctacacatacaagattggcatttgacaaaaaaaaatacagatgcaatctacaaactacaattgattaatgaacaaaaatggtaggaatgcaacatatcatttgctctagtttgagataacggaggtaaactttttcactctattattcagttctaggaaatattacaaaatatcatcttcagtgattgccaaaacatctctctcaatatgattcaacctatcattccccatcttatttctcaactcagtctattgacaattttctagctgaaaaggctcttttaaccttgtcagttacaacacagcaggaggtcacctccaccaagtgtccaaactccaaacaatgtttggttgtcacataggagtttcaatgtgtgaaactcaaattgaagcgagctttcagtggtcatgttctctgcaagcaaaacttatctcaaagaagggatgtaataatatttatgaatgcgattaatggtatttgtcctcttgttttatttctcttatagttgctaaaagagttaaatgttgaagtagaaccttccatattaatatttttcggaaagaaagaaaaatctgagaattgtgacaagagcatagcagattatacatgttatagtcatgaccaaagagtctaatgacaagtaagctctgtcttgataagagcaactagcggcacaaaacaaccagttagatcagttttgctgtgcagcatcattcggtaggaagtaaccacaccgggaaatcacgactcaactggtccacatcaaattcggaagctaatagtttgacggcaaaggacctcatcttaccatctctcatgctatacacaaatgtatcataaggcttccaatcatcagggacaaagtagatatggtcaccttcaactccatgatgtagaccagcaggaaaggacttgcagccacctaagccaacaaagatacagtcaccattcaagctgtgaatctcagttagtccataagggtttgtgtcaacatccagtgcaaacacttcatttatgaagttgtctcttacggtaatcgccattgtagtgtctgatgattaataatagctctccacgccacacaaccatattgcaacttattgcaccaccttcctggtagggatgattgcgaggcagctcagtgagagagctcaatacgagagaccatgaacccacgatcatcctcctcaagttcacaagtgaataggcgtgtcctgtgcctcatgagcatataaagcttcccctggtagaaggagagatctcttgggccatcaatctcaactccagagcaaacctgccatgaaatcatcccaggctgccagagagctggtactggtgcacccttgtggtctgaggaagcagccacgatgtacttggatgactcaggtgaagcagatagtgccacattacatagtgacattgtgtatatatcattgacaccaaaatggacctcaccagaaccattgacgatgcggagggtcttactggagtaagcaggaaaattgtaacgcatatggcacagctgcggtaggcgaatgaccttgcgagagaaaacattcaccaggaagcagtcaccatcggcatctctgttgtactcgtcgctgcgatccttgttaggagtcacacctacaagccatccatcaaaataacccacacatcggagatcatcagctgcaacttccttaggcaccggcacgcaccgcacaggcatcaaatcccccttgtctgataggctcgagaacttgaaaccaggaagcatcagcaggggcagcggcggtggcaggacgtggccgttcgcgctggctcgccagtgacggcacacggaccgcatcctcgcacggtcggcaaggcatggaaggaagtggagcacgattcccagaatgtccggttgaaggcctgcccacagtgacacccccgcgtccaactccaaccttgatctcttcttgggcattccgccgagcaccacacctgcacgagccaccgggtgtcactgtcacgctccacagcaaacacccacccacggccaggaaaatacgcaataacacataggacttaagcaacacaccggatctgtccaagctgggatccatcgccgccggcgactgggtccgcggggatccttgttccgacaagcaaagatgcattccgtcgaacagcttgcctgcacgacaaccaccggtggatgtggatcagcttccaggcagcagtgcagtgcagcacctcgtgagatacgcgaacaggtagaggtgaggtgaggtagctctcacctgagtttcctccggtagaatccatggcgaccggaggttttgtggctcctcgccctcgcctagggggaggggaggggagggggatcgattgagggggagagagagtccgaaaatgctaatgggcgcgcacgcgccagatgcgttgctcgcgcagacgcgtgctgctgccggctaggccttatgggccgctgttggaaacagagcccagaaccaaatcatgattagtatatcgagcaactaatgacttcacgtgattaatttcttggaaccacctatgcatctgtcgggcaaaaatcacccagatttttccttgcctttagattttcatccaatggagtaaaaaaaaaccgaacagacagccaaaaaaggccaaaaatgactgggccaacacactaaaaaacagataaaacatgggctgcaattggcccaaacaacaaattagaaaaataaatcaaacaaagaacagatctgagaggcccaaagaagtaaagtcaaccctgtccaaaagtatgaacttagctgccaagaaagctaaaagaaaaaggacaaacacaaatccaaactaacacaccagatccaaaaaagcaacagcacgcacaccatagagaacgagtaggagagaaagaagagaaaaaaggttgaaccaaagcaaaattcttcaaatcaaagtgaaatcacaggggagaaacaagaaataaggaataaatccaaactaggtatgttccataaacctatgctcatcctcaaaattgactacaaatcttagatcatagcaccatacgtgcccccatcccatatgcataaggagtgttttgaacaaaatacagggcacagttcatacactgaaagtaaaacttacagtgcatttgcactaaaattacatttgtaaaaacagtatatataacatgtaagtgcactgtaagtttagtacaaatgcactgtaaaattatcaatcaatcaaacaagtagaccatacagaacaacttctgttgtttactacctaaaaactgaatacatctattcaaacatgaactcaggagttccagcaccaaatacatcatatattccaaaacatatctgtatcagttgggcagcacaaaaaagaaaataaaaccacaatagtaagtagtatggtgatatgggttagagacaactaacctgcatgatggctgccgggtttggtcttgatgctggataggatagttgagatccatggagtcagaactaaactaaaattaagagaacacaagcatgaattaggacatgttccacagtaaacttcagttacaaaccaattggtatagcgcacaatccatatgaaaaacaaatatatgcacaagggataaataatgaaaaacaagttcagaaactaaaaaacaacccaccaaaccaatttcacattgatatatgctcaaaagtagaaatttacattgcatttgcactaaaattacatttgtaaaaacagtacatatggcatgtaagtgcactgtaattttagtacaattgcactgtaaatttgggtaacataaatttttgcattattgaagtgtaattgataaaatgatgcttgattagtaatctgtcatacagaacacctgcatatttcactcctcaatactaggtattcactcatttaagacaaatggctggataaaattttagtgatttccaatttggaactagcaaaacagattcatagttctctatatatttggcttagaatatagaccatagatcacatttaatattctcatacagaacattcaggaattatataggagtaggaccctccaataatccattcaaatcaaatctaggattaaaagaatatcagtccaagaacatcatagtaaacaatctagggtactcaatatcttggaaatgtgtgatgactcgatctgccatataaacaatcttagtacatgcagagcccgatccacaatattttagtacttatttcactaatacaactacaagtatatatgcattatacaacagttacatcatcattgagaatcatttatgcacatcaaatctatatctctagatcaggatagattcattagatcaacataactagatgatacacatggaatacaaaaattacagtcctacataactaaaattacatttgaaaattcaggtcattgtgtatgtaagtgtactgtaatttttatacatttgttgtgtaagttataatgtattactctatgatgtattgctgtattctaatacattcaataaaattttgcagaaatgaagtcatatgcagatcctgtcaaaattagcatcaggcagaacaaggaatctagggagacaaacaaggaaaaactacaattaggtattttcttttaaaaaaatcacatactatgttgatctgaacatcatgtagaaattttaaaaaatatcatagtacaactttgaaaaaaaaatcacaggaaaatgttcagctgcagggtgaaggatgcaaaatattaaaaaatacattaagggttaaacactactactttcacaccattgttatcaaaactagaaaagggttaaacactcaaaacacattaacatagcacccaatcttaaatagcactatccatgctgccatacatatgcaaaatcaaacactggaagtagaaattacagtgatttgaaattaaaattaaaattagaaattacagttgtaaaaacaatttatattgcgtgtaacttcactgtaatttttgtgaataagctatgtaaataaatatgtaatacttaacattctagtaagatggtttcagtggacatgtatactaatttattccatgaattttgcaagaatgaaatttactgaaccagtcaaggttggatccatggagaaaaaaggtattgaaacactacactacttattcaagtacaaaacatctcacaatttcaaaaacttcaactacatagccaaatataataatcacatatataccactccattcacttgccactcaataccaaacacacataaatacaatcacatatgtgcctaaatacaaaaattttaaaaatatatgcaaaaccattctaggctaacaatcataatttgacctaaatattatggccaaaaattacagtgctttatatctaaaattacatttgtaagttcagttgatacaacatgtaataaatccaaaaagtataaaacttacagtgatttataactaaaattacaattgtaaaaacagtttatatgacaagtaagtgcactacaaatgtggttcagtttataactaaaattacaacaatttatgactaaaattacatttgtaaattcagtttatttgtcatgtaagtacactataattttggtataattgaagtgtaacatgtatgtgtattgtaattttggtgcaaccacaatgtatttgaaaaatatattcatgtttgacataaaacatgcaaatgccacactaaacatatactgctaaagctcaatacatgctaaaaaatacaaatgattctcaaaagacatacctatttaacaaatcagtacctcatatacttcatttctcccatggcacaagtcgtgaagcaatacaagaaggagaaacaattagacaacaatcagaggagagcaaaaatgatgcaatgcagattgaaggaagcaaaagaaacatcaacatggctccaggtcagaaaatatatttggataaattttgctctaagaataaataaaggtaactacaattatgtttgttgattctaacatatgctctaatgatttatataaattttacagggaggctggcatatgcaggaagtcctaatatctacaatttgcaggagggtgaaggaagcagcaacaaaatgccccatttaggtactaactaagtttctaaactaccaggtcgacaagctccaacaaaacaattgcaacatacactgatctaatattctgatctttatctttttcaaaatgcaggatgcaggaaaatacaacatgtaggaaaaaacttcaattcaccagaattaagcaataccataggaacaattgcatcagaagttgtcaattatggaggacaaatgctatatgatcaattcacattgctaaactcagacccaagataggtacactaatcaaaaagcatagatgtagcatataaaactattttatacatgcagttataaactaataaacatataactgtgcaggaaggatagttgagctacactaacctcatgcaccaaataatttatagtccaactgtcaccatacagcaacaaaccgtaagcatatcaacttacattatatacctgacaaaaaaaagagaaaataataaatgaacatgcagcatttgatgtaagaataaaaatttatgaatacttatgtaacaattccctaattagtcatttaaatcagtactaactactgttggagacgaggcttgtagtccttatgctcttttaaattgtgaccaatttgtcccaacttgctttgaatcaacctcattatgtagggaacataatagatttcttgtccaatagtcccctttgagatggcaatctccttcattataacgttgataacatcgaaccgacgaccatccataatggcatcaatgacatgccaagcaactccgcgtatgtcatcattgttgccgcatcttgggaggatggtggcccttactatgcggttgatcacacttgggagagccctcaaacccgccacctttccatatgtgtgccttcccccttcttcataaaactgagaaagatgatcaatggagaaggggttgtaggtgtgctcatcatgaaggtcatccccgttgttgaagcgaatgtgcaagagctccttgaattcatggcggttgatagagcatcgaagggtccccgacatccacttcattgcatcacaatcgccggacacccatacggtggcatagaattgccggatgagatcttcatcaaaaggttgcttcatggtgacaattctatcaatcccaacggtccggaacatctcttgcaaatcttcaaacttcggtgtctcaccaatgtgcctccaagaaatccacttgtgttcggcgaaggctttgttggcatacacttgttcatacacggacttttggaaccatgtatgaaatcttagatcattacaattgttaggcctccggaattgatcatgatgacggaggatagtgtattgttgagcattcctcaaatttagcacaaattggatggtggaatcgagaggactcccatcatcacttgcctcatcatcttcactattgccactcccattgtcagcaccatcatcacttacatccatctcattaccctcaacattttccatattgtcgtcatcactttgaacatactcatctccgcttgattcctcattctcactaacgggatcgggcgtgggctcatgacgaccatggcgagtgcggggaggcatagctgaaaaacaagaagcaaaggatggataagcaacaattttagaaaccacatagtgaagtgggaggaagggcgagtgctgcctgtcaggggcggtcagaccgagagccacggccggtcagaccgccggccctccgacggtcagaccgcgggcccacggccggtcagaccgacggcgaatggccggttagaccgctctcggtcagaccgccactgacaagagcacacccaaatccttccacaatccacacaaatgattctaaaaattgttaggacagtgttgcacacgattggaactagaacatcaaggtgtaggtctatctcatcaagattgaagcaataggggaaactacccttaaccctaaagattgaaatagaccgatttgagagtaatgtacaagagggagaggaatttaccggttgaaggagttgaatcacaccaagaaactaccctctattggtgcaaatcgatgaacaccttttcctttacctagggttccatgccatggatcacaaactcaataaaaactcaaatcaatccatggaatagagagaggaagaggagggaattcacttacggagtaaccggagtgattttggcggttgaaccggatggatttggtggagggaggtggctagggtttgggagaggagagaggagtttttttcgagttggggaagaagaaggatgaatgggaggagatggagtcgggtaggggaggaagagagaagaaaaagacagattctcgggcccaccatccccggccggtcagaccggctatacgcggccggtcagaccaccagggtgcatccggtcagaccgggctctaaaggccgatcagaccgcagccaacagtccggtcagaccgcgcatatagcgccggtcagaccgtctggcccccagccgactgtgcatagcccttgcacagttcggctacccccacataataaaattcaacaaaaaaaattgatttttggagcaattttgaaatatgtgagttgaaatattgccaaccattcataatattcgagatttatgaagatttgcaacaaaactcacttgagtgctaggaggtgaccatttatggtctataggggtttttgggcgaatttgattttcaaacaacttttgaaatatttggattttgaatatgatttgaataccaaaaacatttcaaatcttcttctctaccaactttgttttgaaacttttctcaaattccttctcaatctcattttggggtttaatctcattttggccaaaaacaagattctagtttcttcaaaagagggccaaaatagcattttcattcaaaaaacatttttcttgcaaagtgagggttggaaaacatatagggaaccttttgaaacattttccaagagatggttttcaaattacattgattttgcaaaagttttgacttatgttgacttgggcattttgaaaacattactagcacttttagttgatttgctcacatacaaaaggaagtggagcacatgcaagagtgcaaaactcccccttaatgtgacatgctccattttcgcaatgaagaaccaaatggcaatatatccaaaacataagagcaaataggagcaaatacacaatatgcaaaagaagcaaccatggtgcaccatctcaagccacattagagaagtctatgacatttaactcattcctcaacttgcaaaagcgggtttcatcaagaggcttggtaaagatgtcggctagttgatcctcggttcttatgtggctaatgactatgtcacacttggcaacatggtctcttaggaagtgatggcgtatgtcaatatgcttggttctagaatgttggaccgggttattggctatctttatggcactatcattgtcacataggagtggggttttggtgaaggatatgccatagtccaacaatgtttgtttcatccaaagcaattgggcacaacaactacccgccgaaacatattccgcctcggcggtagagagggctacggagttttgtttcttcgatgaccatgacacaagggatctaccaagcatttggcaactaccggatgtactatttctatccactttgcaaccggcataatccgaatcggaatagccaacaagcttaaatttagcaccttttgggtaccacaagccaatagtagaggaatactttaaatatcttagaatccttttcacggccactaagtgacactccttaggagcggcttgaaaccatgcacacatacaaacactaaacatgatatccggcctagatgcggtaaggtaaagcaagctaccaatcatagaacgataaagctttaaatctaccggtttacctccctcatcaaggtcgagatgcccgttggttgccataggtgtcttgatgggcttcgcatcctccaagccaaacctcttgagtagatctttgatgtacttggtttgactcacgaacgtcccatccttgagttgcttgatttgaagtccaaggaaaaagctcaactctccaatcatggacatctcaaattccctagacatcatatcaccaaattccttgcaaaatacctcattagtagaaccgaatatgatgtcatcaacataaatttggcatacaaagaaatcatcaccaatgatttttgtgaaaagagtggtgtcaacttttccaattttgaaatcctttgataaaagaaaatctctcaacctttcatactaagccctaggagcttgttttaaaccataaagagcttttgaaagtttgtaaacatggttaggatatttaggatcttcaaaaccgggaggttgttcaacaaagacaagttcggcaatttcaccatttagaaaagcacttttcacatccatttgaaatagttttatatcaaaccatgatgcaaatgcaagaaggatgcaaatagcctcaagtcttgccacgggggcaaaagtttcaccaaaatccaaaccttcaacttgtgtgaaaccttgtgccaccaaccttgccttgtttctcaccaccaacccgttctcatcttgtttgtttctaaagacccactttgtccctatgacattgtggtctctaggtctttcaaccaaagtccacaccttgtttcttgcaaagttgttgagctcttcatgcatagcattcatccaatccggatcacaaagagcttcatctacatgttttggctcaagacaagaaacaaacgagtaatgttcacaaatcgaagcgacacgagatagagtttgaacacccttactaatgtcacccaacacttggtcaattgggtgatccttggaaagagtggtgtgtatccttggtggtataggtggatcttgtgccttctcctcctccacttcaacttgagcttgacttggcgtagcgaaagtagatggctcatcttgagtggaggtggatggcttgtcttccacttcaataggcttgacatctccaaatgacatgttcttcatagctcttatcaagccttcatcacctacatcatccaaattctcgtgcccctcttgggagccattagtctcatcaaattgaacatcggcggtttcttccacagtacctttgttcttgttgtagacccggtatgccttgctatttgaggcataaccaagaagaaacccttcatcacaccgactttcaaatttggttagtctaacaccctttcggtaaatataacacttgcaaccaaaaactcgaaaataggcaacattaggcttcctcccaacaattagctcataggaagtatttttcaagagacgatgcaaataaaacctattggttgcatggcaagcggtgtttatggcttccgcccaaaaggaatcggaaacaccatattcatcaagcatagtccttgccatctcaatcaatgtacgatttttcctctccactacaccattttgttgaggtgagtaggtagcggaaagttcatgtttaataccaagatcatcacaatagtcctcgatattggtattcttaaactcggaaccattgtcacttctaattttcacaagagtgcaactaaattcattttgggccctttttgcaatttttttgaaaagctcggcaacaatagacttatcatgcaaaaagaacacccaagtatagcgagaataatcatcaacaatcacaagacaatgactattaccaccaatgctcttataggttgttgggccaaacaaatccatatgcaagagctctaatggtctagatgtggacatgatactcttagtaggatgagaacatgcaacttgcttgccggcttgacaagcactacaaagcttatctttctcaaacttcacatctttcaagcccacaactagatcacgttttgaaagtttgctcaattgattcatgccaacatgggctagccttctatgccaaagccaacccaaagaagtttttgcaactaaacaagttttcaaatttgcttcactagaattgaaatcaacaaagtaaagatttccatatctaaaacctttgaacacacaagacttgtcaagaaggctagaaacaataacttcttgcgggaagaaagcacatgacaagccaagatcacaaatttgagcaaccgaaagcaaattgaaatttagagatttaacaaaagagacattatcaattgacaaatcattggagatagcaattttacctaacccaattacctttcttttgctattgtctacaaatgtcactttctcttgttcattccctcctacttcaaatgtagtgaacatagccctatcaccggtcatgtgttgagtgcatccactatcaagcacccaatggctcccaccggtgtggtagttcacctacaaaagaagatcaagctcttttaggtacccaaacttgtttgggtccttggaggttagagaccaaagctttgggcacccaaatggcattctttttaccaccgagtataggggaacccacatatctagcaacaatgctaccatcatgaatcttcctaagcatataatgagaatcaaatatgcatgtcttaggaggcttaccaccggggcaatcattcaccaaatgcccaacctcacgacacttggagcaatacttaccattgctcttgacaaaacgagtggcacggtgagaaggtttcttacccttctttggaatgaatccaagtccctcattgttaaggatgcaccgttgctccctcaaaatcttgtcaagagtgttcttacccttgaagcacctctccaagctcttgttgagcttagccacttgctacttaagctcattgttctcaacaacaagtgaggcatcacaaatagatacacaagagctagagctagagctagatatatccacaagatcatcacaagaggtagaaatgctagatgatgcaacatgagcaatatgtcaagtagcactatcatcaagcaaatcacaagatatgccaacatcaatgagagctccatgttgagtagtggaaaggaggttgtcatgagcttccttaagcttctcatgagaaatggtgagtctctcatgagaagtctttagctcctcatacaaaacctccaaagaagcatgatccttctttagggccttgaacttgacaatctccttctcactataagcatggagctcctcaaacatactcacaagctcatcataggaaatatcatcacaatcatcatcactctcactatcactaagagatgttaccttagaggagccctttgccatgagacaaagtggagcgaagagtgatggggcctccttgatggcaacaacggccatcttcttcttcttggagcttgcatcatcaccatcttcttccttggacccggaagaggcggagctctcctcatttgagtcccattccccgatgaaggcctcaatcttcttgccttccttcttgagcttcttcataagcttgtagcctccactctttttttttgatgacttgtctccatcatcatccttggaagggcacttggaagcaaagtgtcccttctcaccacactcaaagcacctcaagttggagagagtcttattgggtcttttatttcttctcctatttgagttggagccctttcctctctcctttctccttcccaagaaatcattgaaccttctagcaagaagtgcaatctcttcttccaagttcttattgacgtcattcaccttgcccttgtcttcaacttcagcttggagagcaatgcacttcttggaaggtgaggcttcctccatttccttcttcttcaacttatacatgtcattggtgttgatcttccccaagaggcttgccggtgtcatccttgacatgtcagagttgatgagcatggtgacaagggtctcatacttctccggtagagccctaagcatctttttggcaacctcaagatcggtgtagtttgccccaagccccttgagatcattcacaatgacattgagcctcccatacatgtcattcacactctcatgaggcaacatggagaatgtctcatattggatcttgaggaagtgaagcttggcatccttgtactcacttgtgccctcatggatcttcgccaacttgttccaaatctcatatgcggtctcaaggttgctcactctatcaaactcttcttggctcaaagagttgaacaaagcattcatggcttgggcattgagttggaggttgcggtgatcaatctccgtcaagggcgtgccggtgattgcaaagcctacatccacaatactccaaatatggaagctcatagctttgaggtgagtagacattttaattttccaagtggaatagtttgtgccattaaacatgggagccttccctacgtggttcacctcgttcgacatcttctctctaggcggtgaagcccaatcaagagagaccaagctctgataccacttgtaagatcgagatgtcgactagagagggggtgaatgggcgatttaaaactaaatgacacctaatcaaaactaacctaagttgctaggcttggtgagggtcaactctaactaagcaactaagttatgttttgcaaacctagggtgatagtggctcaaatatatctctagaaaagtaaatcacactcctatgtcaatgtttagcaatcctagggtgatatgatctcaagtttgtctctagaaaagtaaattgcacaaaagtaaatgcgacaatcaaatgagacaaggagacaagagatttttcaccgaggttcggaaactcgccggtttcctactccccgttgaggcgagcccaactccaccgctcaaccacgaagcttccgcacgcccccttcgtcaaggggtgggcaaggcgggagccggcccacggagaggactacccaagcctcgatcactagggtagttcttccttcactccgaaggtggtgaactccaaaccactcacaaaccggcaccgggcctcctccacaatcttctcggagaggtcaccgggcaacttctccacaagccgtttaggaggcgacaacctccaagagtaacaagcaatgacccgacgtggagatgatcaagtgccacactagctctacaatggaagcaaatgcacttgactcttggctaatcaaccctctaacactatatggatgaacacaaatctcaaatgagtgtgagagaggtgcaaggggtgtatgcaattgaattgggtgccaagagagtccccttgctgctggtgggggagtatttatactcccacccaccaaaactagccgttaggggcgaaatccccccaactttgtgctctgccggtctgaccggaggtatgtggccggtcagaccgtgctactctgcaacggctagaaaactagccgttgtagcgttgtcagagggcctcatcggcctagacggtcagaccggagttgattaggcggtcagaccggagtaggctcggtcagaccgccatcggctcggtctgaccgactacggctccgtcggctctgtatcggccatcccgaggagcaccatttcggtctccagggagccggtctgaccgggcatgtgccgccggtcagaccgactttatgggacggtcggaccgccaacttggggccggtcagaccggccaggacattccggtcagaccgccactatgtggccggtctgaccgcccctggtcaggccgaatccagtgaatgtgtgtgtgtgatgaaaaagtgagcacaagtgataatgcaatgacctaatgtggcaattaaaatcatctctttgctaggtcattacccctcttaatagtacggcgaaactagaaataaactagcaaatttgatcgccctacacctcgatcaattctaaattaaagcactagttttaccgtcttctttctctttgccttgcgccgtcaattttaatccaccgatcgtcatccatgtgcacacatgatgtggacctaacttaaaatattatctcaaagacaacggttagtccacaattagcacttgtcattaattaccaaaattaacaccgggggcctagatgcttcatccccacggtcgacgccagctgttgtcgatagacaattgcgtacatcaaaagacgtgcttcactgtcacgccctgaagttcccctccctgctttaaaatccataaaataaatcgtccaaagaaattatttaatttaacctagagatgaatccctaattaataaatgcaaataataatcgaaatcggcatgtggaatttttcttggattctacatgtcaaaatatgctaacaggatttttagtggaattttctgagcttggaaataattttaaccaattaaaataagcaaagtgcaatattaaatccctgggaaaatcctttttcccttttcttttttctttttttcctcctttttccttttattgggccgtcggcccattccttcccgcgtcggcccgctcctccctcccactcccgaagttcacccggcctccctctccctctcgggtgctgactggtgggacccacctgtcagcccttcccttacctccagccggttggagctcgctggcgccccacctccccacgccgccccccttctccgctccacctcgcgccccacttcgcgcccgtgcccacgttgccgccctctgccaccccactcccgcccatgcgcgcgcgcccaaaaggggtggattcgaatttcgaatcctctccccactctctctctccatctctcacgtcgccggccaaatcggccaccttcccgccctcatctgcctctctcgtgcctataaaacgccaccccgagcctccctctctctttttccgtgctcgccgcgctctctagtgtcctccgccgctctccccactccgaaccgagctccgccggtcaccgttgaacctcggccgcgcaccgccactgctagagccgccgccgccgcgccaagccgtcacctccgctagcttcgccgtcgcgggagctatcccggccaccgctcgcttgccgcgcgccgccaccgcaccgttttccccacgcgccgccgcctaacgccgcctccaaccgccgctagccatcgctagtgccgtcgccgcgccgctcctttgccgccattggcctcgcgagatcgaggcccgtctcgtccatcccgcgcgccccgccgtccgccgcttgtcgtcgccgtccgccgttgtcttcagccacgccgactgaatccctggtaaggactccctccccctcttttactcccccttccccgtgtgcgccgccgcctttgggcgcgtcgccgcctcctgtccgcgccgccgcttcagccgtgtgccaccgtctcctcgccggccaccgccgtctctcgcaccgccgatcgccgctgtcgatggccgctcgccgctgccgcatcgcctaaccggctgcccggcttagcccggcaggccctccctttttttcagccgccgcccggtaggccccgcctgccagccgccccctctccctctcttagtgccgctgaccagtggggcccgcatgtcggagcccccctcgctgacgtcagccctgggacatattgcgcaataaatgatttaagtactttttgttatagtaataaacacagtttatcttctaaaaatcatatctaattcatccgagctccgtttaagtccattcaagtcttagtaaattcataaaaatgtatagaatccattaaaaatagttttgtttcctattttagtagacttatagcatgttttgctcgtgtgctttgtttgtcgcgtagatttcggccgtttcgtcgatccatggttcctcgaagacgttgctgtggttccatcagtgcgagagcaaggcaagtcatgcattacaattgatcatattgtacccaatttacaaatgtcccgcatttctattaaatgttgcattggtttacaatatcatgggggatgggtcctactactcagccatatattgtttatcttacgccattggtaacttgggtattgaaatgcttagatgttggtttagggaatgcttagccatgcttagtttaactagtacacaaagggggatcacattaatgtctagactttgattattggcatagctttggattagtgccaccgcaatggtgttagttaattaaaatacactacatggtgggttgtgggtgcatggttttgctagttgtgcccatggcgattaaggaccggttcgcgggatgccctggaagaacttatcgtacttaccacaagccagcatgggcaacggctaggcttgtagtgtagctttcctctagccgacgtacccaggcgagggtgggcgtgatagagttgggtcggccggggtgaccggttgatcggcttccggattcaccgcggcatgaaagggaagctactcgttgccttcaggtctaagtctaagtctaactgacgcacgcgttccagttgctgacgcgagcgtatcagttgcgatagtagcactggtggagaaacaatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtctgggcctgtcaggcccccccgggatctttagtc

SEQ ID NO: 66129 - DNA, 4311 bp, Oryza sativa
tataagtagggtgcggatggagttgttgatagtgcgaagaacacactcagctttgagaagtgtatggacaagacaagcgaagaacggtaccgcagctagcgaaaaaagaagtggtggcatgattaacaaactctgtaccgttatcggcctgaaagcacttaatgggcatgctgaactgggtcttgacataggcaacaaactcgacgagatgctggtgaacatcggacttatgacgaagaggaaaagtccaacaaaagtgggtgaaatcatcaagcaacactagatagtatttaaaaccagacaaactcaagactggagaggtccatacatcgcaatgaacaagctcaaaaggggaagaagtactagacgaagacctagaaaaagaaagacgcgtgtgtttcctccctgctcacgcatgacaaagcttattatcagaccgagtacaagaaggaatggctaatttatgaagagtttgaactgcagctggactggggtgaccaaggcgacgatgccataaggtggatgactcggcaaggaagctgtggaccgtgatggcagggacggcagtaggtagagtgtagaggtccccgcgactattgcagcgaagaatcacgcgccgggttcgaaggttcttaacagaaaaaccaaactcgtcaaattcaattgagcatttgttgtcacgggtaaatcgacgaacagaaagtaagtttcaaaccaaggagggagcgacaaggatgtttgtaagagcaaacctagtagctcctataggtagaaaagaagtaccacgacatataaccggaatagtatgaccattaccaatggtaatgaaggtatgagagttagggaggcatgtaacgagaataccgtcagtggaggacatatgcgatgtagctcccatgtcaagcacccatggacttggactgttcacagacagttgattgagagcagcaatgagaccagcttgatcccagttgggctggacttgcagcattggaggccatcctggagttggtggagacacataggaaccggcaaaagctgtgtgagcttgaggatacaggccaaggtagccagcactgttgccaggattgctgggagggcgccatgtagaggcctgcacagcccatggattgaagcagaaccacgggccggcagggcgaaaaccggcctgctgctgttggtaggagttgccacccgaatttccgtaaccgccgctgccggagttgttttggcgaccattgctgccaccgccaccattgttccggccaccattgcgacgctggttacgcttgccattgttggaaccaccaccaccaccgcgaggttgggacgaaattgtagtggcgcaggtaccggaggagcaagagaaagcagaggaaacagctgccaccatggctgtttcagtctgaaccttgtgctctttggcaaggcgaagctctttcagcaacagagtattgcgcgcagaggcgaaggaaggcagaacgggagcaccggcaatgttgtcggcagtgttggagaagcaggagttaaggccgctcagcaggttcaggacgagctaggactcggtgacggggtggccgacgtcatgtagggcatcagcagcagtcttgaccttctggcagtaatcagcaatggggagatcgccttgcgtcatggagtggaactcgtggctgaggtagatggcgcgtggttccttgttcgcctgaaagatgtcgtcgatggagaccctgttaggaaacgataggcgaacaaacgataaagaacaatagatcaatcacaaaaaacacgagatttaacgtggaaaacccttccaaaacaggagagaaaaaaccacgggcgccagccagcaaaatatcttcactatatctgaggtaaggttacatcgccgcacggcggcttacaagaggtatatatatagtggagccctaaaagggatgatgatccgtacggcagaagctggcctttattaagtgcaaatgaatttagatcacaactcaacagacccaaagatcacgggctgtctggtccggttccatagcgacatcaagaatcgcgttggaaacagaaccgaaaagccaaccccggacacagcaatcagcttgttcccaagccggatcttcagggcgagcaggagcagtaccatcaatatgagcgaggagtccggacttgccgcacatggaagtgaagaaggatttccatctgttgaaattaggatgcttaagctcgagggtaatcgggatgtgtgtcttgacattgacagtggcataagggttgatgacgatggcgccggcagaatctccagtggtgccggcggaggagccggacgtcgaggacgacatggtcgcggaagcagtggtggaagcggtagacatggcgcagaggaggaagcagcgcggctagggcgcggctggggcgtggcgcgagcgagggtgcggctgggtcgcggcgcgaagtggggcagggcgcgacgcggcgtggggcagagcgcgcgacgcggaaggcgcggcgagcagggcgcggcgcgggagcggcagaaacgcgtcggtagggcgcggagaaaaatcgcggcaacgcgtggagagaagccggcgaattaggagaggagagggaaaccggtatctgataccatgtagaaaattatgagacgccacacttcccaacgtggggggcgattatatttatatagccaaatacaatagagattacaacaaactcttaaataagagatatatacaaatacgagacatacttagactatacaaatctaatctaattctaatacatataagctatttaaattactgtaaattcttttgttgtatgttctgtaaccatgtcctaatagatttatttttagaacatcgacggatgccttgtgcatttcatatttaaaattaaagctgataagttcctgaaacattgatgttgtgttaggttccatctacctgtattccactggaagcatacaagttttaaatgttactgatccaaacatggtgaaggagctagccaactgcaaatctttggatcttggaaaaccttgctacttgcaaaaagagcgtggagctcttcttggtatgggaattctgacatcaaatggtgatctatgggtacaccagagaaaagtgattgcacctgaactattcatggaaagggttaaggtaattatctgcaggcacttgtattgggccatggatctctctgtcaaaaaacaatatttttcttggagcaactttctagtacactacatgtagcatatactaaaactcaatttattgttaaaatgacatccacagggaatggtgaatttgatgatggaggctgcaatgtcaatgttgaactcatggaaaaatgaagttgaggacagaggaggcagtgcagagattgtggttgatgagttcttgagaaccttttcagctgatgtcatatcaagggcttgtttttgaagcagctttagtgaaggcaaggagattttcataaaaatacgacaacttcagaaagcaatggcaaaacaaagtatgctcattggtgttcctggaagtaggtatatttcagaaactacacatgtactactgtggcacatatttcaatttgagacaatttaaaactcaaaagaatgatgtctttgaactgctcaaaatcctctgttgagctcttgtgcttagtttgaatgatttcaatacccaagtagctgcccagattcaacttctgaaatcactataattcagataatgtgttactgttttggtttgcagcagtatcagaataaccttttggagaaatatacagcttctattttgtctgggctaacttacatgtcccattttggtctgatctacctgcaattcctacatatcattctaaatggatataaggcctaaaaaatgatattttatctagaatccgtgagatactacagtagatccaagagtatcataacatgtattttccaatccatgccattgcatgagaataattatatgaaaataagtggcttctcatgttttatcatcttattgtaattggttaatcatttaaggattttcctttatttttgtgctgggccgactaggtatttaccaacaaggagcaatagagggatctggaatctggatagtagcatccgtaccctcattttaaacatatcaaagaaatatgaacatgattcatcgacctcagtaaacaaggatctcctgcactccattattcaaggttctaaggatggtccctttgcttcatgcacgcccgaggatttcatcgtcgacaactgcaaaaacagctacttcgcagggaatgagacaacggggtgca

SEQ ID NO: 66130 - DNA, 11914 bp, Oryza sativa
gggggggggagggaatgggatacagatgtagcaagcatatacaaagtggagtagtaaaaaataattgtgggtattgtgctaccaactttctgaatttgtttttgtttctgttgtatctaacctgatttaaggattttcgaatatgacatgataacactagctagattgctctaacaagtgcatatatattacaggccagacactagcttaatggaaaattacaaacctttgaacatgcaaggtcttaaaaatagtcctatatttccactgctgttgactgaacactatcttgcactagttcattagtattatctgatcaaagtcaaacagcgattgatcccgtgcaagtaggtagtgagagagagagagagagagagagagagagagagagagagagagagagagagagagagtacattagatatagaataataatcaggcgatcattgcaaaacctacgcagaatgcactagcatgaacaagtgatcaagataaacaaacagacacaattgcagattgatttatctcgtcaagattgatgagcatgcagcaacttgtttaatgtcaagtcaccaaacaatgccaatatatgcctgcaaagtgaaggtagcttttcggtcacaggtgcatgcatcatgttcatatgaacgacaaactactttagaaagtacgcacatgatcgatcatcacttcactttgaagtggatttgcatgacaactcctattcgatcaggcagtggacactatgctccctatatgtatactctagtttaattagtttgttgagagcaaaagtcaaaatgattatttagtttatccactatcatcaccctatccacttcactttttcagtaagtcaaccggacatgattgcattttcatcgcggtgtaagttttttttttgtgagccgatctgaagtaggagtattaggttatgttctttactctgtgttcccaacttcacacccaatcgtcttccacggacatgtttctcagactgtatatatttttttcataaattttcaacaggaaattttctttaaaaaatcacattaatctattttttaaataatatttaatatttaattaattatgtgctaataaatcgttccattttattgtgtgggagatgagttccaacccattaagaagaacacagcattcgttacatgcaccactcagctttgggccggtccagacaacaatatgggcttcagatgggccgtaaaaatgcaggcccaccttaattttaggcccataacaactctacattgctttcctcctccgtcgattcgtccgccgacgagacggcagctgatgcttccggtgctctccgccgacctccgccgcgcgcccactcccttctcccttctccctctcgctctcgctccgccgccgccgccgcctcctacccttcttcggcgccggccactgcttctgccgcgagccatctcctcctctacctcgccgccgccgggccaggagatggaggcggcttacaagttcgggccgtacaagatcgacgcgagggaggtgttccactccacgccgctgtcctacgccatggtcaacctccgcccactcctccctggtaataatctcctcactcccccttgctcagttttaccacttgatcgatttactctctctaatcgcctccaatcccccttgttcagtaccacagtacagtcccaaaacttgtagcggaaattacagagacgggttaagtagcttgccattgctaatttgtttgatgaccagttcgcgaatcatactgtaactgccaaatgctaacaagcacgtttttttttcttgaaaagcacaatgtacacgcagatactagctagtctgttcacatataatagtgtttttctgcaattgatctcttcttctgcctaacagattcaccttaatacagtaccatttcaccgttataccatatgcgattccgtcaactttgaccttgctgttgctgcatgcatttaattcctgttatattgctatatattggttggttcatattctgctcttctttcttaaccatatcattccttattgtgcaggtcatatccttcaattgcaccaaaagagactgctactttttttctgcaaactgctgttttggagatatttgcagttgatttctttaacgtgccatactgctagctagttccgttgggattgtcgataaaatgagcttgcttttgctggcttgtgtttgggtaaagtttcatcaatgcattcaaagtaatagtaaatagatgggcctgtggaatttatttattcatgaaaggattgtgttggtttacccttctatacttgacaaatatcaagtctggcttaaggtcaattttgtggattggctgaagaggtgatgtaggtgtttattttgccgcatgtcatcttacttgattgatcatcttagaggatgtcatctttaccatgagattgatataactgtcaattgtactgccgtgttgagcaaatcttacataaatttattggttagccatcttcttttgatttatactgtggtatattgagaatatgatatatcttatatgttgttttcccttaacaatatacaaatgttctagtgtgccccaagcgtgaagtgaaacgatttgctgatctaagttctaatgagattagtgacttatgggttaccgcaaaggaagttggtatacggcttgaacagtaccacaaagcgtcttcacttacatttgctattcaggtaaggtctatgtatttatgccactgcaattagtaggaatttgtattttcattatttcaatgcttaatcataccatcaagaggagtaccatatgggttttgcttattgggggtctaaatatgatgatcttattgtgtgtggaataaaaaaaaaccattttcccatacaagtattcttaacttttttttaatcatttgccctagctataactttgcatgtctgtcttgaattatttttttaatataatagtaatattaagctatttactcattagttctagtgcttacaggatggtccacaagctggtcaaactgttccacatgtccacatccatgtcatccctagaaagaaaggagattttgagaaaaatgatgagatatatgatgcggtttgtggcatattcctcaatcgacctccttttatccaatacttgaacccaatatttaccacaaaattcttactcagttgctttctaatagattgatgtcaaagagagggaattgaaggagaaacttgatctggacatagagagaaaagatagaaccatgaaagaaatggctcatgaggccaatgagtaccgtggtctcttctcttagatgtaatttttgcgataaatttcttgtaaactatctctaaattgcagttactcttctccagaaattatttttgtaactgtttgtcatccatcatgggaattcaagtcttcgaatgatattatgaaattatctaatttggtacgatacttgtttgttgtaaaatgtgttctttcttataaatctttatctttgaaactagttatgccacggtgtggcagtagttgtttgttggaaaatttatatttttatgacagatgcccctgtaccatatgaaattacacagccatatattatcagtagctggctgggtcatactatggtttcacaatctacaaatagtaacaaaatacattgtattacctttcagtacctatttgaaagcctacttaaaagaaagaaggatcattcttttggtgttttggatcaaatagagttgcaatccatgctatcaacacattgcattaagtttcagctgaaaaattgacttttcttgagatttccgctgctcttcagttattcagacacagtattttggtcctttgatcatgctagttagaaagtgtgttctctcatgcttatgcggattgctgtgataaattatgtttttgtcatgttttgttgagagaaaagccagaaattcgacatggcatagtagctgacagtttgttagacaggatggataactcaactttctatctagctctttgtgctgagtcaaagtttttattccttctgccgactgtccataaagtttgtggtttagcagaatcttgcctaagtctaccatcttggatgcgatatattgtttttattaccttgttactgttagtctatgcatctagccaacattggaaaagttaacctgactcattaatacaataattctggcaatttgtggccaatggccgtagtcctggctaaactatatatcattctgacgcacctttctgataagatcatgaaaactttaatgatctgattgaaccatgaaaatactactttaattttgtatcattgtgtagtttttaccttttttgctgcttgtttttgtctcctgtgaacttttctttggttaagggactgttccatcaatcccatttaatctaatgttattagaacataagaggctctgattttgattagtctccagtgttaactcttgtgcttgctttacgcatatacattctggaagatagctcaagtaaagtaactggttagctcttaatctctttttgctgatttttttttctgggacttgagcacctttggtcattttcatctttgcatcatgcttgctaagagggccattgagatgataagatgcactgaacagaataattgattatgcatatatgccataagttgcaattttgatacgcctgtagctacctttgacaagtggtaaagaacaatttgattggcaatttggctggttgtgttctgaagtgggatgtgactgttgcaccagacctgaggatttggtaacggtaagctatctggagcccctcacttgttggctgggattgttgccggtgtactaggtaatcaacaccaagtaagcttctgtcgtagtcgtgtgacctggtttgcttggcttgcataccaaccactggttgtctctgctgcgtagaggctattgttgtgttgagtacgttgttgcaaatattcgctggcatatataggtagtatgcatgcttcatctccatcagcaggagattctcatctgcaaatgcaaaagtagttctttcggcaaaaaatatagtgcctcaggtatccactcagaatagcaagtgcttgtcgttctcttgctagaaatgtgcactctgaggtcacattatgcgtactctttataaagcctgaacttttcgcaaattttcttcatgtgaaatagttgcaaatacacaaaatttagcacaaccttagttacatctcggctgcaatatataaaatttacagcaaactactactactgcggtttagatggtatttttccttggatttgatgatttctccactatgaactactgaatttccagatgatgaacacgccattggtgtgtagggcctccggcagatacggtccatgacaacgaccatagccatgacgaccgcgacatcgacgcctggcctgacgacgagggtgaacacgtcgtcgccgaggctgaccggtctggacatcacgccggcgttcttcctcgtgatccgcgctgcctcctcgccgttgctgccacggatcttgcagctcctcatggagaagcagccgtcgattctgaagctggggctgggagaagcatcaggtaattggctgtcaccacttgttcttgttgacatgaaaacttctgcttcgtcgctgctctgaagagctgagctcttcctcatggagaagacttgctgctgtgacactgaaggagagctcgtgctgtccaagccttcttcctcttgtgctctgtaacagttccatcgattgtgcaggctgagaatctgtcacattagagcaatgaagattactttttaatttactctgattatctgtttttacattgcttagtttcaaaaatagcggctgaagaaaagttgacaacgaatcatgcagatcatgtttcttttattacttctttgtcacttaactgaaaattgcaagttgcaaatggagagatctaatgtgaagcacataaaggttgaaaaacaatatataatatgttattatgatagaagcattttgtttgcttgtttcaggatttggttgcattttgcttggacatgtcctactcgatagactaaattaattaaatatttttatcaatagtacaatatctttcacattagagcgatgaagattactttttaatttacgctgattatctgtttttacattgcttagttcaaaaatagcggctaaagaaaagttgacaacgaatcatgcagatcgtttcttttattacttctttgtcacttaactgaaaattgcaagttgcaaatggagagatctaatgtgaagcacataaaggttgaagaacaatatataatatgttattatgataaaagcattttgtttgcttgtttttggatttggttgcattttgcttggacatgtcggcctactcgatagactaaattaattaaatatttttatcaatactgtacaatctttcaattattatagagaatgacgcatggaacatactagtatatagattttctttctttggtttgactggtcaatatctgatcataaaagattttttaagagttaattaggaccgcatatgagatgaatacagtaaaatttgtcgtttgagactttcaggactcaaacaattggatttttttttaatcaaatcatcagagaacggaaacaaggaagcaaagctataattttatacattggagattaagcatatgtatatccaacggttggattccaacctcgaataggtaacgcatgtttggctgcatgattaatatagcagcaaagctttgatcaaagcaacaaataataagactgaatctttaagttgagatgcaaacttgatgcgcatgtatatatggatattgtagtttgatagattatataaatattgcagctagctagcttgtaccctgaaatttctttatctaagtaccctaaatttttggactgaaagcaaagcagaagcagtaagcacacggccatcgtctatatattatggtaggaaagaattaaagtgagaaatgcatgaaagagaattaaagacgctaatcccaggtcccaacctatcttaagatatatacatgattccaaactagcaaactaaactgatcgatcagtaaacaggtcgctgctaaagcaataaacgagtggagctagagaagaagtaatgaagtgaatgagaaggtgatcgacctgcggcctgagggagagaagaggcgtgccgtggccatccatgagcagcaggtcgccggcgaaagctttgcggcggcgggagtagttgtcgacgcggaaggcgagcttgccggcggagtcgtagacggagaagccatcggtgccctggaagcctatgctggacctcttccacaccgtgtacaccaccggctgatctgccgcctgacgacgtgcacggccgccggtgccgccgccaccgccatgagaggggtgtatctgtatccttctcatgctagctatagcttgatgaggctggtggaagtaattaactaagtttgagagggagggaggaagctataggctatagcttatgttacctaggggaagcacaagctagcaaagcaagatttagttgggccaattagatagctaatcggtcgatcgatgggcgatgcaacgtatggacgtacgtggttgcctagctttgcctgcactgcagtctgcagattgggttaattattaatgcaagagagtgagagcagctgaaatgggccggcgaaaaggacatgcagcttaatttgctactagctaggaacgaatagaagtgaaggtgtagacaaacagtgcagggcacgttggattgggatttggcttagcgtgagggagctggcatgcatgcatcgccctacttattattcacaaagcagaagatcgcagggtgaccaggtcaattcagagtggaaatcagatagagaaagtgacaaaattaatgggcctgatttgaatagtagtagtatttctgatgggctttctttgcttctactgtgggagggagagcccatcaagatcattgacttgacttgacccggccccacagtcccacaaccattgaccatttgacccaacgcaactcaactgcttcttcctcttttccatctccatcgccgtcgccgtccaggaagagatagaagatggatacggtcgcgggaagcaagtacaggtttggtccgcacgagatagacgagcggcaggtgttccgcacctcgcccctctccttcgccatcgtcaacatccgacacacccgcccaggtacctagctatttcctctcctcagaacaaatctatcattcctgattgctctctccctctttgtttgttcatcatgctattccaatcttgcccctgcaggtcatatcctttatgtctgccaattatgtgtttgcacagctgctttactcttctctctcatttagtgccttctagtatctacttcacattgcggtaatatctgctctcaacttctcataccttattattattattattattataaaagagaaaaaacttctcttgctattcatcaatgaaatgtgcctctgtttcaaaagtaaaaaaggaaagaaagaaagaaagaaagaaagactctgcactgaactatataagtaatgtacggtatcggttcattgaaaaatggcagtggagtacatcacagtgctcacttgttttttgccttccgaaggggtattgtgcatttgtgctttctatttcaagacaattaatactacctgctttaccgtgttaatttctggtcgtgctaattacttcagttaatccctggtgacaactggcaactcagctctttttgcctttgtcctatgatggattactatgtggcactgcaattttgatagcctaagacttttaacgcccccccccctccttttccttaacttaaattatacatgttcttgtatgcccaaagcgtcttgtgaaacgatttgctgatcttagtcctgatgagacaagtgatttgtggatcatggcaaaggaaattggtgcacgtgttgagcagtaccacagggcttcttcgctcacattcacaattcaggttcgatttatcttgtaacctgtgaggtctttcactttgaatttaagaaatgttataactaaattcgtgtgagcatgacaagtatgatgttgctcacaaaattgtggtttcagatcacaatttagtatgttcgtaacattttttaatgaaaagttgtaaaaactaatgaaaactaactttatcttctattgtgtatgatatgaagttgaataaatttttcgccgggcatgaagttgaataaatattgctacttatcaggacggacctcactctggccaaacagttccacatgttcacgttcacatcgttccccgaaggaaggaagattttgagaacaatgataacaataaaggcatggttagtgatgctgcttggaacaactctcacttcatctgatactccatcaaataaatctgaataatctctctgttcataacagatgaatgcaaaaaatgagacattggacctagatattgaaagaaaagatagaacgatggaagaaatggcccaagaagccaaagaatatcgtgctcttttctcctagaaaatgtctatgtatactacttaactttgtgtggatttcactattcctctagcattcagcttcacagctgcattttacatattacactaatttgttgtgtttttatatcagatgattatactaatcgtattgtgcatactacctgatattctgttgtaatatatgtgtagccgttacttagtaatattgaactccttatttttcatctcatttattttgcattgtgtacatattttactgccagataatatgtttattcctttgtatatgctcaatgtattaggtacagagaacacttcttctgtaaatgataaaccaagtagtacggatcacaccagccctattcgaagggcattcttttgaaatctgaaatatatcatgtcagaatataatgcatatgagtaaaagctgtgtcagtactgtttatgtagcttttggggggtataatacgaggtattatggaatttttttgttgagatgatcactgcaacatgggactttatttcctgatccatgcgggaaatgaattgctttatgtaaagttcctgaatagtttctgtcttccaaaggaacccttaaacagtgacatttcattctactttatatgtaaattaagaaacagagtccttaagtatagaataactcttttgtaattcatacatgttggcagcccacctgtgacattgcccacaaatataaggaattacactagaattttgacataattctacaatattcggttgtattggtgtgctgcactagtttcagtctccccgtattcagcaatatatctactgggttcctctttcattctaccaattagaggctggatcctatgcatgtcgcttccagaatgtattatgtgaacttgtgaatataccaatggacgttccgttcatccttaactttttagtgatcagaagttagatagaagacttagattttgcaaaactcaaacaatgatttctgcagagttgctaaaattccttccaccttgatcaaactattcattttaatttgtatacttagttgttaagttgcttcttgctgatgggaaaccattttattccttctgacaactccgtattaatgtagcgcccgttccgtcgtggcgcctagcgggaaaatttaaattctaaaaaccctaattgcgaaatctatttctttgcttgttgtcagtttccgtgccaatccttgatctcgaatccccgatctatcgtcaaattcaaattccgaatccaaatccttcccaaatcaaattcctccacaaaagtctattttgcctcccccaggttcggtgggccgatttcctctcagcccatctctctctctccccccctcagccctcctctccctcaccccgcacgtgcgtcgcacgcgcgtgcgcgtgagccgacgccaagccgagcgccatctctctctctccgctttctcgttctctcgctctcccactccccgtctctctctccccggcgagccccgcccccgagttttgaatcccccgcgccgttgcttcccgcgcggagcgcgccgtggtggccgaccggccagtcgccgccgccgtcagcgcttgccgccctgtagctgcgcccttccaaaccgcccccgccgtcatcgccgtcgtcacgacccggccccgccaccaccgcgcatgctcccaaggattggaggcagagctcctcccactgcctcgtcgccctctctctccttccttcttttcccaaagtggcaagaggcaagtctcctttcccccttccttttcttcctttttctccccgccggcgtcatcctcccaatcgccgttttggccgcgaccgccgagcgccagctcgctccttgaccgccctaggtcggtttccaaaccgacattgccctcctattaaaccaaggcgccctcccttcctttccctctcccattctccctcgctccaccgcgccattgccgtcccctctgtctctctatcgccgaccgccgccgtcgcgtgtgccggaggagccggtgcgtgctaggacgcggaaggggactccgggcgctcgtcttcttcctcttccccagcccgaggccggagagatcactcccgtgcagtcggcctctcgtcatagcgccccgcctcgtctcggtagggcatctccccgttctccctcctcgttcctcctcttccccttagttttcggtagaagcttgtatagcctccccgtagctagctggcgccgccccgaccgctgccaccgctcgctgtgtgctcgccgccgtcgccgcccgtgctctatagcgcccgcatgtcgccgg

SEQ ID NO: 66131 - DNA, 22495 bp, Oryza sativa
tcccccaccggcggcggggccgttcccctttcccctctccctcccacggtgccgggcagggacagcgccctcccccccgccggatccagtgggaggggaggcagcggcggcccggtgtccctgcgacgacggtggcatcctcctcttccggcgtcggtgtttttatgcttttatgcttgtgatgttcttgtgttatagttgttgttgatgaaatatgttcttgtgatcttgtagtagtgttcttgtgatcttgtagtagtgttttctctaggattttgtgatgattctgatttgtatttggattgagattgagattttgttttttgggttggatgtgggatttggagaggaggtgcgcgtgaggttacagacggacgaaaaatagcagtacggatgaaaaagcggtgtgacaattggaaaaatacgtacgaatcttttaattatttatatggttataattttttactataaatcttaaaatatatgagaaattataatctatagattagttttggagaccgtactgagtttgatcgtgccttatattatagttaactagaaaaactgcccgtgcgttgcaacgggtaaagacgctgagcaataaattgaaatattgggatctctatacattataatttaaaaagttaatgaaaatcttgatattgggatggctatagattataattaaaaaagttaatgaaaatatttcctgagttttgggccgaaagccatccttccttttcagccctaggccagtccactacctcccttcgtttggcctgccagtctgctacctccctgtttgggctgcttgcttcaaggcttcaatccagccatgactgaagtcgtttcagttctaggctagtttgctacctccctcagtttggtctgcttccttcgacctatcaaatcccaaatctttctcgattacccaaaattggttgatggtttttatccactcgatcttctctttccgttttcccaaaatcagagcataaaacttgggataaaagcgatccgggaagatcgccgtcatcatcgacaactgttagattaaatccggccaaataaagccgggaaaatcatggaaaaaatagcgagggaggagtgggaattgatttttttaatccagttggagtagaaaacacacaatcaatatgcaccggcgcggcgctagagttcaactcgggagacgtgtagcaagtagatatgattaaaaaaccggatgagaaaaaccaaaagcgcacgggagaaaaaacatgtgacaaaaaaattgacaaaaaccaaaagcgctcgggaggcgcgcggtgaatagattggatttaaaaagccggataaaaaaataatagcgcttgtgaaaaaaaaactctttcgcgtgaaaaaaaagtcgaaaaaataccggtgccaaaaaaccaacggatttttttttactggccagacttttttttccctttctttacttgagtcggacaattttttttacgatgagatttttttttcttgtttttaccgacgacaccagcttttttttatagtttttgagtcggacttttttttttacctttttagtcggacttttttttttacctttttagtgggactctttttcttttttttttactatagaaatttcttgttctttttaagtagagatagagatagagattaaaatcgaaacatcaaattaaacctactgaaacacggatgacgtaccaaagtaccagaaaaacatctttaatttttataatagtagagataaagggagtacaattaaccatacaatctgttagaatatatggataaaatcgtattgtattatcataggatatgattagtttccatctctatctctctgagtttacttagatctaatccatgtactcctatatatatcggtccctaatggcatgtttaatagtaaagacaagtatggtctcttaaacaataaattttatttagagaccgtatctttacaatagttgaaacgataaaggctctaatcattaactcaaaataatttcttttgttaatattcttttcatttttttaccctcatacaaccatatttccatattatagtgactaagagtcgttgttaagccgttgttatgcataacaacgatgttttgtctctcctctttatctttcttccatgtcaataagcattcctaattagcaacgctaagatatcactattgacaatcattgtacatgccctgaggctcaatacagtgtatcatattcgcagtatttctcccctcatctgctatccaacacaatccccttatctctgtacgataggatttcatcaattaatcaacacatccacaaccagcgtcgtcgtcgaacacaactcagttgagtttttatgtcccgaaaatataatcgtgacgagtccgatcgaactcggacgcacactccaatacgagttgcaaacaccaaacttgcataatcggacgtacgctagctcaaaccgtttcgtacatgctcaataattaataataataatacctgaacgctccgacctcgatttgatctctctctctatataatagacacacacacacacatatatgcgcgcacgacgaacgttaaagtggacgtgagatatatatacatacaattgaaccctaacaaaaagtagcaaatcaatcaatttaagcgcaggcgatcgatggaatcaagccgccatacgtgcgctttctttagtggcgctcaaccgggcttctgttcgcggttttgcagatctgcggtgagcaccctatattttgcattggtaaatcaaaaccttgcggattcgctccttgatatcgtgactcctttttttttctcttcggatttgctagtgtaaaaattaggcggcaaaatatttacaaatttccgaccatttatctggattgatgggctgtttatatagcaataaaagtgggataaaatctggattgttaaattagtaaacaatttacaaaatttaggttgttcggttcgtagcaataggttgccacgctgaatatatattgggcttgggcgtgccatagtttgttagacaagcttttgattggttgacgtcatatactcagtttgtgctaaggtttaccatacatgtagctaataatttattgcctgcactttgtgtgagcttccacttgcttggtaagttaatatgtggtgaagttagtcaacatgcttaccttctatcttattcttattctagtacctctcttttttaatatatgatgccgttagtttttctacatcatatttaactattcgtctcgttcaaagaatttaagtaaatattttttcttttgttgtggcttgacttatatcactaaattaagaaactttaagcattacttatattgctaagattaatataaagttattttgaatggtcacacgttataacaaaagccaatactattatatatacattagaaaatgaagggagtactaattttcttatatacacaaacttcatatatagatcctcacttttttaataccacttttgctatcgtttggttaattattgcttatctatcaactaatgaattgaagtttatacttcctatgtcccacaatataagggattttgagtttttgtttgtaacatttgatcactcgtcttatttaaaatttttttacaaatataaaagacgaaaagttgtacttaaactactgtagataataaagtaagtcacaaataaaataaataataattttaaaaaaatctcttatattatgagacggagggagtatttcttatttttcaactaattaattaaactaattcattgctttttgatgatttgggggtgattttgtttgttgcatgcagtgcatcacgggggccgtgttgggcacggcattcgtcgcctcgacgatcgttgcgttggtggtgtacggggggggccttccggcgtcgtgtcggcgttcttcatactaacttcaatcggcattattgcgtcgacttgttacggcatctgctaccatccgccggaagattgttaatttaatttggccatacttcctccgtcccacgatacaagggattttaagttttacttgcaacgtttgaccactcgtcttattcaaaatttttttgcaaatataaaaaacaaaaagttgtgcttaaagtactgtagataataaactaagtcacaaataaaataaataataatttcaaaatttttcgaataagacgagtggtcaaacttgcaagcgaaaactcaaaatcccttatattatgagacggagggagtatattatacctacatgtgtattacatatatatatatatatagtgaatctattctacaccccctcccatgggtcaaactcacctcccccaccctccctagggcccaaaatccccctcccacctcggtcaaagcgtcctcccgccggtcaaacccgcccaccactcccacccccacccaccactttgctgctctcgtcttgcaagaatcgtgtagtaacaggacggttatcgtgcagtaacaagaaaacattatcgcagtaacaacgtcaaaaagtagccatgatggatcttgtttcgttaagcgtttttttatgaacttcatggtgcaaatggattggaaatacaagatatgatgtgagagatattactctctaaagattgagatttacctcttttttagttctcgtctcactgaaacagcgtagtaacatgatggccaatatgcagtaacatctctgcttttcgcagtaacaacgttaaaaaatagttatgatggttctagtttcgttaagcacttttttttacgaacgccatgatgcaaatgtgttagaaaaataagacataatgtgtacgttagtactctctaaagattgagatttaaaatactctagatctaaaaacattactactatagggccactgttactatgcatgttctctgttactgcaaatttcgtcatattgttactgccaaaagtgcagtaacaacctataaagtttacagtaacaacctatacatttttgcagtaacatatgatgttactactcttctgggataatgttactgccgaatcataataataaggtatgattgttataggtacataactgatttgttcacaaattagaagtgcttgccattaactatgagattatgggttcaagtcttgaatttaccaatttatttttaattttttctaaaaaagagagaagaaggagggagagagaaaaaaaaggggaatcggagggagagaggagcgacaggcgggacggggatgggaggtggaagggggtgtagaatagttattctaagggaggggtgtataatagagctaatatatatatatatatatatatatatatatatatatatatatatatatatatatatatatatatatatatatattctttactattaaaaaattgaagatatttttgtctagtactttggtacatcattcgtgtttaagtcgatctttaattttaattttatgttatctccactacttcaatttccattgtctgttaaaaaaaataagtccgactcaaagaggtaaaaaaaagtccgactcaaaagccataaaaaaatatctgtcgtcactcgtcagtatcgtccgacttaaaaggaaaaaaaaaaggtctggccagttaaaaaagaaaaaaattccgtttggatttttggcacgggttttttttcccatctttttgcacgtgaaagagttttttacgtgcacgcgtttaggctcttgttttttcgtccgtttttttaatccgatcgcgcctctgggtgcttttgttttttttcgtcaattttttttatcgccgttttttttttctcctgtgtggttttggtttttctgtttttaatccgattgttcgctgcacgccttctgagttgaaccctgacgctgcgccgccaccgtaccgattgtgcgttttctcctccaatttgattaaaaaaacttccccactactctctcatcattttcttcattattttccttttcgattcggctttaattcgtcaaatttaatctacgtttaacaattgccgatgatgacggcgatcttccccggttgtttttatcccgagctgattttggaaaaaaacggaaatagaagattgagaaccaattttgggtgatcgagaaagattcggctggatttgatggggaacaaagagttttacactctgattttggaaaaaacagaaagagaagatcgagtggataaaaactctcaaccaattttgggtgaacgagaaagattcgaccagatttgatggtgagatttgctcctctggggagatttacttcgacaacggtacggccacgggactatcttcgggaggttgaagatagtagtagactctgcgagctgtgcttacggctctacttgtggctgggtcgaagggaagcaggccaaacggagggagacaacagtctgaccgaagatggtagtagactgtgtgaactgcggttatggctcaacttgtggctgggttgaagtgaagcaggccaaacggagggaggtagctggcctagggctaaaaaggaaggaggctatcgaccctaaacccaggaaagattttcattaacttttttaattataatctatagcgatccctgtcgacgtttgatgtcgcgattccggtatttgcatagtatggggatcgttggtactaggatatatgcgagattgtaataaaagaaatggggacgaggatttttatacaggttcgggcccctgaattgtctggtaataaccctactcctattggccgaagccggtcgttgctcttattcaccataatcacaccagtacaatatttggggtagcctatctaactgttgtcgacttaaggtctgaagtgctgactcgtagtcgacaacaggatagccttcctcctcgaatccgcatctggcgagatcaaagacaacgctatgtctctcctgacagtatccgtagacaccgtagggcactagccatgtttatctctgaagtcgatatctagtgtcttgtcttggcacatgttggcttatatgttgatcttatgtcttgatctattgtttcgtgtcccctctcctcctcctatggggccttgtatttatatccataggtgtccccttgtccaagtagaactagggaaattaatatggatacaatccaagtagtctttgtcatttctatgtagaactctattcatccttccttatgcagaactcctcctatatccgaaggttgttttcgtataagacatggtatgtggtggatcctgccgagatttagtcgactactattaggtatgtggtatctataacactgacaatcccaatgttaggattcccatcaactttttcaattataatgtatatagcgattccaatattttaatttattgcttaactcttaatatattagtgaaaaaatgtctttacccgtgcaacgcacgggtattttttatagtatatatatatatatagttagttcttcctcttgctatatttttcaatgttgatgttgaagcagatatattattgctgattttttctgttgataataaaaatttggtggtaatattgttgatggtgatgagtgaactaactcactgaggatgtgtggagaaatttccccctactctgaaatataccctgtaccctgaaatataccccgtaccgtagtgaactaatgccaactttgtggtgggctggtggcacgtccggatttcttcttctttttgaagtggtgaatctaattaacaaatttaagtaatgcatattttcatggttgtttatgggatgattattagcaaatttaaatatataattttccaactagttgccaaatttcactttggtaagtaattaaaaaagaaggctttctctgaactggcaccatgcatgcctatctaaacgcgcacatgtgcaatattcggaattagttatgacgtggtcactgatatatgagcctatgagtgtgatgggttctacatgtcaatgaccatgttttctcttaactttacatcggaggatctcaatgtgtaatcttgacggttaatgcactagtttaacagcaacatatagagtggactctccactaaaatgaaatgcaatggagtatgtaaactgttcatgtctatcttctttacacatgacacacacaaacagccaccagtctgatgtaatcgatcgaactgggctctctcatcctcaccacgcaacaaaacgcaaaaattaaagctgctaattcctttaatttctcctagctaataaatccttcacaactttaacttgatcaaatcaacaatggcgacatgatgatcagaagaaccagctgccactggccgcctccacctcctcctgctgcctcgctccggcggcgagcctgatccggttgccgccgccgcgagcgaaggagaaagacgacgacgccgaccgccgcagcccaccgcccggctcgccgtccgacctgaagctgccggaggagctcgagccgccggagccggacgaatacccgccgccgccgcgtttcttgctgctgcctttcctccggagcaacgggagcaggaagcacccgtacgccggcgccgccgcgggctcgtcgtgatcagcttcgtgggcggcgccgtacaagtccggcgccgtggtggctcggggagcgaggtcgaggaaggcggtggggcgggggcggtactcgctgccgccgccggcgtacctgctccggcacggcgaggccgacgccgccgacctgcacgcggcggcggaggagaggcgcggggagtggtagtacggcgacggcgaggcgcgcggcgacgtcatgcagggaggcagcgccagctgctgcctcgtcgccaccttggccagcgccggcggcaccggcgacaccaccgccgccgacgccgcggaggcgctcgcgctcctggcgtgcttgggcgtccccgggcagatctcccacttgaacggtatcgcccccgccctcctgaacgagtcatccattgccgccgccgccatctctacggagattacagcttcgatcctctcgatctcttcttgatttctctcttgatctttcaattcaaatgcaaatgagctgagcacgatgatcgccatggctcacaactgctgcttttataggaggacacaaggctgtcttcgttaacgtgggttgggaactaattcttcacgcgcataaaacaagcaatagattaacacattattaattaaataatcccttcataacaattagtataatatgaattgaatttatttgtttaaaataatatcattggattgccatttgaatttagtttcatatggttataattttgttactataaatcttgtgctatataagaaactataagtcaaagagtatcgagtttgaccatatcttaaattatgagatagagggagtgttaacttttaaaacttaaaaattaatcaatataattttaaaacaacttttatatacctatatttttttaaaataacagcatttaccgattaacacagaaaataagagattagaaaaactgatacatttcaactcagtccaaaaagctgtgattcaggagtgattggaggagatagtggcaacttatctaaactttttttgtttagtggttggagagattgcacacactactggccggccgtttaccactgagcacacacacaaacatgcatgcgcggcgcccatgttcatcttgacttggtgcctctgaacaagacaaaacggcgacgaaattcaggttaattttttctatggagggtttcagtagtgggtcggcgaattcagatagatttcagttcggcgcatttttggggggacgtcgctgtcaggtttgaccgtaccgcacgtcgatgatggcgggaggagcactactttctccggtgattgggtcggcggccgatttgatccttttggtcgtgggctcgtcagatcgatggtgtgatgatgcagagtacaagtaatgctccctcagttattaaatatttgataccgttgattttttaacacatatttaatcgttcgtcttattcaaaatttttttatgaaatatgtaaaactatatgtatacatgaaagtatatttaacaatgaatcaaatgataggaaaagaattaagaattatttaattttttaataagacgagtagtatttgttttctcttgttcagattgtggtggtaggaattatggtcatgagagatcagatagcgggatgctgccgatttggtgtgagtggctgagtgctctggtctaagcaaggttggcttggcacaagtagcagattgtgtgttttttccttgggcatcgatgtataaattggttgaagtgttttgggaatgtaaattttattcaccaaaactctaaaaactcagtagaattgttttttgggtgcggttgagaggattggtagttgtatattcggttgttccgttctccgttgggtatttatatccagacgtcaacttatcgataatgagaaaaaaagtatgaagtacctttgggatgttaattaatttataaactcgattttaaacatcggattataaaactgagagcaccaacagaagaaaaaaaagaggtgaaatccgtgtaataatctataaggcaaacgtggatattgaatagcaaaatggctgagcacaacatgtcgtgtgctgagattcctgcgaccagagataaccatgtttcatatcaatcaagatgattgctaaccacgtctaccacgcggtgccacagggagttcttgttacgcttatgaccgtgtagaccccgacttgggtaagcgatgtggtactaaagcaaattaaagaaaggacgtcaagatccacattagtacgtagttctattcctggattaatttggtctaggcccaacgtaattggaaattcagtcccataatagaacatgcttccgaacgaaattaatggggaaaaaggcaaaatgttaattggttcttgagaagagcaagcacgccatgtatctaatgccaaagataatcagattgacgcacatattttgttagtatctttcttaatttaacgtgaattcatgtagtaaattctttaggttaattaactcaatgcttcaatcaagtgttgaagtgatcaactacatccaacttgttgcgctcattttcttgtatcttctacaacaatccaatatgccaagggtcctatgcttgtttaattcgggacggagggagtaagcgcttacacaacatagagactccaactccagccaagacaatctattaatttgatacatctcaaagatcacgtagttaaaaaaaaaaccatcatatatatcattgacgtatcaatctagttctcatatgaaatagtatattataactcagtatttttatgaggatagtttcaaaattttgtcattttataacaattatgatgatgctcatttaatattataaatatcattattttctctataaacctagtttaattttggataatgtgacttaagataaaatttaaaatgattatattttgagacaaataaagtatatatttttttagaattacacggtacaacgcagatactcacaacatgcacacacacactcatcttcatgaacacacatataaaccctactcctatgagcgtctttgaagactgggtcagcaaattctacccctactacataaaaaggatgtggtgttcatctatcgtattaacgttcctaactttttccaggttactacttgtaggcctattctaatttgtgcggctaaagctcaccatatgttaattagatcactataatgttagcaacccaactcgaccggcccgttagaattcgaagttcgaaccaccagcattatattgcaagaggtcggttcggctcggattggataggttgaggaacgagagaccaacgaacacggcacgatatttattttcgaaaggttttaatggcaaggaacacgacatcgttccgcatttctggtgaatgttttactctgttttttaccgcaaaacatatgggaaatgccccaaatcaggcgcccgcaatcctccacggccacgtgcgccgcccccgccatgtgtccccaccacgcatgccgttgcaataaatcacccatagaaccatctattaagagaatccgttttattttttattccacaaaaaatgcttcacctagtatactcataatgttttactatgtacagatcaaatgttgcagtgaattgaaatattcttttgtaacaaatcacccacatattataaaaaccctctattaagggaatccgtttcattttttgttccaccaaaaatgtttcagctagtgtactcgtgatgtttcactatgtatggattaaatgttacagtgaattgaaacatccttttgctatttgctgaaacattgttttcatataaggtgaaacaacgttcgatgaaacattttcgatctacttagtgaaacaattccgatatacttagtgcaatagcgtgcaacatttaaaaataatttaataataaaactatttttttcgtcggattatatccatgtgtggtcttgttttaaatatttaattgtaacagatttaatggtgcaatcggatcatgatttggataaataatttaagagaaaaatagtttaaagttcgcttagatacatacatgtaggatgacttcatcatgacttgggcgtccgatccgtagtcgcctcaaaaacatatgcaaccaatctacaaattatcaatcatttgattattatatatccgtgtgtgctggcagggagaaaacacaagcagctaagaatcaaatataaatatcggatctactaaatggcatgcaacagaaattagggatgaaattttacagattttggatcatcggattcgcaccaagatttatacctgggctcctccaactcctgtgagctctagtaaagtgcccaactcctgtgagctctagtaaagtacatgtaaattagggtttgggtaggagggggagttggagggtttagctagggcttagaggactgacagtggacacaggcaagcggcgaggcaccggtggttccatcagagccacgaggtcggtgacgggcggtgggacggtgttggtggttggggcaaataaatcaagtggttggttgtggatttggtgacggggagccatcagagacggggaagacactgctactcttgaggagaagacgctgttatcggtgctcggcagccctagaggtgagctcatcgggcttgagtgtgcgtgcatacggtagtgagggaaagtaaaaggggatggctagtgcgtgcatacgcgccagcaattttgctggcgcgcacgccagctgtcccctccccctgggcccttttatttttttcgtactttttttcttgatcttaggcgcgtttttctttttcttttttttcgtttctttccgatttttcttctaatctttcgtacacctctttacaaatgtagaattgaaaagttttttattttgatttaaaagttttcaaatattgacttgaaagtttttaaattttgtgttgaaaattttcaaattttgagttgaaagtttgcaaattggggttgaaagtttttaaatctgagttgaaagtttttaaatctttcaattcaaaatttgaaaactttcaactcgaatttaaaaactttcaattcaaattttgaaaacttttaaatcaaaatttgaaaactttcaactcaaatatgaaaacttccaacttgaatttgaaagcttccaactcgaatttcaaaactgtcaactcgaaaattcaactttgaaggcaattttttgaaaactttcaacaaaaattttaaaaatgttcatcatatctctgaaacttttcaacttagctatttatatattattttgataataaaatctttaattagattaatccatacgcttagcatggttattagcgttaatgacacgtgattatagtggcccacgtgcgacgagaaacagaaaaaacggaaacaagaagaaaaaaaaggagcgccagaagctacggactcgaaacgcgcgcgacttgctaatccggcgcgtctgcgcggattagcaatcctgaaagtaaaacgataaggttacagtacacacgaatcttaaagccaacccaacggtctagaatttcaagatgcaacgtgggattttctgtcataaattgtgtagctagtcccaataaatatgcgcttacacaacacagagaagagagactccaacaaagccaaccgacacatgctaaatcaaatcctcgggtacacaaacttggcacgaagcaatcgctcgaactcctccacatttgcagcctccatacacatgagcacccgcacggcggcggcgtccccgccgtcaccatccgctgccccgccgtccatcacgtagaagaaccctccgcgcaatgactccgcacgggacatcgcccatggcttcccccacccgaagtccaccgcgtcgtacagcggaatgcccagccagctcaccacccgcagctccgtctccggcaggctgccattgtccggacgatcgggcatccccgccatctcgttgtagtcgatcgccgaccgcagcatctcgtcgtcgtttaggcggccaatcacgcccttaattcgggcggcgatggcggccagcgtccccgatacgatgtcctccaccgcggcggcggcgaacacctcgacgagcgcgttgccgaagtagcggtccgggaggggtggcctcatgcgccggcggatgttcacggggaagcggacgagcgtctgggagcacagcggcagccggcgtgcgacgcaggcgcactgccacacaagggcggtcacggcgctgaaggtgctcgcgccgccgccgcagatccgcttgagggtggcgatctggtcgttggagatggagaagatcttggcggagatgaggcccgagcccgacgccgacggcggacggaggtttagcttggggcagaacacggaggaggcgtcagggtggatggcgagccgggggcgcgcgcggaggagggcgcggtcgtggcagggcagctccaccacggcggcgtcgccgtcccggcagaaagcagcccatgtttgcaagaagtggaacatgctatggccgtcgacggcggcatggtgcatcgccgtccctaacactataccgccccatctcaagaaggtcacctgcaagaaaaataaatgctgaaacctacgtattctaacttcgatccaagcaaatcaaattgaatactacttcattagtttcacaatgtaagtcattctaacatttctcatgtttatattgatgttaataaatttatatagatatatatgtctagatttattaacatcaatatgaatatagaaaatgctagaatcaatatataaaatatataagttattctaacatttaccacgttcgaatctatatagatatatatgtctagatttattaatatcaatataaatataaaaaatgctagaatgtcttacatcgtaaaatggagagagtaccttcgtttttaatagataatactgttaacgtttagatcatttattaaaaaaatataattattatttattttattgtgagttattttattactaaaagtattttaagcatgatttatatctaatccgtttacacaaaatttttaaataaaaaaaacaatcaggtccaaaattaacggcgtcatcaagtaggaacgaactagcgaaacgaaacactgacctgtacggcgagcacggcagacggcggctcagtacgggggatgaacagcctcttcaactccggcgacggcttgagatcagtcaagatgtcatcgacggcgagctccgaccgagccaccgcaaagaagacgccatcggcgttgcagtcaatctcgggccggccgtcgccgccgacgcggaagcggccggcgagggggtagaaggccaccagcgccttggccagagcctccttgagcctgcccacgtcgaagaagccgccgccgccgccggcggcatcatggcggcggcggtagaagtgcacgagcggggtgagggctcctctgttggccaagacgatgtcgaggggagaaagccagaggacatgcttcggcgtcttctcgctgggcactacgaagcaacactccatctcttgcgtcccatggccggccataggtgaactgaactactactactactcatcgtctttatagatagtactccctccgtcccataatatagcaatctagcaccgaacgagacactttatagtacaacgaatccagacatgttttttttcagattcgttgtattataaagtatcttatatctgttaaatttttaggagaaaatttatcgataaatgtattggtggtccctatacccaacgggaaatgcatacgtcatttgagatgtcagcattcagtgggctgattcagtggttcagcccttgcatgcagatctttgacacctactccgcaggcaggccacgtgaaatccaatcattgcttacgacaaaatctgcccttatctctttggtctctatgagggcatccactgaaaaacgcacatagtagtatcatcaagtgaactataggtggacttaggtactcaggccctgtttagttcgcgaaaagaaaatttttaggtgttatatatatcgaacgtttgaccgaatgtcagaagagatttttgacacgaataaaaaaactaatttcataactcgcctagaaaccgcgagatgaatcttttgagtctaattaatctatcattagcacatgtgggttactgtagcacttatgattaatcatgaactgattaggctcaaaagattcgtctcgctttttccccctaactgcgcaaatagtttttattttatctatatttaatacttcatgcatgtatccaaagattcgatgtgatgtttttgggaaaaactttttggaaactaaactgggcctcattagacacgcatctttcaatggagggtactccaaccagccctaaccagccctaccaaatctaaggtaacagtggaggtattctagtccacaacggtcgtgctctagcccacgaagccacatgtatgtttttccttccctacccctagcccaccgactgcccagcttctccctcatcatccctttttgtttgctgctccgaccccatcgtcgcccctccacccgtcgcctccggttcctcctcctgcttatctctctctccgttcgtcgttgacccaattgtcaccacccgccccttcacccgtctccgcctgcccctccttccgctcctctctctctcccttgtcgttgttgacgaagctcctcttcaccgcctctctctcctagatctagcacgccggcagccagatctagtgggccagcgccgtccccaggtcgccaccgcctctctctcccactgcccattgttgtccatcatgctggaagctggatctagtgggctgcgtcgtccccagctcgtcgccacttctctctcccaccgcccgtcgccgtccacgacacaagctagatctccccaccacgtcgccgactcgttccatggagctccaccaccctgccgtctccaactcctccccaccgcaccgccggctcggagcttcaccaccgtgccgtctactccggctcctccccacggatgagaccgagggtagaaggagaaaatgcatgtgccggaacaaggaccatggctcacagctccacgaaaaggagcggaggagcacagggaggcgcgtgcctcgcagaggagtcacgaccttctgctgggagatggctccggccggaaaagcgacgtttgctcgatggggtgaacagggctatgctccagggacatgtattggggatggcctgagtgctcacagtacatcgtttccaaaggcagattttttccgagacatttaaccatttgccacttttaagatatggtgattaaggatttgccactcgttgtctatgatatgtggcccctcatgtgtctatgacatgtgggtttagtggcaaatcctttagaagcactagtaaaaatagtaaaagtggtaaatagttaattattccgatttttcatgtctaggctattctttcgtactttactttcccttaattttcttcgtactaggcatctggtcttgcgcttatcttcgtaactctcaagcaacactcgatctcttgggtcccatggccggcccccggccataggtgaactactcttcgtcttgatcatgagcgaaaaaacactcttggcagcatgcatcgaccgatgcaattcacatgcatgcagtatacgtagaacctgggctttttgaggagctactgtggtaattaaacacccgttggaggggtccctgcagggtttcaaatctctcactatagctgccctatcttatgtaattatttgagaaggattctaattatttgttctcatatataatttagctgctatagttttatttagcccgctatagctgtttgaggagctatccgctaaatgttttagcccgctatttaaaacattgggtccctgccgtccgtgtccgtttgttggaggaggttagggaggtgttgtcggttctgcaaggagaggggaacaaggagcgacgccaggaagaggactagaggagggctcgagttaggggctggggtgtggatgggcgacaccagaaggacgacattgagggcgacgccagaggtagacaatggagtcgggggcgatgccactggcaaagggccgcagcatcagcgaaggacagcgccgagggtgagcggtgaaggacgacggcgacagaggcatggatgggagcgagatttttctggtctcgagggagagatagacagcccagcaggtggtgtgattaatgtgtttttttcgggagtagctatgtttgtggcgccatattttttaccaaaaattagtcggtatgtatttacattgtaagtccctaaattacatatgtaattttagtgtatttacaatgtaagttctaaaattacatatgtaaatcctaaaattacatactaattgcatatataagtggtgtgtaagtggggtgtaactaccatgtaaatttataaatttaaatcttacattgtaaaagataaaatgcaaaagcatatgcagtcctaacgttctagctaggagatgatcaagagaagaaatcgaacggtccgaacaggcacagccgaagacgtttagcgatcagacggatagcaaagccgactgagatcagccccaaaaagtgtcgacatctttttagcaagtccgtttttttctaagaatgatacttttcgcgattacagtgcagtcctcaaaaacaaatttttttcttcgcattgtattttcataaatataaagatttttatgtaaactttataatcgtgagataaatcttttgagcttaattagtccatgattagccataaagtgctacttactacccacgtgtgctaatgacggcttaattaggctcaaaagattcgtctcctagttttcaggcgagttatgaaattagtttttttcattcgtgtccgaaaaccccctctaacatccaatcaaacatctgatgtgacaccaaaaattttctttttgcaaattaaacagggccttaacacgagaagacatagacataaagaaaaaaagacgtgtcgccactctgagtagccagaaaaaaattttaaaaactgtgaaaagagatgagggtagaggggttatcagctgatgattatgttatttccacgagattagtattttatttccacgggttagataagataacagatctcttctgttaggtatatatgaatcaggccagcctagggaatgagtacgtaggcagtgcggcaatagtgtgagctagcaagcaggaggaagttgatgaaatagggatcaaatgaaatggataatctacttgacacgatatattaatatttaaaaaacaaacttagcatatatcttaacatcatgatcatataatcaatacaatgcagtaggaaaaagtcttttgagaaatcgtactgttagtgtggcaagccaccagttaaggaaccttctaatcctccactcaaaatgaaaaaaagaacctgctaatattgatatttgagtgcacctacaacttgagtatcctgtgagaactgaaacaaccaacaataatttgtaaaggtatgagattaattcaacataactcctgatacaacaaatatttttgcacaacacaacagcatggcatactatctggcattgacagatgcagaacatattttcgtctaattttacaaaaaggggggtcgttaagcatcataacaaagtgtctggctccggatgatcattctaagaactcttcgggcgaaacttccagacacggatgtagttttcgccatgtgtggtcacaattttcttcatgcctactgccaggcaagtgatctgagggcgcaggcgtgtggggatgttgtcaagccgcgcatttggagcaacctggcggacgcttttcttttcgacttgctgatgggaactggatgctgctgggcggtctgcattaactatgaaacttcggatggtttcaccggttctttggcatatcaagcgaagcacaccgtcaataccgccgactgccagtgttgctgtgtcacctggcaagtgatgtgcgctgtagatgacatttgggctaactctcttttcccagagaggcctcagggtcctgagcacgaataacagagaatataagtatggctctaatggagatcacagctatgacttactgtggtacaccattagcagtttagtactataagtgtgccaatattcttgccatgcacgaactaaaagcaatgtaaaataattacagactccataagcatcacgaaagtgaaaatgagaaaagattctaaaaatgataaacttcatagtatatttcaaaagataacttaataattgtcagttgttctagaatgttaaagtaatctgaactctttaactaatctcttctgtgataaataatgacaggtaggatgtaaactaatacttgtaaactaatagaagttttgcacacacatactcctgaaagatcatggcaggtatggactatggagtacagacaaaggcaaatggtttatataggccatgcatctctctattcaagttcactctactgaaagtctcaaactaaataaaatgtttaaaaaacaatacttcaatgttcatgatttgttctataactccagaggagagagcttcagttattacacagaccagacagctcaatgatagtaaattactaaattctatcatcttacgataccgacctcaagtcccagcagtgcgcataaccagcagatgagcccgcgaatatcaaatggccacttgtgctgaatgacaagcatcttattgctgaaatcattagaaaacatgaaattagcttagtattgattaagctcacagcactaaatatctaacatactgaaatggatcatcattggtgccttttatttacaaagatttaacaaggacaaatactgccagtaaaatcttagatatagttcttcatcgaactgagacgagattataaggcatgatttttataaagaacaacataactaaagaaattgccaaacaagaaaaaaagagttggataagattgtcactcagcatcctgccatttttctagaacaatgctattctttttaatggaagccaaccttttagagggaagaaaggggacactgcataaccatgcattaacttaatatgcaagtcatcatttctgttcaaacttctgttgaacaagcattatgctgcaggtgtattattctctttatggtaaatgaaaatgttttttgtcatggtatgtcaattcatttggactttttttttttgaaactgatacatttgaacattttcaacatggaaagagatgaagagaccaagaacatccccaatccccatcaatcatcagcaattggcagtccatcatgcttattcaggatcagctgaggggttggttacctgttggtgcaaaagctgatttcagaacacctaacttttgtccagaggtttgatctgcaatagctacatttccaaatgtagaaccagcagcaatgagctggtcatctgttattgtcaagcatgtcaagggagaagagtgaagcctgtataacacagttaaataggcatcagctgcaggacatactaatatagaatgcagaactgtacatcacaggggcaaaattgtctctttttttctgcatttgtaattattaatccttcaaaaatttcttaaatatgtacactatgtcattctcaaagatcaattgtatccaaataagtgttgcttctcaacttttctgcatccatagaggcccatataaatatcaaattagatacacctttagaaggaagattctaaacctcagcacaatctcatttgactttaaaactatgtaaaacattcaaggggaaacaacttcatgaggtgcagacatgcattgataaacaagacgaaattataccagctgaaatggttattagggctgcagga

SEQ ID NO: 66132 - DNA, 3082 bp, Oryza sativa
caaagttgaccagcattttagaacttggaacaatgtactcattcatgtatttgcaactttcagcagaccaaagtcggagagtctggcaaaaatcaaatgccaagatgatcagcatgattataagatctgtgacggtattaaacaaaattaaaaaaaaaagcagtaagcactaaaaatcttcaatcatgctttcaattatctaaaaacttcgcaatgtactcaggcagccatggtttccacaatcatgtcatgtcatgtttcatctggcattctgcactactatagcatcacctgaatagcgagagtggaaggccattgaccatacccctattttttaaaaaacaaatataaatataactttttttttgtatactacatcactacatttctttttgctaaaaggacctaccaaaaaggtctaaagcacaaaaattattattgtactagtacaaacattaattatttgtgcctgttacatcttacttttttatttcaaaaaacagccatttcacattgatgaaggataataagaacggcacatgatgcaaggctcaccttatctccaactccagttaagattgaaccactcttcatgcggcatatggtggccctgaaacaagaaatagaaaactgaaagaaaaaaatgtggatattgagccacaatcccaacagtgcagctccagaaaagaagatacttgatcaaatcgaacaatatgaaaaaactaaaaagaaaatgtttgagaacacgagaactcttttagttgatataactaattcactatgcacaagaaacagcctaaatacagaagctcagcatagtacagggctacaggcttactggttaggatgaccaatccactgataaacttcagcaggacctctagagaaagacgatgcatgttcatcaagtgcaagctccttgaagtaactctttattgaagtattagaccctgaacttcttgcttgtggattcctcttgtaatatagatccctcatcagatgagctgtgtcaataactctattcctataaaccaagcagagtagaataagtacgtacaaattttaataacaactgataaattgcttggtaactttggaattttcacaaggaagatctggcggcatagacgagaaacatgcatgaataaaattaccaaatgaaactaaaatgattagcaccataaatgtatttgtcagtatggaaaatggtagctggaaaccagaataacactgaatcactgaattaatagtcaagtcacgaactactggacagagtatgaataatatccaaactaaaatgattagcagcataattggcatagttgtcaggacagaaaatggtagctggaaaccagaaacagcgctaatttagcagtcaagtcacaaaccactggacagagtatgaatatccaaagaagaaacacacaacactgattagctccccagaggtacatggttaagatgcagataacaaacaaatgagaggttaaatgcatcttcaacaaatgttaccatgacgaaaactcatcaatttgactagtcattcagtgttctaagcaacagttactttgaagcatatatatataccatttaaggaaaaaaggaaaaccgcagacccggagtattgggacatgcttcatagttatccacttatcctgcaacctctaggcataaaatccaggcagcagagttcaatgcaatgcgacagcagagtagtaattgaggctatttcttctaatctcgtagtagtagatacctgccgtattgtactgtaaattagagcaaaaaataaacatccccagcgaaacccaaacacaaacacacagcgtgcgtggtagcagtaggagggggaacatgggagtgaggaggggagaggagacgattcgcgcggcggatgggacgaaccatgagttgcagacggtggagcagcgggcgaggtcgaagtggtcgtcgaggcgggagaagacggagcggagggtgtcgtcgttcagcgcctgcgccgtcgaccccgacccgccgccgccgccgccggggcccctgcggcgcttcaatcccgcgctcccgctccgtccccggctgctgctcgtctccatggccgaacccctctctctctctctctctctctctctctctcccgatctctctggaggcgccgccgtttgctcgttggtttcacggtggccggtggccggtggccggcggcgactattcggtccttccgccgattgtgtggtggataacggcgtgttgacccagcaaagtcccgagtcgatctggcccaatggcccattacactgacaactaactcggtacatttaggcccatcaaattttggatcgctccatggtagtaacccaactcggcccaacttaattttgaatatgtaccatgtcagctatcgaacataaccacccgaattttgtagggaaaagtgcactttacagattataattcgtagccctcaatcacaaaacctggtatagcgtgtcccctaacttttaaaataagtgacatatgaatctcttggcagttttagacgatggtttcattctaagtgacatccagatggtattttgactttgtcatcattaacgtggcatgtgcatagcatttataataattaataaaagaacagtgtgatccacatgtcaatggcatcaccccttattcctcatctgcctcctttgtctctctcgcgatcctcatctcttcttctttggcaacgtcggcatgggaaagggagcagcggtcacaagagagaggagaaggttgaggccattgcagtggcaagagaaagacagttgaaggtagagcagtggcgcatctgccacgacctatagcaatcactgcggtgtagcctctgtaacgtggccgcagggttctcctttccttcgccggtgcagcaaattaaacgacgagttggatgaggaggtgaagaacctccatgaattgatccgttgactcgctcattcctgccggttcccctcaacgctctcccatgttaatgcgccgagcaacgcactgactctggttttgggtacagctacaaatgtgtgaggatgatggggagttcctaaaggtt

SEQ ID NO: 66133 - DNA, 6630 bp, Oryza sativa
ctcctctccgtgctcctctccgcgctcttcggtgctagccgtgtcgacgacgtcgagtccaccctcgcctccgcggagtcctccttcggcgtcgtccccggccgcgtctcctacaacgtgctcggacgagtgagaacagcaagagagacggaagaaagaagggagaggagaggggaaagaaaggtgacatggacaccctgacatgtggggcccacatgggtccacgctgactcagccgccacgtcggataaaaccagggtcaaaaccatcgaagaacctaaagtgaacggttttgtaagttgacggatattatatatctggttttgcggttaggaaatgatttcgtaactcgatgacaagttgatggacctttggtgttctttttcctagtagttattgaggtaggtaagcttgttttgacattgagttatgtctctcttaattaacctattgacagggagtagtaaaaagcagaggagcagcttgaaacaactcaccctcggggtgaaaatatgtaatacaaactagaaatataccgttgaattatgaaatgggcgcctaatatttgtccgcgttatcgagaataaaaattttactcgtaattcaaccatgagcaaaaaattgtctgggagtaaaattttactctcgatgatgtgtataaatctcaggtgttcatttttagatctaaaggtagtttacatattttcactacatatgtgttttctacaaaatatttttccaacaaacaccgtatccattttgcagtatatataggtgtgctgtacgtggagcactgcaccggttgatccgtggcgatcccggcgaccatacaatacatgatttgtctgcaaacacaaagctcaaacagatggaagttgttagacaaagctaaccattcctcgtagctagttcagatcagtgaaaccaatgctgaatcatcggataaaggagaatttgaatttttatttgcaaaacaacagtggttgctcaggcctgacagagatgtgttttctagggcgatgatcgagttgcatgtcggacacttacagacaggcagacagagtatcttcatcttatatattagcaccttgattgctgtgtgcttaatcgtgctgaaatgagtaccctcgatcacgtatgtttcagatttcaagttaattcagagtaggtttaggcgtttagctgatgagctaattaagctactaacattgtgggtttgtacctacaattcatttgcatttccacctaacaagtgattgtcaaatcaagcgtgtgccggcctgtgactgcccaacttgatttctagaccatccaccttgctgaatgctgatcatttatttggcacgtactgtagtattcaggctttgaaaggggatacaaacaacaacagtgttaggtactagtccaccaatagtcaaacaaaacagcggccttttctctacagtctagctagtagtctacacaaccatatccatacatcaaagtgggttctacagcaattaatcagatcacaccctaaaattaactctctaataagagagaatgcaaaaccagatttaaagcacgaataaattgtttgtggaactggtagatcaagaattaatccctttctgaagattctatatgcagttaaacattcagatatcaacatgcccgtgtcaggaacaatgacatccttaagcatatctagtcccaagaatctctgaaaaaaaaaacttaatacgtttgcaatcgcatcagaaaaccgttgaataattcaggcgcatatgcatattgatcatggaagagatcgaattgaattagcagcagcaagaggtgtgtggtcatggctgctggctggtgcaattggtggcgccacagtcgcaggtgtggggggagaaggcgcagacgccgaagggcttgccggggatgttgcagtcgatggcgtagcagcaccgggtgtccacgcagctgctcgcgttcgacgacgcgcagcaccggcagcccatgcacagctcgaacggctcgtacgccgccgcctccgtgccgatcgccgccggccggtacatcaacctcttcaccggcacgtcgtacttcatcaccatcttcttgtctggtcctgcatgcatgaaaatcaattaatggaatccgatcgacttttggaaggatcaccaagatgcatgatgaagcaggtgaagatgaaggtgtgtacgtaccttgggcggcctggaggaaggaggagctgaagatgaggaagacgaccatggcgaggccggtgagagagatggagacatgaggatcttttgccatggtcaattactttgtctctctggaaagaatggaagaacactgagatgcaatgcaaagggggaaacggttgggttttgggtcagatatactactactaatgaatagtactattgtttggcaataaggcaactcgacgcctcaagtcaatttcactcgtatttatataatctgcaaggcaacgcacctacacatgacatggctaattgatagctccaattccccttgaaaaaaaactgcacacaattttactaatatgcttaaataactagttaattgcatggatgcatgatggttgcaaattaatcaactcggaaatgaaaaatgtgacctgccaagcagcttggcaacaaagctgcttgctgctttcctgcttgcttccttttcagctaacaagatattgctactgcatacatgtgtcaactagctagcggtgtggctgttcaccatcgaaaactaaaaaaagaatcgcggatgatcgatgagatgaccagtcggaaatttctggaactctgtatgcggaaactagattcttgttctgaaatttcacaccattaaagcagagagaatatgcatgggccggggaagaagaggattaaaaagcatcagcgtttcataaagttaattagcagttgacagatgaagcaaccgttatgcgtgccagttaatgagagcgattgatgttcctttgtgtcaataccaaaggggaatatctttctttaggtagagatacgtcatttgctggctctctaaagttgcatatatcagatatcaccagcaaacaaatatggtttgcaatgcaaccttggtccttgtcgcatctgatctttgtatttttcgctcttctgattattttcttttatgaacttagtttaattcattctttgtcctccaaattaatttgtgtgcacagccgattctagtttaattcattctttgttctccaaattaatttgtgtgcccaaccgattctcgccaactctctagcagtaactagataattaaccaagtcacatcctatagagattttcctgtatgttggaacttggaaggatacggttttaattgttttgtgacgaaaaaccttgcttgtcaacaatggaacagtgcacttgatgatttttcttgaaaatgattgctcactgattttcatgcatcttttagttatgacatgataatgcaccaacattcctgtccagtcaggcagtcagtgcaccaacaatttgtgacacttgtttgattaatgagtggttcttcctttccaacttccttccaaggacgacacactttcagattcattaattattgtccttgcagaaaaagctataacagacacctttcatttgctaattgaaatgcttatccctgctctctctcaaaaataaaaacattgaaatgcttatctggcttgatccacgtcacacacaatcttttgccttaattctaaaaccatctcctaatcactccttcgacgcaagtgcgagtgatgatggtgatgatgaccatggctcaagggcaccatgtgaattacagtacaataagagtgtatgtatttttgtgactgaaaatgactaccactgttgtctatatatgcttattactactctttactgcagcattatactaacagacaggtggccatacgcttaacaattttttgccttaattctaaaaccatctctgaatctacttcagacagtatatacatggttatagactcagaaaaataactgctaattaatttggtttaaaatatggttaattagactgaagttttcagttgaaagattaagcggaatctatggttactgtattttagcactctgaagtgctgtttgttatcagtgtcccgactgatgagaccaaacatttatcatagtgctgcatcaaagtcggcatctttagaattaggaatggagtaacatggtggatgacagatgacaagacaatgagggctccttgttaattacaaaagcaaaaaaagagaaaagataatgactggttctgtatacaataaaagaacagaaagacaatgagtgaaacagagtgttgacgtgggaaaacacaacacctggagtgcaaaactgacgcagccttgaatacgagaaacactgataacatcatgataaggtatataggaccaaattatacaatgattcacagcagcaatacagatgaccactacgtcaggaaaacaaacacaccataacaccagcaatttaatatcagaaagtaaagctcaacaaaaaatgcacaaagaaagtaggcaattcatggaacaagatacagatgacagacaacgtttcagtagcatagcaaccatcgttgcactcttagttcagcctttcatttctggggttaaaccttgccggttttggcagggcaaaacacagtcaacaacacataagaccactgaaaattagagggccttacaagcaccaccatgcagagcaaatttacaggttgaaaactgggggagaaagccaaaaaaaaaaaagaaaaaagataaaacccaaaagcacacagcgcaggtgtgcacactcacgcaccatcaacggtttagacttgcaatgtacaactgaacctattccaggagcaactgaaacagcacactctcatctcaccctgcatgctgggacagcaggggagcacttggggttcggaagcgccctacagtggactctgttcgtcattagtctgcggtttactctgtagctcggaaggccactgccaagaacagattgaacagctccatcacttccaccactgccctgcaatggttcaagagtctcaacgacgtcgctcataagaggcctcgcctttgggttttggctcaagcagtagtatgctaggctgcaggctttgtgggcagctctaactgaatactgtccctccagttttgggtcaatgatttggagaagcctcctcttgtcgttcagcttcgggagggcccagtcaaccaagctatgctccctgctgggccgtgacttgtcgatggacttacgcccagtcaagagttcaagaaggacaacaccaaagctgtagacatcacttctagcagtcaagtgacctgcccaataggtatatatacatcagatgaaattgcaagggcaaaacagaaactgcatacttgcatatcacttagtaaactttctggtcacattttgatgaagggtaataacgctattcagaaaaaaaaaatgaagaaaacttaaaaaagataaaatgaggagagtaccagtcatcacatattcaggggcagcataaccatatgttcccatcacccgagttgatacatgggtttgatcgccttctgggccagcttttgccagaccaaagtcagagagtttagcagtataatcctgtgtaagtgcaaataaaagataaatgctattatgaaaaatatttacatattcccaacagatgcatagaagagaaaggaaaaaaaacaagatattggcaagaaatgctactcaactgagtccagcagaatatttgatgtcttgaaatccctgtagataattggcctttcagcattgtggaggcaagctaaccctttggcagctcctaatgcaatcgacatcctagtagcccacgatagtggagtagctgtccctgagaagaaaaatgaaaagcacagacaatgtcaggaaatttcctactctcgaatacaatttcaccacaatgtacaagaaaaaaaatatagttgagcataatctttagtcagcctaatattcagtgttgggcctatttggcatataatttacttaacctacaaatgaattgatgaaataccgtgccaacatttcaaatcatacatgccagtattcaatagtattcatatattttggaagaaaaaatacagaagatatttagcagataagtatgggtagctcgcatactctatgcatggtagttaactatcacgaatgattctattaagtataccaacaaagaaaatcattcagatggttaactggacactttgggcaatcttgttaaaaacacgtcaataaggttttccaagaatgataaatatgaagagggcctaaacttactgagggtctagcagcgaacagttaaatcggttgttcagtcaaaaagctctggacaatttggaatccttgtgaacagcaagtcgaaatgaaatcctaccataccaggttctagagcgctgatcatttgctcatatcaacgatatttaatagaacaacgttgcaactctattatccacaatatggtcaacttcagctatggtgcttgattgcattatagagagaaacatatatatttaaaaagtgtgatcacagaaactattcagccatgatatcattcatgaagtga

SEQ ID NO: 66134 - DNA, 2880 bp, Oryza sativa
tctgacaaagaaacaaaagatgagttacttcttgataattcttctaacataacgacaagaatgaaaaggtaatgaatttccaagttaataatatgcccggaaaactggcaaaattgcttagtcaaattcaatatatcatgtttcgtttatggacatgttgcttattctcctttaaaaaagaaatagaatttcacctattccgagcatgtgtagatacactgttctatttgtagcatgtgtagatacactgttctgtttgtaaacattcaagaaatatgctatttaacagtatgactcagtctacatgcattcggccaatgaaattaatactttagccttcatcaacctatcaagtgtgcacatttttcttcatgatacaagcccaatgaatcattctaactatgacttgtagcttcttgagaaattttctattccaaaaagggaacaaactaagaaacatgaaagcagaattttgcatggtatatttatttgctagcgtacttgttaacttgagtataactaaatgctgcatgtgccattgttgatttgttgtgaaatacatagttagcatcaacaaatatttttccataatttacataattaagatatatcatgttcttgtacgagtaattgttaatgttccgcgtatccatgtacataacggacatcagcaaccatagtgaatattgaacaagttggcaactcacaagccattctctgtgtccttgatgtccatctttgttgagcaccttgactgcaacaggtagtgacttcagaccaaccctgacattctcatctatgtagcccttgtaaacagtcccaaaccctccttcaccaagaacgtagtcagcacggaagctccttgtgatagtctcgagttcaaacaatgtgaagtcaatcacatcattgtatatggagatgttcttggcatcttcaattttcctaggtgttgaaggatcactcatatctgatgagatgcgggtgtgcttcctctctgcaacagcattcttgacaggatgttgtaacaaatggagctgctgaactgagaagatgacatttcaacaataagaaagaaaaaatagttaaggtataaacgaattaaggttaccagaaattctcgtacaaacaaaataaaaggcaagctttttttttcatattgaattttcagcattcacagagatggatggatgaaagagagctaatcctgctgaaatacgtttagggaagctataatcacaaactaacaagagaactactggaaacgagcgttggcgattcctagcaattataatatggtattctacctaaaaatactgtaaaaaagtacatacatgggcaagttgattacagaaagaggtaaacaggaccaggagaccagatctactgcagagttgcatgcaataaaaaaagggctccaaattgcttaaacaatgcagcaaactgcaagaagtgattatgtttttccaacttgcaggatcataactctattttctgttaaactgaaagtcaacagtgcctcagtgaagcagagagcacagaaattgcagcactattgggggaagtgcctgtaaattgtcccgatgaacataatgaagcagaatttctgatacagcaaccaagaagataaggatatgcagcagagaagaaatcacagagcaaccacaccagaaagattaaggggatgagggcttccccgcaaaaaaaggaaaaaaaaagatgttgagcaaatgtagactgtaaaccaaaatcccagaatccccatatgcaacaaacagaaaaacaatgttgaacattcatatgcaacaaacagaaaaacaatgttgaagatttggagcaaatgttgatatcagattttaatcaaacctaaaccggagagtaccaaaatgccgatttggaatagccctaacaagaatgaacatttgcaaccaaaacacccatccaaaggtcccaataacataagtcatcatatatagcaaaaaggaaagacagtgcttttgtcaattccccactgaacccaccaacctagagtcctagagatcaggggaacccagaaataaccaccaagatcaattttttttgatgaaattcagatcatccaacccgagatcccatcccaacaaccagcatcccaagaaaacaatcaccgggaaatcccccaagaaatcaaatccgaggaagcgaagaataccttgggcgtgcgccgcaacgacggcattctcctctcgcgtcccgcagttgcccatctatctacttctcctcctgatgttcttgatggtggtgggtctgtctctatctcttgtagtggaggcccaagctctcattcttgggcgggggcggggtgggggcaggcgatgcctatgccatgcgccgccggtagaggcgatgctgcgtgctcttcatcctccagtggcctgtgggggggcagcggaaacgaagcttgctttggtttggtttggtgttggtttgctttgctgtgtgcgcgtggaagtgggatggacggtggtgggagagcgagaggggggcagcaaccgttaactggaggaggaagagaagaaaaggctgtgctggtgtgcgtgagattgacagacagagacagagatagatgggagcaagagactctgctctctgctgctgtttggtgtgggtctcctttaaaaagcactgccatttcactacactatggattggttggttaatcaccttttaatactaaccacatattaacaagtttaataacccataacggaattgctaaatggctgtcgaatgattttttgagctcaaaatcatgcagattactaaccatgggatttgctctgcgattcgtgctccggcgaccttagctcttctcctccaactccggcgacaccttctccaact

SEQ ID NO: 66135 - DNA, 10263 bp, Oryza sativa
agcttgcatcaagagcaaggccgggacgtggcaattaaggagctctccctcccttgttaagctctcgaaaagcaggcagatacgatttcctgcgatctgaatatctgatcctccttgatcggatttatagagattccatctcattacactgtttgtactaaactcttaactttttgtaataataacgagtggagtacaatggcaggtatgcctccaagtaatagtatagcagccaaaattgcatggctgcagaggcgtttctggtcagcaatgtgatgtcgtgtatcgtccgctacttgcatgtagccgttataagttggtcgcttcttcagttcagtttccattttcctgcaactattctgaacttctgctcactactcttcgctagcttccatcttgatgatggcaactttgtccgtcaaactaaacagatcatgttcactagtacgtgccatcagcatcagacttggtgttgatcaagacaaggtgatctgaacttctgaaccatggaatggaatgaatagttcttgcacggataaatacattcacaaagctacagtttgcaatattgcaactctgatccactgttgataatagtcattgatagtggtgctaggctcatctccgtccacgcaaacgatcaatgcagtactcttccaagaaattagtgggaataagaaaagtggacgtggcttgggacttgccacgtcggaggatatggtttgggtcccacaaaattccgtacaccagttgaacgaggacacgtgaggaaatggtggggacgggtatcctgtgatccatcgggataagtccaaaagatacggacatctacgaacgaattcaggtatacagagaatgagaaagttgaagagatgctggagctttctcctttaaacgaaagttgaaagatgctgtttgcttgcactgatgatctaagctgcatcatgttcatgtcaaagaatcttgttttgcttttcattcaactttgcacaatgaaatttggtttttaatcctagcttacgaacaagatctaattcaatttcgttcaattcgtccattgcctggtgtacgttgcctgcacgtacgagatcgaagataaagaagaagcaactcgaatcgtgtccgacgttggcctatggtgcaaatagtatgaccccacatgtcagagaaacaacaaataacaagccggctgctctactacttgggctctgggaaggatttaggcccacggccacggcgattggaaatcgcaggagcgcatgttgctgctttgtttttgctgggagagagtttagtaccacctcggctattcagctgggagaggcggtcgcgagagctataaaaggagccggagggctccgtttcaactcatacctttctcggccttttggctaagatcaagtgtagtatctgttcttatcagtttaatatctgatatgtgggccatgtgtccactttgatattaaatttattttttgtgggggagggtccaccacagtggcttgccactggggccctcgcgtgtcgcccaggcgttgcactacagcccgggcctggcgcaccccaaccaaatcaatcttaaatttgaacgacaataatgtataatgtctttaaatcggtttcaaatctacttctctgattaagtttaaaattttaatttaaaaaattagtctaaagaggtgctctgcaaaatattcatgatttggatttgtagtgttcttttgcaaaatttgcctccttccattagcgcaggaggccgcaatgaccaagaaaaagccacacccaaaatgaaaatgttactacttgtacaatagaactagattagcttatctaataaaggagtgttaacactttaatctcttcacctagctgtagaattttacattttccctgcccatcttttccttgtaaaatgcattcatgcagtaacaagagcaagcatgcagtttgatgatgattcaggaggcagcagcgtaggtgacagatgacgccttgtgcctccgcctgctgctcatcatcatcgtcttcccgccaccatccgacgaccactgagactgcgagtgagagctcttcttcgtcttcgtcttcctcctcctctccgctccgccctgcgcccccaccccgagcatggcgatcctcccgatccctcgcgagatcgacgccagcagcgcccggccgtgctccccgccgccacggccatcccgcatcccctgcctcatcaccccctgctcccgctccagctccgtcagccgcacccgcatccgcgcgatctccagcttcagctcccggttctcccgccgcagacacgcgtagttgtcccgctgcggcgacacgcacgagctcgccaccccgctgccgccggtcatcatcatccgctgcgacagcgacccgccgcagccgtcgccgccgagggaggtggtgtggggggtagttgacgacaccgtggacttgaggcggagctgctcgaagtagaggacgcgcaccaccgtctggatggggaggcggtcgttctgcgccgcgtggctcgacgcgtcctgcgacagcttctggcagtcgatcagcttgcacatcttcttgcactccgactccgtcagagatggatgagcctgtttgttatcacaattcagttttttgtcaccacacacagcaagctatacatcatcggacactatacagattgcaaatggttctaaagattacatccagaattgaaagtattcgtgccacattttcatcaacattgaataatgttgtaatgctgacagagtggcagttactgaatttgccattggacataatcagaaagagttatcaaggtttgcagtacagttagcttaccttcaggtatatgtcaatggcacggtagagtccgtcatcaacaattctcgcatagtccggtaagagttcgatgagagccatgaacttctgcagtttcagatatggatctggtgctatttctgcaaggtaaccatccatcagtcttccaaccttcagaaccgagctgtggctcggagactttagtccatcatcagactcatatccgcaaggtgataagttccctgaatcatcttcctctatcctttgcaagaagttcaccaatatgcgatggacagtgtcgacatcaaacatcgagtcactcgtctgcgttgcagggatcagaagatcatcaagtgatgccatctcaagctgaagtccaatccttttctcaacttcaatcctataatctagtcctgcatcaacttctattgccattctcagcatgccaaacaagaatgacaaggtaaccgatgtgatcttttctgttgccaacagatcaatgagcgtctccacaatcactcgttggttgtctccaacaagaggacctgagtcccatacatggcgcctttcgatacccttcagagctgtttgagcatagtgcacaatggatgtgccaatactctctggcctcaccccagttcttctcattgcgacgataacacgctgataatagtcaattcttagtgcagaaagatcctcaacccaccaatcttgacaatgcatgcgcaactttcctgatccgacatcacattccaaatgagccaagcctgaaaccagctgctccttgcttgcattcatcgcaattgcatcgacgcacatgtctacaagtccaacgtcttccactgttggatccaatccatcacaagcacataggacttctagggatttatcaaggttcttgactacaatctcattcaagtatgtctccgtccgaacaatgagattctcctcttggtactcttctgtcatttccaaatactctgcaatgcaccggagatgagccacattgacagtattaatttcaaaattactcccataacagaacttggcagcaagttcaaatgctaaagctccccctggtacatttactagctccaactttgagagatctggatccttggattcagctaccattcttcgtattcttccacacctagagactagagggaactgcaaaattggtacagaagtatactatgatcccattttgcaactttacttcagactatataatcttatattagttatgcagagataaatatgaaatacattttccttgctaataccttcctatgaaagctccttttcaccaaaaaaaaaaaaactccatatgaaagctcaaaaagcattactaatgtacaaaagaacatatacaaccttaaccctgattttcccgttaaccaattactgctttgtctccaattacacactcttatattgactaacaccttcagcctatatgatcagaaatccctgtcgacccccactaagaaagatatatgccttttgcagagcgctacatttaagaaattgtgaatattgaacactaacctacagtacaaaaaattatatgcttgtataattatcacatcagtaaggatatacattatgatttttatgtccccaaattgtaataaggtgttcacttcaatcacattggttctcatgttaagcaaattaatatggaagtcctactccacttataacattgtcaggtaattaatcttcctgcaaagacaatccaactgcccaactgagcaataaccccccaaaatatacttggcaggcttgtgcagtagttgatgactaatgataaaaaaaaatgcaacaggaaaaatgacaggctacagagaatgggtaagatgaagctattgaaatagataaggcaccttatgtagtagaaaagattggccatccaccgatactgttaaatctccagcaacatcagaaaatatcctgcacaacaaggaacattcttgaagttttagacaccaagaactgcatttgcatttgcagcatgtgaatatcaagtttgatatgcttctcatggtagttttgctacactcttctgggaacacataagaattgatcacatccctttttacagaggaatggaacaaagccatggtaactgctacagaaatcaaatagctggtgcagattatttcagtccactaagacatactaccaatgtaggttccaatcacaattcacaaatcaatcaaacatttcgtccaaacaaatcacataagaagtagatcctttgagttaaattgctaacgtttgcaatttttttctcccaaaattgactgcattttcttttaggaaagagagacagagaagggggggaaaaaaccttcattgacttgttcagaggttgagaaccagatgcagcataagaaaagagaatgctgaggtagggacctgaatctagacaagtgacgggacgagataaaaaaaaaagtgcagacgttttgtgatgcccgggaccatccgatattccgatgaacatttttaaggcttgccactgctttcttcagtaatacaggggataacttcagatgtcatctgataatctgaactctgaaggtagcatttgcgagaaaccagtatttcagcgggttcggagaaatgaactccgacccccacctcccgattccagtatttcaggggttcggagaattcgactccaaccccctgttatttttcaagggattcggagaattaaactccgaccccacttggccgagctcgaacacctccggcgtggcggggctgagattctcctaccaccattacacaaggcaagtgaccctctccaatctcctctcctcatggagtggctgcacctgcacctgcacctgcactgcagcagccagcagggtctatgcctttctctgcttctttcagagtcccagagaaatgtaacatgaacaatccaaacttgcgcagcaaaatgaacaaaaactagttgcaactgatctgaactgacaaaggacaagtttttgccaaaactagcaaactataggaacaccagcatgcactcgccattgcattttgtgcaaaagaataaaccgcggcaaaaccacacccgagctcagaaatggaagggaaaggaacagcattggtacaagttacctcctgctgatggggttgcagaagcgcggcgaggcggcgagcttggcggcggagaaggggaacgacgcagggctgtcgctggccagccccattgctcagcctcagataccaaaccctcctgcttcttctttcccttccctttgtgtagaaaagaaaagctctgggcaatggcggagcggcgatgagtgaggacgaaacaaaagaataacggatgtgtggcctgccatcattaagatactagtaatattttaaacaaatcattaagatactaataattcaattcaatgacagacattcttccaaaaatccattctttaattctttcgtctacttttcttcttgcacattgcacatttgccaaatttgccaataggcccccctgtctggctgtctctgctttccctttcttctacaggccactcagctgcatgactgcatgtctgcagataggaagaattgcatctttcaaggtgtaaattagcaaagagggtctgtgtgttggattagctgagaaagtgacactgatggaggaacagttggctgactaggggacaaaggctggtctactgtcagcttgtggatgcttcaagaattcagtcttcatctcatgtggccatactactagtgcctttgcttcttgttttttgtattttagatgtgttacattctaacatttattctttcttttctccttaataactaacttatggtatattttttactggttcccaagtatgttatgctctgtatctgttttagaggtgaaatttcacaatgtttcaagtgccatgtaactctagaaaatccatgctactgcaatatgtagcagcatgcactagagagtggagagaggagtggggttgaaggctgtcggtgaaggaaatgattcggatgctttggctgccatggctccttgtccactgatctactcgtactagagtagagagaatggacagctctaacttttcttcctttggcttttacttttgcttttgcagagaggatatcgaggagaagagctactagctttgatcgggctttgtttggtcaggtccaccatgagaaagccacaagacaacccgactcgattactcagcagcctatactgcttgttcatactccattgccggtcagaagcacgaaccgtgccattgatcatttcctctcacagattctttgcattcatgcttgtctgcctacagattttgcacatcaagcaagcatccaggctactgttgcgctcgtgcaaaacttaccctgttatttgatcatcgagaatacatatgatccaagcagtgattatgattcacttgatcatcagtctctctgtccgtgtgtgttatttccctccctccaaactttctttgtgaaaaatttcttttcagagatgagatagatcaaatggggaaagtacagcaaagtaaaatgcaaatgtgctaaagctttgagctgtttttgctgctgattgatcgatgctttcaaattcctttctgaaaagcaatttacatttgctacaaatactaatagcgctctgtgagggtcatggctctttaagttgtcttttctatatatggcaccatgtaatatcacaaactgcatatactactgtaacatgcctgcgcgtggttgactgtctccttggcatgcaggcacaagttgatcatggcagtggggagtaaaatgttagtgggctggacacgttgagacatgttggcacaaaattcgatgaaagtaagagcatattcagtagtatatgataagaaaatgtgtaaattattttatgaactattgcgacgatacggattactcctctaaattacaaaactaaatatttttcaccctcaactttttataccggatattcttcgaccttcataagaatgacaaaataaaaaaaatatctcgatgtatttctagcctgttcccctccttcaaaattgatattactctactatgcaagaaaaggaggtcgaagcgtggaagcttcatgtgtatcgtctttacatgcacggtataaagttagtagtatagatttgagctgcatgctttaacgacctcgaaattggatcaaaggcttgctttcactatctactcttgcatagtagtatgtgattaattgtacttttgtgtagctcgggatctgagattatatattattcttctgtatgtagtgcagtcgttcatgcagtaccgcgcgtgtataggagaaaatcggtgcatccattggcgtgcatatgtcctagaatttacgtatattacagtgaaattggttacttttgcctagatgtacattcagaaatccattctatgtgacagcttataatcttatcaaaatttacagaaaaacttgggaacggagtcctgtagacatcggataacttctcctagtaaatatctagccctctcttttcacaccaccgattcaatcttatcctctccattatctcttctcttaatttcctctccacacgcgcacacacacactctctctctcacactactaccctcatgagcacggaggcgacgatggcggccggccgtgcggggtggcacgtcgggcgttgaggaagctgctgtcatcgccgccgccgttgctgctggtgtaggtgtgggcggagtagagaagatcgtgaagctatttatggggtaggtgcctgagcacatgatgaaggtgaagctgctcaccatgttccaggatgtggccatcgtcgacaaggtcaccgtcatcaaggacaaggcctcttgtggtgtggatctgtacacccagatttaggcttgtgactctcgagctcttacattggcttgtttctaaggtttagtttggggttttctacatgttatatgggtgtttctacagttatgatgactttttattgagctctttgttgatttttcttgagttctctcttgatacatggatatccttttggatagtctagtgatattctaatagtatcatgatactctagtatatcacgttgatgatatcatgatacttaagtatcatacatgatacctaacaatatcataggtgatacctatacaattatcaggcatggtacctaagtacccgatacctgctacccaggtatcatacactcgataccaaggtctggtacctagtacctaggtacccgatacctactaccaggtactaggtatcggatttggtacctataggtatcaggtctggtatcccaggtatttggtaccaagttgaggagagaagggatgcatgtcgttgccttttggctgccagcgatcgacatgccattggctcttcttctcttcctctcctcgatgtctccctcattccttgcagagttgcagttgatgtggctaagcgaggaagcaagggggagcgttgctgcttcattgtgttacacgtagttgcttaggcaggtagagaaaatagaagggttcattaaagtgtatcattataatgctattccgtactgtagcagtcctccaaaatttaataacaccaaaattcgaaatattataaatcacatataacaaaataggacttgaactactcctgttagcaacggtataagcctagctaaataattgaaaggaataagttcacttgaggtctctcaatttatcgccgagttcgaaagcataaaaccaggtacaacttatccctcaacttataaaaccgtgtaaataacgtccctcggcagtattgtgtctggttttagctaacgtggcgtatacgtggctcatttaacgaggtcttcgttccacgtgcattgacgtgacacttatttgatgttgaaaaaaataattaaaactatgagaccgacatatcatctacacaagaaatacaaaatggtggggccacatatcatcctcactcctccatcttctctatccctctctctcttcttccagcagcacggcgccgctggaaaaccgccttcgccgcctcggcctcgagcgcgtcccgggcgtggtcctcctcgagctccgcgaggcgtgtggccggcaccggcggagcaaaggagtcattagggagctctcgcttgcctccgcgaagccctcgcctcgcgccgcggtggcggcggctgcgacggcatcgtcgttcgcgtactccgcttcgtcgctgcagcggcatcgtcgcccgcgtcctctgccccgtcgctgtgggggaggagaggaggaggaggagggtgggggtggtgcgctccgccgtgcccgggatcgccgcggcggggctgcacaactacgtcgccggctgcgacgaccccaccaaactggagagcagcgaggtggaggccatcgtgagcgagtgttggatttgca

SEQ ID NO: 66136 - DNA, 35384 bp, Oryza sativa
gcgtcaaatattttgggatggagggagtataaaatagttcctactgaacgttgtcggctacttgttgattctttttaggtggtgtttgttcctgtgcacaaataggtctgcacatgcacatgcgatttctcttacagttattttggtgctttaaaatgctttacgtattggtaatattagagcctagaggtcaaaaactattttgtatagagaaaattatcccacatagccatctgttgtttattcaagaaaatattctatgtatcttctgggaaccatatgtgatacacaaattgaattttatgtccattgttagagaatccatttgcttgaatcaaaattagagaatcatatatctgatggaaaattgtctttttaccaatatgtttgccttgcagattggtagttcctctcgtcctccaggcaccagctatggacaatatctatacctcaaggaagcctcttcatgttcccctcaatatttctttctgggtgcatgcactctatgcttgctatgcaaaacccaatgtatgtgaatgtgatccttatgctgcaaaggtgctactataaacacttcgttttttatctatttatttaaacattctttgttggtgtcggtgcattgcctctgaattttagatccttttttagtgcaaaatgcatatgaatgtgtggcattgatattcccttggagatgaagcaaggtattcagtgtttgcaaattaacatttacgagtaggatttacctagctagcatggcctctttcatagccacttttgcatgtatgaatcttgtgaattgtggtcctataggcaaatagaaaggtaaaattacgtgatcaactcgagctctttttcatatttgtgccactcatatttgtcctaagttttaactgtattttaatttaatcttaaattcagcccaactactcttgcggatgttatttaatgaatttggatgtgattgtactgcaagttaatctagaaattcatttccctgttttcataacaacaaaacttttaaagatgttatccctttattgtcattcaagtcagcattaagcttgctggttgaaaatttgaagtttttttagttcattctgaagtatgaagtagtatagaactttctgattttctattggtgtttagctcttaattgttgttttatctgagaattcactgctgactgctagcttaaccatctcaataaagctgatgaagacaaggtgctcgatattcagacgatattggtcaagtataacatatttcatattgaccagtgagaagcatccgaaagaagtaaacgaatgagcattgagttccagaaaatggtgtatagtatagatggaattatgaaaagcatctctttccttctcttccatctctccctcccttgattcccagccatagaatcctagatctggatggtggattggagtattggtgaccgggcattgtgggtgctaaattctcctataaacttgatcaaacttgaaaaaatttaactaataatatgaatcggagggagtagtaagaaaagtaaccaattgttgaaatcatagaggcgacatgacgctgttggatgcggatgacgatggtggctctaatggaagcaaatagtatgatgtcagcgctggtggaagccgatagcatggaggtggtggaagtgaaggatgagagtgatgacctattgctgaaatctgacagatgacagggagattgaaaggcgttttgatcgatatacatgccgatagacagggaagagtgaagacccttccagggagggcaattgactatgcaaattgcattttactccctcaaaatggtattttacatttaagttattttttggtgttggacataattcgatagtaagagattgccagtacatagatgtaccgagtagagctgtcaaaaaagctcaagactcacgagctacttgagtttgattcgttatgatcctgattcaagctcgaatttcttgggcgagcctcagcatccagcgcatgttctttctagcaggcttttcctccctcctctctcttaatttgcccgttcaaattatatatctaccagagtagcactaggactggcagggcggaagggcatactccctccgtcccaaaataaaggcaaaccctgggtttccgtgtccaattttaactgtccgtcttatatgaaatttttttataatttgtattttcattgttgttagatgataaaacatgataaatattttatgcgtgatttgtctttttaatttttttatatttttttcaaaaataagacggacggtcaaatgttgggcacggaaaccaaggtttgtctttttttttttaatggagggagcatgcatttgttattccatgtcccaaaaagagcatggctagtactggtactagtgtgtggcttgctttaacgtaggatcactagcattactttccccatctaatcatgcatcacagtgtcaacttttcaagtgaatgggatgaatctgttatagtatttcactgcaccaccaggcaggcttgagaagagctcgaagctcgaactagccgagcttgagctcagcttcaagctcacagcaaaccagggcttgacttgagctcgactcaagtctgtagcgagcttgagcctacatatggaagcttcctcgagcttggctcgttgatagcccctagtactgactcttactttccactcccttcatccaactgatctgatctgcgcataaggtttgtctactttgaccaaggataataaaaataatttccattgtgaatataagccacattgataaggttccatgcacaacagctccttcagcgtacacgtgtgttcttctgtgattctactccgacaaaaaccgtcctcacatttttatacgcatatcaatttctgattttgttttgggttttaattatgtgctgatcaaaattggatggagagagtaattattgttgttggttgactttgatgccgatgataaaattaatacccagtgataagtgctttgctatgggtgttgaagattttcaggatggttcttagttaaataagggctgtcgtccctagtcggttgcccgtgggatggttagatgggtgtatcggtaatcaattacgtttcctttgcttttagtctatgatatttagcaggtcggctactgtgtaatctaaagatgtactccctcctccgtttcgttttatttgacaacgttgactttttagcacatgtttgaccgttcgtcttatttaaaaacttttgtgaaatatgaaaaactatacgtatgcataaaagtatatttaacaatcaatcaaatgataggaaaagaattaataattatttaaaatttttgaataagacgagtggtcaaacatatgctaaaaagtcaacggtgtcaaataaaacgaaacggagggagtattatctttatgtttgtctatgtttagaacttacataaatatttcttgatgtcatcgcttgaggtgaaaatgcataactaattactatcgcgcggatatgggtttgaaacaattgagatttttgcaaaatagcatgagaagggtctcctagggtatgcgctttgggtcattgtcatcgagttgatgattaggcggtgcatgcctcggtagggcattaacatgctcatatgttaaacatctcctttggtcctagtttggcactgtgcttgttaaaccattaattgttctaggtcatgtacatgatgaggatgggtgctattctttttatggatcccatctatcaaatataatgtgatggcacatgttagagaggtcagcggtatagtacttgtggatctcggcatcctaaattcatgaaattttggcggtacggtatccattatttttggtataatttcctgaaattttagattagtatttcgtagaacaaaagtttgaaaggttcaattctaattgccttgtcttctaactgaaatttggttgtaaattttaattcagccacataaattcataaacaagcaatcacatcacaacttcacaaggctaatctattttcaaggtaaattaaactagggacgttacagaagtactcaccctttgttcttaaatattatccgaaaccgacaagggtaatgccgagtttgaggattgtgcctgatgtcttaaccctataagttgcctatgataccttagacagatgctattatttcttttttcgtagcttcttcagtttctactaccttcgtcccaaaatgttcttacctagaaggctaggactgttcagattagttattctaggatgaataacatatctcattctaggtagcaacattttggaatggaggaagtagtaaactgtgtaagacttttcaactttatcagacttaacacaaaataaaaaccacagtaattgtgtgtatgcaacatattatatttcagtggtatcaattttttttcgaaagatgcccatcctattctcaactttggaagattagaccggcataacgtctcggtgttgaggggtatatcacctaccactaccactgaaagaataatttgtcataaataagagcactgttggtatttcttatgaccacagataaatctgcaagcacacggaataccgctgtagcacttcaccttcgggtgaccccaaaaggatatcgaactcagggaacgtgtgtaatctacctaaggctaagagaatccaaggacaactataggcaggcaggctagagaggactttctatgtgctttaattatctacgctaagcaaggtaattccctatctgttgcttcgggcaccgacccctactggtctgctagcgtggttccggctatagctctatgatgtatccaaacgtggaggattactaggacgggattcagggctgtcaccacttgccgcctacctctgacaaatccgtgggatacacaacaaacaaaggtaatctctaacctaaacaccacgtctaagttattaattactactctaatacttgtacatgaacttccttctttatccagagtcctagtactagagcacttagtatgaatactaaacaatgtacacgcaaagatggaaatctatcttactcagacaaagtaattaaataatataagaaaggaacacgaatgcttactttatagaagaagttcttcgaacccggagcagagtgtatcgacagctccggtactcctctagaattcctcctaggaagctacactcgttaagaaagaagtcggagagggcgccaaacttccgggcactcctccagagcttcccttcactctctaccttattctaatgtaaaaaagatacaatagagtctcatgtaattcagatcaaagttgtgtactggaaatgagagtgagcttcctccttttataggcaggtatgacggttacagcctatgcgaaatgtccaaaatgccctagaatcgccatcaggaagtaatcagggccgtccacatggaaaatggtgatcaacagcgccagaacaggtttggccgaactggtgggttcggccgaacccaaaaacactcctcccggcctcttcttcggccgggagattgcttaatgggcccccaataacctgtgctttgttttggcccaatcctaaatggttttcattgacttattgggcctccaatccgtgtaaacgcgtcctgaatgcgcggaggtgcattttgtcgcatgactgatgtggtttctcctcaaattacctgcatacgcatatttcacctacactagtggaaatgattagtaataatatctaccactaagtgagataccatgttttatttatatgtaagtattgacggtcaaatattatgatttaaggaccatcaacaagcacccatgctaagtttgggatttgaatctaagaggacaggtcccaccacaagataccttaccagctaatacgctacggtcagttctccagtgggatggatttgtggttttatctactgctatgcgaaggcaccaagcaatgtatgtgtgtgctgttaatgcagaaggttaatggtcctaaaacaccagggcctgacatgacatttctatagtgcagagttaattttctcattgattctattgtaacagggctgatggtctgatcagaattgagcagtccaagtagctagttaagtcttctccaactacttgttgagctagatagtcagattgccaggatcatatgtttttagattctgagttggaactagttgttttagcttcgtagagtacatattaatagttctagattttagtttacgtacacaaccagtcactactctttggctgtcgtagatatgaagtttctttccaaaaagaaacagagccatgcatggcatttttcatagccacaaaaagataagtgcaaaaaaaaaaccgcagaaaaaataatggatggacttgagaatgcgaacgtagcaacatatgcacgtgcatttttttttggctgtgtatatggacatagagcctagacatatatccattatctgaaaaaacgcacgtgcatttttctcaacagcaaaaaccatgtagtttccagtttcctcgtactctctcccggcaataattggtgactgcttccacttttagctatttcctgttcacggtaccccacatcttttgctagcatgcccctacccattcatattgaagctcatagagcagcccattgccatagatgaggaccagatgacgaaccaacaattaccatttaaaactccataaaatacaaaagggaagggatgatacgtactttgctgaagagatggcagctcctttgttgttatcaacaatcatttcggctctagtggtggtagcatcctctactcgtggtaccatggctaatggtgtattccaggtgcgccgcaaattccatatcgtggacggtgtgtacaaggggagcgacataggtgcattacaaatccatgatgggaaccgccatcgtcgccataaccttatggcttcggagctcccacttggtggcttcagcatcccatacggcactgggtatgctttaatcatctctgcctttggtcatgtctgtgtttgcttggttggttggtgtggttattagggataacaaatggatcttggcatagattatactacacagatatagggatcgggacacccgccgtgaagtactatgtacaggtggacaccggtagtgaggcattttgggttaacagcatctcctgcaagcaatgccctctcacgagagcgacatattggtaggtttccttctagtgtttctttagtttcagtccattaatctgcttgcaaaatctgctttgcaaaattgctttgtaatatgtttttgtttttgtcatgggtatgtgtatctgcttgtgtgcagagaaagctgacattttatgaccccaggagctcagtaagttcaaaagaggtgaaatgtgatgatacaatatgcacttcgcgaccaccatgcaacatgaccttacgttgtccgtacatcgcggcgtactctgatggtggcttaacaatgggcatccttttcactgatcttctgcactatcatcaactgtatgggaatgggcagactcagccaaccagcaccagtgtcacatttgggtgagttattaaagaaatagcactgctacacgtactaagtttttcttactaaatttttactgacaatcatcacaaccgtttgatttagctaaatggaagttataaaaaatctagatgcactcatagcatgacacatcaatgtattacaaccattttcgtacatgaaatttattgatttacaacagaagtgctcgattgtaaaatgccattgataagcaatagttcaacaatatgttttccatacgtgcaatactctttcatttttaccatcacatcatggttaacatcaaattatgtctctagtttttataaaatgaccaaaatatcattgagaacatagttatacccttgacagacttcttttgttttttacacagtgaccaaaacacctttgataactctgttacaccctcgacagactttcgtgagtgcctgttgctgtttatggtgaaatgaactttccattagaggacaacataggccccttaatggttagttcacagcgatggagaaaaggtagaaaaataacatgtatggtggcataacatataactcatatttataagatcgaaacacaataaccaaacctaccagagagtggtgaatggtacatacaccaaaaaccaaaatggaataaaaataatcctctaaccttacagagtccacgatgaagtctagttgactaacttgtgtgcaccggtctgaccactctagtcctgtcggtctgaccggtgtagagtcaccggtccaatcgccttgcttctcccttcgcctgacactgccggtccaaccatctaaaagttgcctgtgtcaccgctgtggcgccgccagtcagaccgcaaggatgctactagtctaactaccgaaacaaagaaaaacacaaatcaaacaattttttagaagtaaatcaactttattgcttctaattgtgctcacaaagtgtaacagtaacactcatctatcaactttcgactatactcaaaatttaggctaaacccttttttttttcaaaactgttatctcacaaaatggtaccaagaggcctcaacccctcttttttttataccttgaagtggctgcacaaagccacgaattcaacatggataagtaattctaatctcatagaaaacctacccgaacaagtatacaacttatccctttacaaatcaaactccaatcttttcaaatttggactccttccaaatttgactcatatttgttgatggcatttcatagagtcgagtggttgcatgttgatggcattttatagagtcgagcactttcatattgatggcacttacaatattccttttcatacaaaagacatttcattgcactagtacacagtaggcaaacactgccggtctaacggttactatagactagcagtgattaactatatataatgccggttcatgctggcttggatattttttccctaccaacccatgtgtatgggctatgatagacctagcatcactgtcggttcatcaaccggtagtggtaggtgaggccaccactgctggatgacctcttctagttcaaaaactgatagtgatgcatcaactacgaaccgatggtgattggagtttctgtagttgtattgtcttattaaatctgaagcattattttacagcatcacatggcaataattaaaccatacatatattttctgttcactattgtctgtaaggtgggtatgctgtattgattgtcttttattgtagatattcttttcaagaagtcgtactatataagtttgcccacttaggccctgcttgaaattgattattgactgtatttttttatggattatctactttgattatagggatagactaaatattttgagaaatatattcaacagatagcttagaacaagtggaccaataagtatacatgcaatagaggaatgttcaattttagaggcgttgagcaaatccatggctataatccagagaaggagcagaagagacatggcataagttaatgctcctgtggggggctaccattggatgttgcaccacacaacacactagttctttttcatatgaatggtcctgtggggggctaccattggatgttgcatcacacaacacactagttctttttcaaatgaatggtattttattgcactagcacacatgagctaatcactatcacccatcactacgggttgccatgcatagttccaacaattattgactattaatgccatttcatgccagccgggttgggcatttaccaaatctatatgaattcactatgatagcctgagcatcgctgtcggttcagccaccggtattgatagccgagatcactagtgtcggctggcctctgctggtttagaaattggcgttgatgccggttatgggttttgtgtaaatatatttattttcttttcatgtaaatctctgatgaactcatcacatgacaataattggttatggcggtcataggtatattttgatattttttatgccttgttctccataaggtgggtaggctgtattaattgtgttttatcgtagctgtgctatctaagaatgtgtactatataagttggcccactaaggccatgtttgaaacaaattattactagattatttttgtggattgtctacttgagaaacaatcttaacaaatggcttggaaagtaatctatcctatgcagtagaagaatattttttagcaaacatatttttagggacgtggggcaaatccgtgataataattcgacgaaatggctcccctgtgcttctaggtgtggtttaacaacaaactggaagcttaaacaattcagaactagcgattgatggaattattggttttggcaattcaaatcagacattgctatcacaattggctgcagcagggaagacaaagaaaatattttctcattgccttgattccacaaatggtggtggaatttttgctataggagaagtggtggagccaaaagtaaaaacaacacctatagtaaagaataagtgagttaaccatgtacttctctgctattaattattatgtttcttttatggtcacaatttaatttggatctactttaaatacatataattttaccctggttatagcttcttctggtatacttgtttaagaagcatttatcaaccccctaaaatatgatgcatttatccacttaaacatgaactgtgtcaagtggtacatctctggtacaaacattgtgaaaaaaaattatgtgttattgttcttgagtgttctttttaggcgcaatgtttcaaagttttgaatgcacagagctatgtgaaaatttatgttggctgtcttcaacatggactgaagggtgctgttaggctggaatcgctagaaccttaaactataattttaaaaaaaacctatttatatactttagtacatgatcttggctctccaccagtccctgttggatgttgggtttatgacaagtagggatatatgcatataatatcaatttgtattgtagtgcacgtatgccttcttacatgttgtaaccttttgagaatacatgtctttctgcgtgtaacccaggctcgtgattccaacacaaagatcataaccaaccttgtttggttctattgttgtttccaccaaactaatgctatagtatccattttgaatctgtataataatcactagacccaaagcatggatttacaaatttgtgggaatatgtatagtttttatagaagtacttatcatgtttatctgtatcttctgaaaattaaaagcagcaaggcatctggaacttttgagcccactcacacaccacacacactaactcacatcaattcactattctatcacatagtgaggtatattaccttgtgaacctcaagtcgatcgatgttgctggcacaacatttcagcttccagccaatatttttgaaacgaccaaaacaaagggtacattcattgatagcggtacaaccttggtgtaccttccggagattgtatattcagaactaatacttcttgagattataggcatataatgatttaatttattccataaataaatcatgacattacagatgaaaactagcatgaacgcatcattagatctacacatgtaaactacacagtataacatgaacagattaaatatgcgcaacatattgaacacgtaccgaggtgacgaaaagaccggctgcttggtcgaaacttttcgcaggtgtctacgaaggcacgaaacacgcgagcgaagaggaaggcgagccgttgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggagggcaaaccctagattgatttcgcgtatattgcgtgaagacagcgggtcgggttatatagagaaaggtcgcttgatcagggcgcccgcacgatctctactgcgcgtaaccgaaccggataagtcgcgcgtaacttatccggactccacgctgtttgcatgcaccggatttttcggaacgtttccaaaacaaaaccgaatccgaatttgcagcaaaacaaaactgcaaaaggaggctgcatctgcacaagggtgaggagccaacttttttcggaccattcgacgcgtacgtcgtgcacgcgcgccgcctgccctgccctgccaggccaggccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtagagcatataagtcatactcctaggtctttagtaagcttcctagaagattcacccaaaatcttcatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatatatattggtactctcctctagtttactaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattattcgctcaagcgcacgccagtgatcatctcccggattagaggtaaatcggctcaacttgctcacagcaaaggagatatcaggcctagttgcactagccaggtacatcaacgagccaataatttgggagtattccagttgattcctagcaattctattgttcttgcgaagcaacaagctaggatcataaggtgttggagaaggcttactatcaatgtagccaaagcgattcaagatcttctccacataatgggactgcaagagtgtaatcccattctcacctctaattagcttaatgtttatgataacatcagctactcccaaatccttcatatcaaaattttgagacaagaatgatttaacctcatttatcacctcaaggtttgtcccaaatatcagtatgtcgtcaacatacaagcacaaaataactcccttacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaataggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaaatcccgttagcgataatggaatccatttcactacggacagcctccttccagtagtctgcatcaggagatgcatatgcttctgaaattgacttaggagtgtcatccacgaggtacacagtgaaatcatcaccaaaagatttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccagtacttcggatttaactattaaaaatctataggcaatgctatgatgagcatatcccagaaagacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtctaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcattttcaacaagtacacatagcaaaatgtagtagcatcatcaatcaatgtcatgaaatatcgttttccacccttcgtcaacaccccattcatttcataaagatctgaatgtaggagttctagtggtgccaagtttctcttctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaataccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctatcgatagaagggacatgctgcacgttcttcagctgcacgatctttcccgaagtaaacttcagatctaccgtgccaagaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcgctggactgcccaccatcgctcttagacgcggcatctttttcccgagctttctcctcaacatcaagagacgctatcaacccctcaacggagtattcctgtctcttgtgtttgagtgcagtaccgaaacttctccaagatggaggtagtttcgcaataatgcacccagccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccggaagcatttcatagctgtcagccacagagtgacccggatctgccatctcttaaaatgcacaccggtgaatttatccggcctcagtgcatcggcaaaaccagccatagtaaaatcacagtgcctataataaggtttttggactgttgagattataggcatataatgatttaatttattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgatttcgcgtatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaacttttttcggaccattcgacgcgtacgtcgtgcacgcgcgccgcctgccctgccaggcgaggcgaggcgagcgagtgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatacttgcggtatggcaaaagacctgctattcttttctagtggtagaattgtttgcaattacgtttacatataactctcaaccaattgcaggtatttgccaagcatccggatataaccttgggtgctatgtacaattttgaatgttttcattttcttggaaggtatactctataacacaaaatctatagtgcagagacattatattcaccaatggactatataccagaagattcattggattcatattgagttaattcaatcttttcaatgcctctgaattccactttatccatcaaataactccaatttgttagtagtccgctaacattaccactgttttgatacccaagtatcctatccatttgttgaacgtgaggaaaaccagtaattctctaaaaattcccattgggtcataacctaataaagaacgctgcctactcaaaccgaagctttgttatgtacaattttaagtcttgaataatactctaaatgggtgaagttgcccaaattaccaaaaccttagagtaaaaataaaagtaaaagaaactttcgcttttctatatgagtttcagacaaaatataaggtacgatggagaagcagtagtggaaattgttttcattatacgatttactcggtaaaagacacataaactgctatttcatctgctacagcagcaaaacctatgtcaaaagtgcagtaggggtttatttagagggtttcctatttatgttgggattacttagactgttccatagttctgagggatggggtatattatatgcaacttagtcttcagatggtagaatataattattccattttactttgtgattattctaactatgttgttgttttcttgtgcagtgttgatgataaatttccaaagataactttcaatttcgagaatgatcttagcctggacgtgtatccatatgattaccttcttgaatatgaggtaatgacatttcacccctatgctctaccaaagttggtataacaatttgttcacaaattggtattgccttgtcttattaattctgacaacttaacacttcaaacttgtcatggccagaaaataccttttccgaacgctagtgcattaatccccgtcgtaggaaaatccgtggtcaccacaacagacttgatacaaaagccacatctttattaattatcacgatgatatctatattattatataggcacattaggtctgtcaacaaaagaaaaacaacagcggactagaggatgtatgactccatcttcacaggcgctcaacagtgctataagctaggactccacttatgacttcttcaaagcttgtctgactacaggatgaaagattgagtaagaatgagtgcaaccaccatactcagcaagccacaccaagaaatgcacacataatgcaaatgggtacaaggaataatgatacatgttgacttttgcataaaacccatttttaaatagtttagttttaaaacacatttcaaagcatgatcccaatctagtcaaattttttagtcaagctgcacacttgcacgaacatgcgttaacccaagccatcaaattgcagttccaatcattccagtttaattaaataaaatctctaacttgggacattgctaagcttgcccataaccgagggcttggctattcgaatagattatactctgatcatccatgtctttttatttctgaccatattaagctatgagttaagccttacccactagacatgtggttgtaaggaatatgctttgtaacataggtccgaagaacgatccttatatatgatggccaaggtgcgactaacagaaccaagcacattgagcccaacctaaaacaagtttgagaattatgaaaagaagtccaacatgtgcaggctaacaacaagcctctaatccaccattaatcaagattatatggttattcccaaagtctagatcattaggaaacaactatatgtttctcttagagcattgctaagcataatcctaaaatctctaataagcaccgcacatagagtagtcactagatagttatggttttctagggttgtcaaaggtaattactcaatatttaataaataaggcaataacaaaaaatataggaaaggctaagtaaaacagttataacacaataaacttaataaagttgacggagcttagggctcctcaccgggagaccgcgcaggcccccctttgtcggttcggccgggggcgctgagtgaggttcttcgccctcgatctgaggaacgtcagcgagaagaatcgcacaagacacgggcgacgtagacaggttcgggccgctgagaagcgtaataccctactcctgtgttctggtggatctgtgtgtgaaggattacagtgagctcgagagcgagcgagagtgcaggctcctcccaaaatccctctccctcctccttaggcctgggcctccttttttatctggttaggggtcaccacatgggcctctagctgcctaagaaaggaaacattctttttataatgagggctagtctacagccggaagtgacctttgacaagcagagcgcacgtctcttgccccgctcgtccgcttttccgggggacgcccatttcaaccttcatttaatggccagcgatttccttgccatgcttgtgctgaagcctagaatggatctgaccgggactgacataccaactccaggagtcagcacgccagctccggctagagacgagagccaggaagctctcatcattctgacgggacagggcgaggcgcgcgacaggccgcctgttgccacccatcccgcgatctgaccgatctgtgaccggtcacataccgcgactggtcacggaccgggtaagcatgcgctgcgccgcattgaatgcggcgtagcgcgctcgcctaacctgctataaatgcggttaggtgagcgctgctgctcacctaacctacacacgtggcgccaacaccgcagggggtcggggcgccccagccctcggggccgaaacgggagcagcccgacccctcggggagacagagagaggggggggtggccacgtcaccctcgggcccgaccccccgagggggtcaggccacgtaggcgaccgcggctacccaagcctctagtcacgatacccccggccccatgtcaccgacaaaagtgaatgcaaaaatttaaattaaaatactttccgtaaattgggatttgataaggagagtgtgacttcccttgctcaacgaaacaaacttctgagacttcagcaacgaacatgaactgcatgactggaacctccgaaatgacaacaaccataggagcaacaaaacaaggccacaactctaagaaataaatgataacaagacataaaagcaacatacatgggtaatttaagttataacaaaagttaaactggtcaagttggagctcatatggccaagatacggccatccaaaatttaactgtagtttaaattaagatttccgaattgtttaattattattgttcccataaattatgtgtaacacaacatcgctcgaggagagaaagaattgagtgactgacaaccaggacccacgggtcagacggctagttcatcgtggatcaggttcaccgagacgatccacgggaaaagtgcacctacgtgtaagcctcagagaaaagactgaagactggatcccacatgacaccaaacaagcagtcacgtgcgtgaaaacgcagctacatgtggatggagacgataaccagcgactgcggcacatgaccggtagtcacctaaggcaaggaaaataggagggaaagagcggaaaccagattctcgccacaaacatgtcgacaaccgaaatagcgaggagggaattgttggcgaggaagacaatggcgagcttgagcagccacgacagcaactggtcaacgacgaggggacaacggagggattggcgctgcggacttgagggagatggtggtgagggtgacgacgggaagcacttggacgaggaggggacagtggctagaggaagatagtggtgatgtcattcgggtcgatggcgcgggtgcgttccgatggtcttcacttgacaagaacgcacggttgaggaagaggatgacaagggaatcgaaggctgacatcgaagggagacaagttaatgcagcggggcggtgctctggcaaggcgggagggactgccaaaggaggaagaagacggcgttcttctctgatcactagcaaggaggaacttccggcgatctccaggcaaaatggtggggttgctgggttataggaggttaatccgcggccaggggtggcagcgctgtggtcttccgtacgtggcttgggtcggtctactggaaagggcgccggagctcgccggcgcagtcgagatgccaggagagcaagagagctcgaggtggctgcgaaaatggatggaagggaggaagacgacgccattttataggctgggagaggaaggaggggaatggtcgtgggaggagccataggccattaacggcggctatgaattgggaggtttcaaatccgcgatataaagccaaattaatagtggggaaaatatggcagaattggacagatgcaagtagggaaatgatttttgaaatcaatttggaggagagacgtctggcaaggcagatcaacctcggtggtggtgctagtgctagctaggagagggaaactgaactagcagattggaggcggaagacgatgatgcaacgacttcctgggctagctgggccgtgcccacctaggccgagcaagggaggcccaggagaaggaggggactttgctcatgagccgagggaggaggacaggaagcagatggatagaattggcccaaagagaggacatgcttgtttttaggttttttattttcataaactctgaaatttttttgttgcattaaaatagtttaggatgctctgaaaaaatcaaggaaaaactgaggtgacattttagagcatggaggatttaagaaaggtactctaagccacattcaaacttttcttgaacatgttttagtgtatgatatttcttttaagcttttaattatttctattattcattttagaatgtgactctttaatttgggatgaatttatcaacacatcacaaaaatgaaacatgaaacaattatatgatgctaaaatagttcagagtccaaccatggattatatcccatacatattgcgggccacatcttgtgctacatagatatatgtgctagtcatataatgggtacccattaacaaacattcgctaaattgaatatatatgcacttcgtgtcatatttttttcttaattgtactgacagagtaacttaggctcatcgccattggcagtataatgtagagaattgtttaattagttacaagagagataataaataatctatatacattaaatagacgatgatatctccaaaagtaactgtacggtttagagtttcaccttcagctgtcaaattttagttcttgtttcatacgtgaagagtcccattttggtccaagtaactagatgcaccacataaccaattgataatctccatgaaaatgtgtagaggacaagagttctgacttctgcaattctcaatcaactgacagttagttatttcagtcatgcatgctactctgtttggtatacatgcttttgcttaatattttatagtgcaagtctagagatatatgttcatcacacttagacttgtttggagcagggtaaccagtattgctttggattccaagatgctggaaaacagggacacaaggataagatccttttgggaggtttgcatatatcactgtccaaaagaaaattcctttttcatatttttttttgtgctagagccattgttctgttttttttcagacatgatcatctcaaataaggtggtcgtctatgacatggaaaagcaagccattagctggacagagcacaactgtaagtttcaactcgttcaaattttatcaataaagtgtggtagcgagggcctcagcccactaggaaggatgcatggaggcttgtagatggaggcaacgaataaagacattggcaaggagtaaggagtatgcattggatgctgaactagctatacccctgcatcttggttgtgctagccatggcaatgatagtgttacggctacaatttaggaggtgaacgaggttgtgaaggttgtacaattgccaaactagtggccaaggccctaccaccctaggaagctgaggcaccaggccagagtgagaagggaatggaaagagaaaaacctttgtttatccctttgattatcctccacaatccattcctttttaggggtggagttactcttaatagtaaaaaaataccaattagggacaccaaattaaaatgaacttaagcttgatcctggatgtgacggctatgccgttggtggctggtgcatcttggatcgcagcttgcaatggtggcaagtaattctaacaatggaagcacttcagcacactgcgatgtcagctaacagataaaggtggtaggccaccttgttgatgaaatgcccgagacttcataagggctgaagtaacatggacgttgttaatggactatacccgcctacgatattttgtagagtatgcagatcgttgatgctagtgtatacgcgagattgaggtaaaagagatgggagacaaggaattttatataggttcaggcaccttaacagacaggtaatagccatactcctattgatctgtctagatgtgccgcctctccttttaggaggtcttgtatttatatccctgggtgccccttgtccaagtagaactaggaagacaagtttggatgcaatccgactagtccttatagtgtccatgtaggactttgcttctctttccttattcggaataccttccgtatatcaggcttgactccgtataatacttggtatatggtgggccccgtcaagcctaacactaaaatatcatgtatgtcttatcctcccctggttgttcatttggacttggacactcatgccaaccttcttggtttgaaacgttgatggacatgctcctaaccaaaatccgtgcacaggaagagacgagccttggcctccgtgaacaggaagcaatgcgcctaaccaaaatccaccaaggattgtagtgtggcattcgaatctcgagcaacatgcttttcccatgcgaagctacaccaaaatttggttggggggggggtcaccacttgcttctttactctgctttggactgagtttaggcttatgtaggtgcctgggttttgaaggaggagagtgtacatatggtgaaaatagacgaactatagctaaaaatgtggatttagttcggagggaggtgggagggggttacaaatggtgaaaatataccaaaatagacgaacccgcttgtgcagtcgtagatgtcagtcacgacagtggtcgctgccaccatgctgctgattccccggtcacagcttggctgtccaccgctattgcactgacagccgacaacgttagtttggtcaacgatcatgatgctgatgaagtcgctaacgtgcccttagtcatgacgtgtgcagttggtggttgtctcccccagattgtctagtttttgaagatggatgtcaatactcataacttaggggatcaccaagaccaatgatgaagatctgtggctgttagtccgaagtgaaaatgtggcgcaccccttctgagaagtgtggccagcatggttcgccctcctctttgtcgaagtgtatgttctaacattgagcattgccaatcgtatggtaagaacccagccatagcatgtcctcctccatgaccttgcacccgtggaggaactgctcacatatcgaagtccaggaactctaactcgttgttccgcagaacaccactgccactggtgctctgatcttggtttggaacaaaagactcctctcctgtgccgctaccagagccatgcttcttgatgtgtggaaggtggagatcgtggctctctagtattcggttaatggtggatagatgcccccagacttcatccatcttttgtgaaagtggagatcatggctgtccagtatgtagattatggtggacaactaactcaagacttcatccatctcggcgaagaggggtactatgccttcaattgtcaacatcgagatggtggcggcgaaagagtgctctaataccaatatattatggatagaatttaggtggtgaatgaggttgcaaatgttgtacgagcgtccaataggaggcttagtccctagtgccctaggatgctgaggcaccagcatgatgacaagggatcatcatgctgtgaacacccgtccaaggaaggagatagtttcttcttattccttatttattggccaatagtacatcaaattataacctaattaacaggaaattaccaactagggatatgacaaactaaaaggaaacttgctggtgcacccggtgtgcccttggattgctgcttgcgacggcggcaagtaattatatgtaggtcagttcaagggatcagcgaatgacctttttttaaaccaactctgaaaattcacaccggagttgaacccatgagctagtaggtgctaccaggcatataagtgcaaatactaggctgcatacccactcgcaacaacggttgcccatattttcttggacgcatgctttaatggggatctaacatgtgatcaaccgtgcacagacgtgctcccccatcccaacgcacggctttgccccccccccccccccctcttatcatatggttttcaagaaagaatttaatatatttttagaaaggaaaaaaatactaacaaaagaagaaaaatctgctcagacatattcatgtgtataaactttatacacataaaatctatgtgtataaacattcaatgcagcaaaattctgtatgaaatatttgaatccaattgtcagacatttaaaatttggtctataaactttatgtgtataaactttgggtgtatgaactttgattgtataaacttggtctataaactttgattgtataaactttagctgtacaaacattccaaattaggaaagcatgtagagaaaaaaaagtggtgcccagaaagaaagggcaacctcctcgcgctgatacatgagcatgggctcgctgaattcgggctttcctgcctctggtagccaccaaataacaaagagaaaaccaatgtatgtctagagtttattaaaagggattgtttagattccttgggtggcaatcctatagttctaataactccactcttaattagtcaaaatatagtctctttcatatggataaaagttcaaacaacaaattccagacctaaatatgacaaacattttcaattcctaaaactttacaaaattatatgtagaagtattcaataacttgcaaaatcaaaaaaaaaatagcaagtataattcagtattttgaaacatacgcacaatgacctacaaataaacaactgacaaataaaaagattcttatttcctttataacaacagacaattgaatttcctttatgtgaaacatttttccttcagtggaaaaagacggaagttaatgatatagtagtttccatcctagacaaacatgaattagaagaaaatattttctatatgaatcaaacataaactgaaatagtagtttctattgtggacaatcttgatttgtattttagcatttaccgttgaagtcaagtaaacattcccagtgcctagcaacatgaacataaataaagaaccgaagatacacttccatgactataagtggcacttaatttatttaaggagaataacatcatgaacttgaaaagatggacatataagaggattaatagcatgcaacaataataaacaataataatgatacacatatggattataaaatagttaggtcggttaaaaacataaaatagatattgtgaattgaatagagtaaaactgctgaatgatcacacataaaacaagttcatgtcacaattaacttaaagatggtaatatcccaaagtcttatcagctgtaccagaacccttcaaacttaaagaacaaatctacttcttgtcaggctcgtgaaaaatattacatctaaaatggtcaatataaattttgaaagcccaaaaacctgagttctgagaaactagcaaaactatatatgttcacttattgttcttgtcataacttttaaaccactcaaattatatatattaatttacattgcactatgttggcgagtggcctcacaagtccatgtaggaggcatgctgtcatggaggagaggggaggtggaagcagtggctcgcagtagtgtcagggtacactcactgaggcacattcctttggagaataaaacgatgctaaacaccacagaggaaacggcacggggagagctcagtgggggcaagcatctccaggtgtttatctcattgttggatcagtaccacagccaccctgctgctcacgttgacaccatatctgcaccattgttgggccagttgttggatctgcattgatataaggcttatcggccgatctctttgccagatctgtgccacagccgtcaagcgtgacacaccactgccaagcttatcgcctgatctgtgccatcaacatcgtccttcagccgagcagccctcggcaccacagagctcatcagcccgatgcacaaactccatggagtgctgctcacgatccgtcatccatgttaccacaagaccttcaatcatgggaggggacggttagtgtggggaggtggtggtgattggtgaagagtgatgactcaaagctttgaagtaaacgaggatggcagcattcacagtgaatcgaagtagttggaggcaatggcagtggtgatttgggagtagaggaggacaacgacggtcctgacgtgagagtagatgggtatgcagggttatgggtaggctatgatagtttaaaagaaaatttcttaccatataaaccaggaaccacgagatgccgagcagcggaacaagatttggagcacagcaaaccggttcaacaaactgtcggacaacatatttgatgtagtcaatcccaacaacttgatcatatcctcctcgcattaacattttctcctcgcacctcacactccataggagtgactactgctatccacacatctaggcgtggaacgttgtgtgcaaacacgtctacctgcagctagtgtttggctcatgagtgcaagggcggctagggtttatcatgatggttcatgtacttgcatgtctcatttaccccctcaactgttgcccttgaatgcatagaacttctaattggacctccaaggaccattaggacgcttacctagatccctatccatatggagccactattggatctctatccaatcaagtcatttcaatacattaagtgtgtgaccctataggttcgtgtacacacactacatatatcataacagacctagagacttcctttatagccatctagttacgtgcagtagcatttaacaacctaaagttagccaatatgcttgttgagaatcatgataccatgtttgatatacaatcaaggatgatttagaaatagtagcatattagatgaagagtatcacaaataagtcacatactcattgatcaatagtaagttatctatctcaaggaacacttcattataattctagacaaagtatgtttcacaatcatctctgtgattgcctctagggcatatcaccaataagggacaacaacgatgctggtgctttggaggaaatggggatggcgatggtgttagtgtgtaggcagatttgggatcagtgtccaatgtgcggtgagtggagtaattgtgtgagggagatagatgagggtaaggaaaatgtgatgctttcgagaatggccagtgggacaagggtaaggaaatggtacatgtatgatagtacttagtgccataaggtttgtagtgtaaaatttgaacatttttagtaaataaagggactaaaagggtgaaatagttaagggttggaatgcaaaattttatagaggaagtgacttgtgcaatagtctcatctacggttctacgagtcatgttctctcctacagaaaccatatttacaaacggtcaaaacataaatttgtaaacaactatgaggcccacctgccctgaggtgtctatgaaaattggtattttcccaaacaggtggctgaaccgtgtgcgaaaacagattttttgcataatgccgtccatctacaaaaaaataaaaaaaaatccagaaacctgagctcccattcgtactgtcgtcgtcgccggcacagtccaatgtcatcgtcgctgccccagaagccgttgccgcctctcctcagcactcctttaccaccctctatagatccacccatcgcagggcggggcggtggatcctgcacctccactgccatcccttgcctttccttcaccagcatcgctcctgagactgggacgagtggatcctctccccttgaagcctttactattgtcgtagtcaccgtagccacgcagttgttgttgtcgcccatcgtgttgtcggcagaggcggatcccgtagcggggctgcccggtgatgatggatccgcctctcccggggccaagggcggtgccacctaatccgctgccttgaggccgccacctccatcactatcgccctagtcatcgtcaccccttcctgccgctcctaaggacggtgccaccacccgttggtgcttgcttgcacgctcccatcatcagtagagctgagaggagccaaacgtggtagggagaggaaggggggagtacggagaggagatgcgggaggagaggtgatggacgggggagtaaatcataaaggaagtatgaaccggctgggtgtgaaaacttgcaggcgggcctcttaattggaccatcagcgaaaatagacctattttttaaggagtgtctcttaataggtctgtttgtgaaaatggatttttgcatagggatttatactggctgcttttgatgtagaattacgctgcgacaccttgagcacgttatatgcaacctgcagcaacaccctgagatgtgcctacgtagagattgggtagatgccgctgaacaaacacttgggagggaccctgtcagggtgcatgtgcaccgttttgtcctaggctcagcaggctagccaggacgtcctataacaccatagagacaagagacgatgaataattgggggtttaggagaatagactttggtataggtagcaaggagggagatgaagaatatatatggtttgggtaataaattgattttgacgattgattggttgttgtttcaatcggctttagcccaaatgaagaatatatagggtttgggtaataaattgattttgacgattgattggttgttgtttcaatcggctttagcccatatatttataggaggattggacttgctccacagggtccttttcacgtcaaattagatatataatatcaagcccaagtaagaaaacccgtgaaccactaaatcagactcggaatcagggtcggtctaactggcactgtggcagcagtcagacgggcctgtttttatgtcctctttaaaaaaagttatgttcagaaaaatcggtttttatagtgtctctcccagaggccactcctctgttgtaaatgtgctaagaggatatccaatataaaatagaggcaattcattttgttaactctattttatatcaatcgtgtaaagagttaacaacaagaattgctaccaggttttggatcctgtgagtttcaattataacttttaaaacacttaccgaatagaaagaagccagttttcgctagaaatatatcatcaataaaaggactaactcccgtaaaaaaaaaggactaacttctttttagaatacaaatcataattctctgtgaataaataccatatttcaaaacagtactttatatggaaaaatgaatttgattaactatttagcaaccaatagccattcctatttcaaatttatgcatctagcagcaggaggtttacgaaaatgctcgcacctggacgaccgacgggtggagaaaaatcggacgccgtctgccactgcagcatgcaaagaatcttttctttgcttatttcttcaaaagattttttatcgtaaactatttatctaatctacaatctgattacaccactaaattcattacaattaaatctttacaacaaaaccacacatgattatatttcgacaaaaaagtattttattttttttattgatttttttaatgttgcatgtggtctcttttgatgtttcaactagtagttttacaatgtttcagctagtgtactcatgatgtttcactgtgtacggatcaaatgttgcagtggaacgtgccgttgcaataaatcacccacatagtttggaaaccctttattatgggaatttggtttattttttgtttcacaaaaaatgtttcacctagtgcactcacaatgttccattatggatagatctaatgttgcagtgaactgaaatatttcattgcaacaaaaaaacccacatattttggaaacctccaattaaagaaattcgtttcattttttgtttcaccgaaaaatgttccacctagtgtacttataatgtttcactatgtatagatctaatattgtagtgaactgaaacattattccgctatttgctgaaacattgtttttacataaggtgaaacaacaccagatttaaacgagggaaacatttttgatctacttagtgaaacaattccgatatacctgatggaacatcgtgcaacatttaaaaataattcaataataagctaaatttttttttcatcggaatatatccatatgtggtcttgttttgaagatttaattgcaacgaatttaatggtgtaatcggatcatgatttggataagtaatttaagagaaaaatcagtttaaaagtagttttgcacataaatcagtttaaaagtagcgtccgatttttccctagagcatcggacgtccaacgcatagccctctccccggaggtttacccattgattcgtgatcgaactggagaaccgaaagaaatctcaaaatttgttcttcgtcttgtccttctctgctcgatatttcctttcatcctactccttgcctagccttcctatgtccttggctgatagtagcaaaaacaacaacagaagcacacaacagtgggcagcgcaacgggtttggtgttgccggcgttgaaataaggcatgggcgacatgacttcagctcaagctagcttgtcgtccccacgaccagccatctcgcgagtcgcgatccctccctccaaagaaaatcgccggcctcatcttccaaaaaaaaccggcggtcagccctcctccagaaaaagcggtcggtcctccctccctccaaagaaaatcgccggcctcatcttccaaaaaataccggcggtcagccctcctccagaaaaagtggtcggtcctccctcttctagtggaaaaataaaaaaactggcggtcagccctcctccagaaaaagcggtcggtcctccctctcctagtggagaggtcggtcctccctcttctagtggaaaaataaaaaaactggcggtcagccctcctccagaaaaagcggtcggtcctccctctcctagtggaaaaataaaatagaaacagagaagttatggttcgaactcaggacctcctatttcatagtatgcaactctaaccacttgatccagtagagatttctattaaaaagttaacgcttatttgttttcaagcttcattaaaattaactattaaatcctgctgctgatatcacctatcgtttatattattcaagacaaaaatatgatagattaattctagcacctggtagtaacatcactatagaattgtagtaacacgcttagttactggaaaacacataagccgttactactctctagcactagtgttactacacaattttaactaggtgagcgttgtgtccgcataggggtttgaccaagaataacctatggtagattcattctagcaccatcaaagatgcaaatcaatcatgttacattttcgtagtaaagtcatcacgaaataattacagtaacatgcttggttactgcaaaacacatatgttgttacgtcatgtaagaactattgttactacacaattttcacaagattaatgttacatctgcttaacgattccatagagatttacttgatggtttacctctctcccctcaccctcccgacgcaccctctattcaaattttcatttactgtgaaagtatatgttactaccaaacatataggacgttactgtagttttggtaataacatcatggtgaaattgtagtaaacaaggaatcgaaacaaaaatgtatgggttaaaagtatacatgctaaccatatacttgttactgcacaaaagtgtaagtgttactacatggcaggtacacgttaccacaaagtttgtgtagtaacactattcaagaattgcagtaataagttttgttactgcaaaacttatagtatttaccacactttcacagtaacatcatgatgggattataataacgtacaacaggaagtagtaacacttatgatatagtattattacttgtggagagttaaatttcaaaagaccaatatttgaaggttcgctctacccttgccccacgagtaaagcgagccaattcccctctctacattactgcactttttttcttactatatatatccttgcagtaacgttatcaagtaattacagtaacacactatgttattgtgcaacttatactcgttactacatcttgtagtaacgatatgatgtggttgcagtaacacatagtagacaatagtaataattatgttatagtattactgcttgtggagagttaaattttaaaaaaccaatctttgaagggtaatatctctcacatcatgcactatttttaaaacccgtttgcaccatgatgttagaaaaaaaaatgtttatcaaaagtagatccgtcatgactatattatgatgatatttcagtatcgttacttcaagtaagacatggtgttactgcacgatgaacatcacgttactacgttgttctgagacgagagctgagaagagtggaggtggcggggaaagcaccaggctggtttgaccgaggtaggggacctttgaccgaggtggggggtgggttttgcccccttggagagaggggaggtgggttggagtatcgttacttcaagtaagacatggtgttactgcacgatgaacatcacgttactacgttgttctgagacgagagctgataagagtggaggtggcggggaaagcaccaggctggtttgaccgaggtaggggacctttgaccgaggtggggggtgggttttgcccccttggagag

SEQ ID NO: 66137 - DNA, 26238 bp, Oryza sativa
tcgtctgtacttgctgcatttggttgtgtgatttttgtttttactcatttacttctgaaactcccatttgctgttggaatgctagtaaaacttttgttctagcttgtttgcgcaaattgccatgcctataaaattaaaattataaatcacatattgaatgtgtctctcttactccgtcaaataattccttttactgtcaattattcttagatacggcgttagcacacaggatgccctctgcccggcccgccactgttccgccttcttcttgcagagttgcagtgcaggggtagagagaagaggtaggtgtgagaatgacatgtgggtcctacggttttaattatttttctgagatcaaattgccacatcaacaccacgtcaatgccacgttagctaaaactgggcacaatactaccgaggatctcgtttgcacggttttgtaagttgagggatgtgttgtacctggttttatgctcaagagacgaatttcgaactcgacgataaattgagggaccttaagtgaacttattcctaattgaaaaggacgtactccagtttcggcccactaggaaattatgggaagcaagtcttacggcgcagaaaagaattgggctcatggcaactatgataatctagggctccatcattatcattaactaagttaattaaatgcacaactacaccgagtccacgatcctcactgtcttgttgccactagttgtggaccacttcacctacactctccatttgtattaaaaaccgtacaatacctgggcattaatagtttcagatagactaatttcaaaacaattgtctcatcacacatgctgatcacgactaatctcctaacaacctcataatcttcaatccgaggttcagttcatactactactaccattgttagtcaacgatttatcaaatgcatataatctacctaccaagtaccaaccagtacatatggtaaccttactcttcaaaaattatcagaagcaggttaacgccttttctatttgaatcttgatggaaacagtagctctgaagctgtgccactatcctgctacccaatggttttacagtcgctccaacaaaacgtgtcaaaccagctgcagtggttaattaacacacaaaaacaacagctcatactccaacacctgatttaactaaacaagcactccagtacagcattacaaagcgaatgcaaccagtcacattagaaaacacgcataatcatgaggaaataggcggccacatgatctatgagctgtgatcagtttgtgtgacagcaaaagattctgcttagctgagacgcaccaccttcaaaaattacctgacacaaaacacaaaaactaccagcacaatcaagtaattatacattcagttcagttcagccatacattcttatctcccattacacaaaacactccctctctagccagctgctggtttctccagccaaacaagaggcttggcacacttgttttccctaggtccctaagcattttgtttgatccatttcagctggctggctggcatatctggctggacctgcccttcagttgtaaggctatcaaagatgccactcacatgtgtgcagggctagctaattaccctagacacatgcttgtcaaagcagcaagtgttactaatttactactacaggttgcttctgccaaacactacaatatcaccacagtacagtacagctaaaaaggaactttcagagaatgtgggcacctaatttgaattgggaactggattccatcaatacaagacaatctacaagcaacagctaaattcttcatgctagcatgatgtccaacataaatttcaagatgcaaaaagagcagctcacgccccctaaaaattcagagcattatccagaactcatttgacagattatacatgcgctcttttgatgtgcttcgcttttatgacacattttgagctacaaaactacaatcgagttcagtatattttcctctttcatagttcagtgaggacaataagaaacaaatgaattatgtaacatattgccactaatttatacagatagaacgcatattgtcttcctcattgatcatccaaatccccaatgacacctctacgcttgacaaaagtagaccaaccgaaattaaaccaaggaaaaagatacggacttattcattttgctaacagagctttcttcaatccctctgtttaattcatcgcctgccatcagattatacttataataaccttatttttctgtttcaaatgcttaaattcaagctgctaaaagagaaatatgatcaacagaaactcaggccaacaggaactaaaaggatatcatattagttctgaagaataattctggtaagtatcgtgtttagacttctaatatttctttagagattggccataatgtctgacctagaagaagataactaggaagaagatgatggaaatttgtcacagcatacagactggtggttaaaacaagcaaggatgaaatctaatttatcagactagttatcaaatcaattaaacaactaaacatgtacaattgtaccttacaaggtctctaaacatgaggagccaaaatacacaaaaacgaaatcgcttaagcttgaacgaatttcactgaagtagcaaaatgaaatgcacaataaaattccctcacctttattgccaagcctatatccttttgaatacagcaatccaaaaaataagggattccaaatctgacacaacaaccatttcttccccattgcttgcttggagatgaaaagagctccccactatgaacatggcaattatgaacatcaacatgagccattgtagaacaaataaccctccaaacaaaactgttaaaagaatgtgttaagtctcatgagccaagactatgccctacatctagcaatttgtgccgcactcattgatatggaacacttgttgcctcatccgaccgaagagcaatcccatgcttgccagcataactggttacccttgttgcctgaattccgctgaaatgtcaagaaaacatctatgcaacatactcgctctcaatcaccggttgtgttcttgtccccagtgctacaggcgcttgtgacctcccaacctgtgccatacgcaatgtctccccagtctctgcattctgttccatcagttccaatttcttatctcttttgtaccttgccaaacaaaccacaagcgacgccaacaggaccaatgctatgacgcccccaaccacgccaacagcaatcttccaccccttggagctgcccttagaacgacctgtaggagtcggtattggcggtgtaatgttgcctgaaggcactggaccaggaggaatcgcgctagagttcaccactatcgagaaatgccctcggcggtacgtcgagcacacattgcttgcctctaagtcccggaattgtggcacaccatccaaatcaaaccacacgcaccgaggagctggaccgcctgccggcaccgatctaacatcactgaaatttatagaaattgggctcccggaggcgacaaagctcagctcctgcaaccccaccgccgacaagttggccgcgtcgtagagaagcagcccgagcaccggcgagaggtatgtgtacccgggcagcgggtagtagtggtcagaccaattgccgagattgtggtagacgagcaccaccctctcgacgtacggctgcacgacgatgccggtggggacggtgaagtcgaagtagtcggagaaacctttcctccgcaggctgccgctgcgaaggcggaccgcggacagggcgacgccggtgaggttggccgggacggtggcgttgtagacaatgccagtgtgcgggtgcacgaaggcccggtacgcgtggtcctgcagcattgcgtccagggccctggccggcgacgacgcctgcgccgccacccgggaagtggccaagaagagcaggtggaggaggcagacgcaggccaagaaatccatgctcctgcagggggatcagggggagtggagcagcagcagccaggagctgaagaagaagaagaagaagaagagtagatcaggaggaggatctcctcctcctcatctacgaccgccggtgacggaatctccaccacttaagtcggggcagcaaggacgagatttggggcggaaaatgctgggaccaagcaccaccaaggacgcgcatttactccctgaacaacacaagggcgagctagctcccagtcccagtctctccctccaaagagaagactttagcagcaaaagagcaatggcgatggaagcgaggcacggacagataggaccgagtccaagatatggtgggagagggagagcgagaggaagacaaatcgggaggaaacaatgcaaaaaaccaagattggattggaaatggatagaggaagtgaagaattgggagggaacgaatcaatcttggagaaatccaatccaagcaagcggggaagctggctgccacagaatttggggagggattaacgcgccccacgaatgattgcgacaaccaagacgaggacttggagagaaggaggaggggtttggggatttgatggcgagagtgaagcaatggagagagagagaggctttagaaatggagatgatggtgagggcttctatgtgaattgcacatttttatgagggggttatatggaaatgtttatgttgtgtttccgggtaaaagacacgggattacagttggcacaccgcccaccagaatttactgctttgcccctggcctggacggctgagttgtgggtccaggctgtcagttggtctgtgtgcgcttttggcgacgtgtcctcttttctaacgtttcgattcttccgaggggcttttgtgcaactccctagtccctattctgcaaggtgagagggtgcttgatgtaaaaagtcctcagaggctgacctgtagggcccacctgcaacttcaaggcgtccagcaaagcaagagcttttccaacgaccagtgagaatgataccgaaccagaacaataatctcttttccaacgttaactgtcgagctcaggggcttttccaaaaccaaaacaaacaaaaaaaataaaagtggttccacgtggcaaagaagctcatcatcttcttgtgcggttggttcttgatcagcactcggaaaagattgtgtgattggcactgctcttctttgtttctttggcactttgaggatttgtttttgctcaagagtgaagctagcattagtgcattatcatggcgatgagatgatgtcttatatgtgacgcaatcaacttgtcatcatctcttccttccatcttgctcgtgtctttggtttcatctttgtctttgtctagtgcgaggtggatctaggaatatttaattggaggtgttgaacaaactatacaaaattatagccctctctatgtatgaaaaaaaattagtgcgagcttttaatcggggctctccacccatggttacaacgtcggtagcaagggctcgagaccccaccgcccctacgatggatccgccaatagttactaataaacaataatattgttcacttcgtatccaagggatcaaaagaagacagcactagacgctaccaaatggatatgcgcatttatatacgtgaagtgatgattgggctcattttggaacatgattcataatccagttggctagaaacaatgactaatcacgcactcatcactgactaaaaactttataacccacttacaccatatgtgacaaaatgctcacaccaataatctggtcgaatgcacaaattaactaatcgaagcgtccggccattacagcttctaattaagcggaagacactagctccgatacaaacgataaataattttaggtaatttgtactctttgaattctaaatccaagtaattggctaagacttataggcaatagcttaaacaatagttagtgctacaatattgtaattgcaagaatgggccgctctagctaggtggttttccggagactttgcagcgaagacttttattgctgactctagtttatcctctacagtgtcttgtgcatcgatcatactttacggacgaacggagtagtacagtactatcagaggaggtcaacttaaattacaaaacacaagtcaatgccattgatgaaacctaattattgcaagaaagtactaattctaaacattaacaatgctcttgataatgacagattgagtaaaggagctggtcccactttgcctcgcgcccgtgaagaattatttatgcaattaatttaacaaatgatgtctatatgaggatgacaacgagctcaaaatcatctgcaatagggagaatatgaatttatcaaaaacagtattcacaagtgaatgatgggttcttctatataaacgaaaatgctatacgtacgacttgagtgtccgaccggcgtacgactgtgtattacacgacgtcaagagctgtgctgctgctgctgttctgtcatacgccgttaagtattgtgccgctcagccgtttcgtcgtacgccgatcggatgacgcagtcgcacgtatagcagtgttcctgtataaattcagacattagacagtaaattactatcccaaccagcaccttaatttgtacgtaaatacaaccatagtggtccagaacatgcaggagaaggtttgatagtggtgttattgcaatcatcaatgtgcaatacatttgatccccaatgcgtggacttatgggtgcaatctatgggtactactagctaccagggtgatcaatcaaaatttgtcatgttcttggccggcctcacacatgcatacatgctggcaaggaccattgtcctcttgttctttctgagagtcataaatatgtaccgatgtacacaagctagcttaggccacaaaattaaggaggagaagtcagaaaccattctgctcttcaaaattgcttttacttccccaacttgatcaagacagagtacgttttaagcagtgaatatacggggtgtgaaaatggtaggaaaataggtttaaccatttccgtaatcatttcatttttctcggaaatgaaattaaaaaggtagagcccaaaataaaaaaatgggaatattagaaaatcataagcagaatgacagaatcatactggtattgatcataaaccgtgtcaaaaacattaaaccgtaaaatcacatttgtaatttattgtgactatataatatgaccacgtaaattcaagttcacacctacgtaatttacaaaccttctcctttagctatatactcaaattagagatttagttgaggagtcaatggacctctaaactatgagccaaatagagacattgaccaaagataatatgttatttttagaaatacggtatttactgtattatagaaatggtaatttccacatctaaagtattgaaagaactaatctttcttgcaaaattaatgtgccacgccatcaaagaaataaggaccgttcgattctcgctctagacgttggtggtcgttggatcctctaattggcatagtatattctagacccttgatgaaactcctatctatttctagtccttacacatccttatacctcttttgtttttcgggcctgttcactttgatattattttcaaccttaccaaattttggcattgccaaaattttagcacatgcaacttgccaaaattttggtaggatttcttatatagttactaaaatttggcagcaaactaaatgtagccacttttttagtaactttatctaaatttaatatggttgaaaatgacatcaaagtgaactgagccattcattttcacccttccccctcccacaccgtgagacacccaccataacgctctgtcttctcgcactcgccgcgccgtctcgcactcatcgtcgaccttggagccgcccgccgccgccgctgcctcatcgactcctctccaagactccatcgccaccgctggccccctctccatctgcactgctgcacagtacgtatcctcccatccaaaacctccttctgtccagcggcaggcgcggcagccacacctccttatgtccttcagtccttcccatccaaaacgccaccacgtcgattcattccctcctggccgctctctagctcctcctccatggtgatgtctcctggtggcttggagctggcaacaccggaggaaggtagtgatgaagccggctcaagaaggcccaaaacgccggtgtgacgaacaatgcgtcaaatccgatagcggacaaagacgattgtagattaccattaagtaacttgagtacagttgaggaactatcaagtagtagtatttggatttgtaatatggatgcttatgttcagctgaagcatcaacaattgcaacttgctacttctgaatatcactatgagtttgtcctgattagtgtcggtttcggatgaaggtgtctgaacctttgtgtagacaatagaagggaaattcgatgaaaaataggaaaatgtgcggtttaattttggtttcatatagtcatcctgatttttaataggattattcttacatcagagtgagttagtgtcacaatgttaacccctacttatgtaattcgtgagtttctctgcaaagcttgagcatgggtcaaaatgattgcaatctatttgatgtatataatttttttatcaaggattggggcctcactaccttaaaaataatttcattaggaagcagcgaattcatggttgccagtaatggctatcatttgtagatcttttgaacaaagctgaagccatatccagaattaaccaatggatacagtgcattaggagaagggttttttttttggtggatcatggatagttgaagcctctatgttgagagtatgtcattatttatacttaacaggagagcttgctactttgcttgatatgccattattctttatttcctatgccccttcccttccagagcataaatggtcttttagtttgaatctactaagcatcttctgctattgtcttttagtatttctgcaattggtttattacttataaaatcatggtgttaaccacctaatttggtttacataatttctctctcatgcataatccttttcagggcaatctactgcatgaacacactggtagcagttgtacgtatatacctggtcctggtccaaggtaatactccctccgtttcgaaatgtttgacaccgttgactttttagcacatgttttaccgttcgtcttattcaaaaacttttatgaaatatgtaaaattatatgcctacataaaaatatatttaacaatgaatcaaatgataggaaaagaattaataattacttaaattttttgaataagacgagcggtcaaacatgtgctaaaaagtcaacggcgtcaaatattttgaaacggagggagtagctgattacacttcttatatatccacctcagattgcatgtttttgcagagaagccatgtgaaagtgttcctggagtttggtggatatgggcaaagtgatattcttttaagaaaatcaaagacatggtgtgtatcacagtgagtccaattgtcaattttcttttctaactcatgttgtgaacggagacatgcatgttagtggaaatcctgagctatcacgcaggttatgaattcctcattcaagttgttcgtgatagaaatactaaatacttcacctttttatttcaggcgctacaagctgcagaggttccatttcaccatgtattgtacgttaaaagtcagtgtttccaatgtaattgttggccatacaaattgcaggatggttgcagcagagcagtagagcaattttcaaactacataatagggtaatcaaccttttctgaacctccatggacgtgcttgctgcactactcaacattgaattagcacggatgtgacagagacaacgagggcagattaattacatgccatcctttcttgatatttctaacaataatatttcattgaatcatccaaaatttcctcactaactcaaaattgatcattcagatcattgggcattaaataggtgccgctcaattatttttcctgacaattcctacatgatatctattcacgatgacaaaatagagaaggtacttcttttacaatgttttttttttgaaatttacttcttttacaatgttggtattgctatttttgtatagaagagcagtagacatcaatacaagtcacagtaaagacattttcctcttttatctgtctagctttcttaattattttactgcagttcagcactctgaagaaccggacaggaatttcatcagcacaaaacaataccagattggacaaaaactggagatgaacagagactttaccggttgtaatcgccctgttatttcactacccaagtatggcatctcctgcaaaccaaatatttcagtaagcatgacatctcgtgcatcgaacagtaaaaaaaatttagactaatatgatcttaggctgcttaaccatggggaagcttctaactgctttgctccataccatcagcgtatgttatgtaacagtttatatgtacagagcttttataacggtatgtaaaaagtcgcgcaaagcgtgactaatgtggctagtaaatatgataaaaataaggaaacagaaggtagaatagcaaaattatttccgtattgtttaccacttatatttttatttttattggttatcgtttcaaaatagttcattcgagagaacatcggagacgagcctcgatcggtcagaaatttccaataccattttcgcccccatgcaacacagcacacgatgatccttttgatggccgacattgcgaaggaacttgctaacacaaactgctaaatccttttgtgtacgtagtgaagctggaattaagcaggtgactatgttcttcttggcaagcctaactagtttagttagcatggcgtactgaaagtctgaaggaaaaccaacggaaagtattctacagtggtttgatctcgcaacggatctgatattcctcacctaacaaatgcaagcatatatactctacagtggtctcatctcgatcgatcaatcccctggatgtgctgaatgtcggcaaataatttatcaacagctctgtctggtaacaaatgcactcctgcttatcaggatgggcttctgcacatacaggtgtaaatgtggcctttactccctcgtttttggcccaatatttatatttggaaatgttggttcgagccatcagcaattacaagagcaagcgtatgtatgtacttgtaaacagaataatggatcatgcaacttgatatgataaccaacaggaaatcgaacaccagaatggaagaatatagattcaaagggtctagattcatgcacaatgtgaagtgacaaaactgcatacaaaagatacgcattttgcgtattcccgaaaataatttgacaaaactgcatttcattagcttgatacactaatctcgatatacaagtggtaaactcacccttgaaaattttcctcatttcggctattcacaccagtcagttgtttcaccaacccaacatagaactcaaaccatatactgagaattgcagactttatctatgtattcacaccggtcaatttcaccaaacctagacagaacccaaaccatacacaaaaccaaaaatctataattaaattacatttgcaaacaaatgtggataaagaatggacaaaaaatatatgcacagcagtcacaaccaaaccaattccaggcccagagaggacaacgaataacattcgtcaatctgtgtcaggtaccaatgcatttggctttgagacatagcttggtaaattggcagcactgcttttagaattgctggatttgggggatgatgactcacatgagctgaggattggagattcaggccttgaggggacaggagatagttcttcacggtctaaatatgcttcaactaccggaaacatatcttccgagtaagtgtgattgctatcttctcctggtatactgtcttccatgtcatcatccaagggggcaacatcgtgggtggtgaattgatgaaaatctactatctcacgcaagaaacgattttcgcgtgcgtacatggaattttcctgcgccagtcttgatttctcggccaataaggtctccagttgcacacgaatctgttcaatagcatgttcttcaggcatgtattttaaatatgcagaagacatgttgtactcattacttaacagtgataagtaaaaaataactaaagtctgttgtacacaagcaatgaacctcttctaagtatgaagttagggacaatcgtgttcttgcccttactttaagttgcaattgtgattttgcccctcttttttagggtttgtgattttattttttaaatgaagcttcagtttgcccctgctttagatggcgttaggtgggtccagattttgtaagataataaaatagataaggtaaagaaaagaatgtttacaaaatatagaaagactagtgtacccctgtaaaaaacacttaccagttaccaccacctaagccatccaacccattctcctctcccattccaaacaggtggatgcaagcgacggagacggaggtggcggcaccggagcaactcacgagcaggctgcgacggcgcaagtggcagcgctcaccagcgtgagcagcggctgctcggtagagagggagcaggcggcgctgctcggtcaatgcgcgagcaggtggtggctcagcgacgctgtagcaggggaaggggtgccttagcttggctcagcaatgctgtagcttgctgcgaacatcgttcagagtaggagtagcagcaaggacacacgacaagcaagctcatccacgaggccaatgcaagggatgctgcctcctgattttcttttttttcccatctcatagttgatagtatatatttgggagaattttgtttggtaaatatttttttcttgtgaatgcgatgaatccttggtgaattttttgcgccctgtgcaacttctgtaaaagtgatatccaagctctatcaaaatttgtcaagtttggtcaaatttgagagcaaatgtgaagggtatatatgtcttcttgcagctcatttgacactgttagttggtcttaacagagtaagggcaaattgaaacttcgtttgaaaaaagtaagggcaaaatcacaaaccctaaaaagaaggggtaaaatcacaattacaatccaaaataggggtaagaatgcaattgccctatgaagttaataatcagcttaaagtactgaaagaccaagaacaactataggggggttgaatatagtaattcaaatcttgcccccgaaaatactcatcaagccggatttctcaaaatccttactagaaccccggctattagagaagccggatctagaaaagaagaaagaaggaattcccgaaactagaagaggaagagaaaaggaattcccgaaactagaagagagatgaggaggagatagcaaaactcatcatcgcaaagttcaaattgcaagcggaatttaaattgcggaatttaaatgaacaaggcaaaaacgaaatctttcaaatcatttcattcataggtgatgcaaaataaccgctcaactaggagcaaacatacaccttcagaggaacattaatacaaacttaaaatctctcggacaaacacactccaaactaatcctaatacaaaagcctctcgggcaaacacactccaaactcacaccgaaactctcaccgagcatctcaaaaggattaaaaaagagcaacctccacccttgcatccatttctctatttatagcctaagaccccctaagacattgtcacaaatgcccttaaggcaaaccctatctcagatgcaatcctggctgttcgttcttccttacatccgaaggaaacctcctggatgcttgccacggcgttgatccaaagcttcacatgcaaatcaatctgcgtgctccctgtcttgacgaatctgagtgcgacacgttgccgcgccgaaatcccgcgcacgcgagaccgcgctctctcctccatgtcgggcccgcatgccagcgagccacccagtccgaagccgctcccgcgcgcgctccaaatttcacgtgggtcccgcgcccgcgcgtgaaaccgatgccgcgtcgagggagaggagcgcaccaatccaaaagcgccgcgcgtctcgccgatccaatcccgtgcaccgtgtgggtcccatgagagaccgcgtctcgcgcgtctccgcttgcttgtcgaacaggagaccaccacgtgtccttgtgccatacgatctcccgcctccgcgcgcgcatgcacctgccgagccgagctgggccgtcgtcttgtctagggctgctcggcttggcctcctcccgtacatcaccttgggccagccacgtgccagcccacaagccaaatggccagctcgggttggcctccctgccaactgagcccatgcatggctagctagcttgacttttccaccgagccatgctagtagcaaccggtacagtgcaagctcctccttgcacatgtacagtacgtgtacatgcatgtatgctagctacagtaagtagcagcaatgcacttgcacagttctttctccttccgattttttcgcgaatcctggcgcttgcacacttgaccttgcgaagcccgttgcgaagacctcctcacacggtgtccgcccaccgtgtgcaaccttgtgtctaatcttgtcacccggcatccttgatcgttctggacctcaacccctccctgagtctagtcccgatccaccgttgaccaagatcgactccgatcatctgcacacacatgaaccaaacaaccgttgtctcggcacagatgtcgcaatctgaccaatgttagtccacgcacacacttcttgcacttccagtacttgtcaattttccatcacaaaagaactataaccacacatggttttacaagtaccaatgcttaatagtttatccgacatgatatagtggttcaaattttcatcaccaatacatcaggctttcatatcaaccaaccacattgtgcaacgtactgcaaaatttgcatatctttttcaaaattgtccagaaatgcaagggaaagaagaaatttcacacttttcaatggtcatagccagagttttgggatgagtcatcacaaattcaccatcaagaagaatgtagttctgataactttatcatgagaataaaataattccagggttgcttgcttggaaaacattaacataccaggtcatcatcctcttcagttttgctccctttctgctttgcttctcgcaagaacttgttctcctcttctagctgagcacatcgctgcttcgcaaaagctagatcagcttttactgtttttagttcacggagcacaagttttgctttagcagccattgcattagcaacctgaaacattttggggggatatgagaaaggcatcactaatctgaaaatgtttgtccaaatacatgggaagaaaaaaaaaggtcttatttcaagccatattaaccataaaaactgataaccaagaacttagcaaaaggaaaataagtattaatactttttaagtacaagcatagcaaaggttttgccatattaaaaaggtccaagtttctgtacgttaaacttccactactagacccagcatgtggcaccttacatcgcgagaagcttttaattgggtttcctgggctgcagtttcagcttgatcatgtgaaagattaggaggtcttaatgtatcaaatgctgggttcggcatataagaattcgaattggcttgcttccttctaatttgtatcttctttgtctcctcaatgatattggatgtcttattgtccacaattgtgagtccttcctgttaaagaaagaagagaagaagaggttattgaaaccaatgtgatactaaacgagagaaaatggaaatcccagaaaatccagaacaacagcaaagagagatgtagagttgagaaatcaatcagatgggttgtgccattagttatactaaatataaagagctgaattaagctaaaaataggacattacttccaacgcatctctgattcttccaccaagttggttgacagaagcagcaagagcttccgaccttgtccgggatccagtatctcctgtcctgctgtggttttcaaatgaccagcgagatcgagattcctaataaatatcacaaattttgagaacaatgtgaacataaatacaacttggaacatcaagatatcctacttattctgctttgtttttctaatacttgccacctcacctgagctccagtggatgaatcaaacttgcgaggggtcttttgttttgtgtactcgtcagacttatgtgctgtgccatcctcatcaagaattcccttggcttttcttgccaaagtttcccatagcccaagcttgggctcgttcatacttttgattgatgtgtaactgtacgatgaagaagagccctattcagagaaattgacatgcttaggatacatcatttgtgacttgtgagacacacacagacatctgaaaggacggtgcaaagtgatcattagagaccaacatcagttagtgatttcttttatccttttggaacaaaatgttttgtttatctgtaggtgataaacaaatgggatgatttaaggagtttgtacattaaggaacaaaatgatcaacgaaccagcgaggagccgaaggtggtcgaatcagcacatggtggtttcttaaggaactgtgatgatctgatcgataggcctaagaaattgattctaattatctcacaacaaaacaagtaatcttgcggttattttttttcccagagtaaaatagtagtaatctgcagttaaacataggaggattactgtactggttaaggggaatcagtgtccttttgctaaacaagcttgtcctcaaataaattaagatgcacgatcaatcaaggcagcgacaaaaaaaaaatctaatttgatccgatcaacagggattgaaaactgggatatactactacagtactagaagcaagctgaagagtgagagacaaggaggggggagaggggcgcatgcctgcggcggctgggggtaggagctccggcgatcatcggcggcgatggggccctgcttccggcggtaggccatggtggcggcgcggcggcgggtcgtggcccggacccggagtaggagagcaaccaaccaactctgaatctccctgatgcctcgccaccttcctccctgcaaactgcatcgatgcttttgcatatgaaaccctcgcctctggataaattaaattatttaccaaattaggtacagttacattttgtggggaagagacattcaaattcagtggatctccagagaaatgaaccagctggcggatagtttggcaaaatcgacaatttccaagccaaaatcaaatggcttttgactcttctgatatttccaatatatgtgaaaggtctgattatcatgttaaaaaggacttcttcttactcctaagggagatgtaactatagattctgttttaaaaccttttattacataaataaatatcatgagttctaaaaatattgtgattggataagaagtataggtagttaaaaaaatttaatagtaaatggttatgatcggttaagaaaagaatattggtacataaattgttatattttggaataaattctaaaagctaaaaaataatatttttttagaacggaggagtaatacatagtaataatcaaatatgaaatatccacaatgttggtaatgcaatatgcgaggaagtagtgggtgcagatgcataaacataaaaaggggaaagggaaaaacaagagagaagaaatgccctcctcccttctgctggtttgctttaaaagctggcaacagcgatgacagtaatctggagcgggaggtggggctccactccacgtaccgaacccaatagcaaaaagtacactgaagtccctcaacttgtcatcgagttacaaaatcatcctccaaccacaaaaccagatataaccgcttacttttgatccttccgtgtttttgacatcggttttatctagcgtggcagctgagttagcgtgggccccacatgtcaggctaacagcgtcatttcccttcctctcactttcccctctttatctcccttcctctctctctcatcatctcctctctgtgtgggctggcccccggccggcgggtggccgggtggggaggaggtcggcagggcgaggcgagagaggcgcccggcgacgggcgatgtggaaagaggtgctcgcgtcgatgcggtcgtcgtcgccgccggcaaggtggggggaggtggaggcagggaaggggaagagtggagggagtgggaagggcggcgaccggcggcgagagtgcatggagagggaggagacaaggaagccagcggcgagcgcgcaggtagatcctcttcatcgccactttgggccgcctcgtcgcccgcaggaggtggccaagtcgatgtcggcagttctacgtcgcctccatgtactggttcatcaccaccctctccaccgtcggctacggcgacatgcacgccgagaacaccggagagatggtctacaccaccgcctacatgctcttcaacctcagcctcaccgcctacatcatcggcaacatgaccaaccctgtcgtccatggcaccagccgcaccaggaaattcgttagtagtcactttctttgatcgatcccttgctgtttcttgatcaacagcaattctttggtgttctatcttggttcagtatactctagtactcacaagtcacatcacatgatggtttcttggcgtgtgttcttggttttaatcacatgatctcaatgtgatcatgtgatttttatttctttccaattcttgttggatgttcgtgaggagtagttgatatcttctgtggtgtaatttgagtgaaggtttcagagatgaatgccgagtactttgcgccgagagaggatatcatactgcagaatgaagcgcctgcagatctctacatctgaagtggcggcgagcttggagagctggggtagggctcctcgcggcggccggcccggaggcaggaagccctacctcgcgcgccggatgcgggcggcggggaatggccggtgaggtggtatggcgcgtagagcgcgtcatggcgccgatgaggtcgcccaccaccgctccgtcgccgcggcgaagaatctcctcacggagctccacccgttgcccacatccccgctgccacgccccgcgctgctcgcgctccccgccgcgcgcgcccgccacatcggcctgttgtgcccagctgctctttgccgccacagcggcaccgcccgtggaagagaggaagaggagaggggagaggaagccgaggctgacaaatggggcccacgtgggttccatgccgactcagccatcacgtcggataaaaccggagtcaaaaccaccggaggacctaaagtgaacggttttgtaagttgagggatgatatatatctggttttgtggttagggacgatttggataccactagctcgcgccgacgggcctggcggcagcggggcgagcgacggtggcagcacggcggccacggcggcgcgaggcttgcggacggcggtgaccggccgggcggctagtaatgaacgacggcggcggtgccggtggcagccgcggctatgggaggcagcaacggcaacacccgtggtggcagcggcggtggctgacggtgcggaggcagaggcctcggagctcgtcgcagcggtggtgtcagcggctggacgacggcagcagcggctgctgtggcacggtgggaggaggcacggtggtgcgttcggcagtagtggttgcggtggcagtgaccgcggtggtaccggaggcatggcggcctcggacggctagccgagggcgtggcagacggctgcatttggccggtttacaaccctgtagggtcgtaaccaggaaaaaggaaaaatataccaccacccacacaccgacaacgtcaacacacaacccgggataaggctagcaccggaccgcccgctgctaagcgtgaccgaccgccactaagcgtgaccgaccgccactagaccaacaaaggaacacagacgagatcgccccctaggggatgccaaaacgacgtcttcaagaagagaagcgacggaaaaaaccgcctccgccgtccgtcggggctcaaaggagccaagactgggcttttgcccggcaaccgcccttgaggagtcagacagcacgacaacaccctcagaagggggaatgaaccatcgttgtcggcccggccaaggccgggctaggttttcacccgccgctcacgacctgtgaatccatggctaacgcaccgatgctccaccaccactctagctctgccgacaagtgagactcctacaccagcgtccctcgccggctagccttcgtgcgccgaagactgcgccacacccatcgacagttcctcctcacaccaaggtcacttccaccaccgctaaatccattaaaaaaggacaaattttagcggagggggctgctacgggcaagttgagtactcagattcggcgcttgcttgacatctctctttgaattttggacaaagccgaccaggaatccagctgaatgacacgagttactctcccgagcctcctctttattcagaaatgaaaccaagcgttgagaataagtccttcccttttgtgtgaattcccgccggccgcgcctctcgcgctaagccagcctccatctccgcctcccgcggtttgaagccaaattttggcatgcctaagaaaataggccatttcaatattgaacttaggctattttggcttcaatccaaacacaactttacctcaccaaaattaggcatgccaaaacttaccaaaatttatcaggcatttttaggcaaaccaaccctcgatgacaagttgagggaccttcttcgatgtactttttccaacccaataacgtggaccgggccgacagatctggcccataactagcatgcattgttttccaggccttggatgggcttttgtgaaaatacggcccactcggtggatgtcttgtctccttatctgcaacgtgcccacccaccagtccacgcagtctccttgctgtgattgtgtttggcgtttgcttctgcagttctgctgccacattgttgatttgctcccaaatcccaatccgccgccgccgccgtcgtcctcgacggtagccagctccgacaggaggttccccgtgctatccctccctctgcaatactgtggttttgctctgacttccatcggctagcctaggcgcaaagcaacccaccatggcctcgcagccgttgctcttccggtggatgcaaccccactgcaaggtactcctgccactaatctcctctgcactcgattcaactcattcccaactgatagctggtgttcgtaactatgtactcctatgtgtttacgcctttacggtagcaggtccaatcgctatagtaaaaatactaccgtgtggaatttgctcagatggtcaaactccaaacactctggctaccatttccattcatttctcattagaggggaccggccagtgatggtctggtactgttaagacataatttttcaaagctatgagtgtagttggcatttgtttcatttgatggtatatatggcaaaactgttgtatgtgcacgagagataatggttgtctcacatcttatacaagctctcttaggtttactagaaccaaacttttctactttgatatcatcttttttttccctctgtgctcttgcattgttcacatgctattaactcacttactcacagatgttttacttgcttcaatattggatattttcaagggagattaagactggatattttgttgcccaacgattacaacagcgtacaatttaggaagcagactgtttttctgaaggattttttttttaataaaaggaaccatactgttaatctgtagtgatttggttacacttgtagttttcttgtctttgcagttcattagatcaaatccatgtttctacatagaatgactgaataacttattttaaacatgttttgctaaagatagagaaatacataatgctttctagttatacgcttcctctgcaaagtactaaaattatttccatttcccattctacgctactagcaggatttacacagccactcattcatttagtacttgacatgtttttgagtagttcgtttctgctttggtcatcttttcctccttctcttcgttaatctagttactttcatggagtataagctgggcatggttttgtttgataacgattcaaatttgcagtgtgtggatgcagattgatttttcagtttgcttcttccgttgggaccccacacaattgttcagtccagaaaatgtgagtttcctgccttgcagttgatcaggtcaatgccgatgcatctcccacgctccctccaatacccaccctcgactccacaccctctacattccaccgccttctcccacagcctccgccctcgccgtcccaatggtcctcccccagccttcgcctctgccgagttcccaggtaaccatcttctccattgtggaagacttgcagcatttggataggaggttcttaaaatgggaggttttgaagttgatgtgctctttgcaagtagaatgcatgttttcccccatttaaaatggcttattattgcgcccttcttttcatctgggtagcagaactagcaccaacagctaaaatgtccccaaaactagcagaacagctttggcactactaaaccctacaactaatgcaggttcagttccagacagtgcccagatgccaccacgacgccgccgccgccggagtgtggctggcattgaccaggacgatctccttgaccccgacgccctcgccgacccagacagcagcttctacgagatcaatggcgtaagggtccaccacaaggtttgcacccatgaggattccagtgaccaatctccagactctgccatcacaaacgcggaccaaaaccaaattggtttgcccatagtgctattacatgggtttggctcgtcggtcttctcttggacccacatcatgcgccctctagcccgcattgctggtgccaaggttctagcctttgatcggcctgcctttggtctgacatcccgaaccatctggtctggtgatgacaccaagcctatcaacccctactccatggccttctcagtcatggcaactttggcattcattgaccaactcggtgccaagaaggccgtccttgtcgggtacggatgtaacacaacatgtgttgttctatactttaatctgtgtgcattacttgatgaattacatgtgtgtgatggtttggattcaggcactcagctggttgccttgtggcagtggaggcatactttgaggcaccagaaagggtagctgcacttgtgctggttgcaccagccatttttgtgccagttttcaggaggaaaggtgtgaaggagaatggtgtaggtgaacaagaatggcagaataagaaggattccaatgattcaaatttgcctacaaatccactcaataggatttggggaaaattcctcgagctatgcttgtggattgcagggtttcttatgaatatgattagggcaataggtggtgttgttcgatctttgtattataaatctgttgttgctgttcttcgatcatcagttggcgtgatgctggtaagttttttttaatctctagtgttttagctgatagcctcttcaatggatactttagtaaatgtgtcaacaaaagtaagtaaaaattagctaaacttgaattatcaactctcactgactaactgaatagcagacttttccagttcacaaacatttctttatgaattgaaaatagtcaggttgaattcttttcttgattggactttggtgacataggtaagattgatcatggataagtttggtatattggctgtccgcaatgcatggtatgacccaagcaaagtgacggatcatgtcattcaaggttacactaaggtgacttatatgtctctgaaaattctgcaactatcggatccttatgcaaagactgaaaactatgtcttttcttcagccattaagatccagaggttgggagatggctcttttggagtacactatatccatgatcatggattctatatcatcatcgaaagtgcctgtctcagaaaggctttctgagatctcgtgcccaggttttcatatacactctacttttgggatccttcaatgatatacaaataagcaaaaaaaaaaactatttgttatccatgtttgaatttgcattcaggtttaccagtgaactatcattattttggacaaatggttggaattatcttgcatgtggctgataaatgatgttactttctggatggtttgtgtgtgtttaccattgcagtgctagtggtgagtggagacactgatcgccttgttcctcgttggaataccgagcgcgtagcacgtgcgattcctggtgcaggatttgaggtgatcaagaactctgggcacttgccacaggaggaacgacccgaagaatttgtctctgttgtcgaaaggtttctgagaagagcttttgggagacccaacaacgagcaagagcaagtgttgcaagcagctgtatgatatgaaaccagtacctgtagataagcatctagtactagataaccaatacatgtttagatgcgttctgtactagttctctgtaagccgttaaattttatttgctaaaaataatatcattaagttaacatttgaatttacttttatatggttatgattttagtacatgggaaatttaaagtaaaaatttagctttggagaaggtatcaagtttgaccgcaccttatttagtgggacggaagtatacaagattagtagatcacaataatctaatcaaatcaacttgctttttagcacaaaaccatgcttccaaacttaaagtgcaatccaccaacccccacgactactccagccatggttttcaaaacagcaaaaaaaaaaaaaagtaaggccagctacatgaaacaccccttgttttttttttaggggggggggggggggagcttagttaagaagtatgcctttcttccgtaaattagaacgagcaggaaacattggaacatgaaagaaaataaattagtcatggagcacagtttgtggggagccacgtgaagaaaccaatgttattaatatgaccaatcaacagccgaaagaaatgaaattacatactccctccgtttcaaaatgtttgacatcgttgactttttaatatatgtttgaccatttgtcttatttaaaaaatttaagtaattatttattcttttcatatcattttattcattgttaattatacttttatatacacatatagttttacatatttcacaatttttttaatgagacgaacggttaaacatgtgctaaaaagtcaacggtgttaaatattttgaaacggaggtagtatataggtaattctaggtagtgtttggtttcgggactaagtgggatgtgatggaaccatccctgatttttgggttgggatgattccactcacatgtttggtttataagatgggacaatcctaattttttgtttggttgaagggatgagagagggaagggatggatgccgtttgcaatcaccgtcaaccgatcgccggatctgccaccacagtcctccccatcgccagaggaagagcaagaggatgagccggcggcgagcaagagcaagaggaaaagccggcggcgagcaagagcaagaggaaaagccgccgccgctccttccatcgctggatccgccgccgcccctcgacttcctcctcgcacgccgccgccgctcctcccccgtgagctcctcatcacaagccgctgcagcacctccccatcgccgaatccgccgccgcaccatcgccagatctgctgccgcccctagacctcctcctcgcacaccgccgtcgctcctcccccgcgagctcctcctcgcaagccgccacagtccccatcgctgaatccgccgccgcccctcgacctcctcctcgcatgccgccgccgctcctccccgtcgctgaatccgccgccgctcctccccatcgctgaatccgccgccgcagtcctccccatcgccggatccaccgccaccgccctccccaccactggatccgccgtcgccaaacccccccaccgccgcggtccgcgttgccgagccctgcgtggtcgccgtcgccgagcctgccgctgtcgcacgagccgtctgccgctgctcccgagggcgagcagcgcgagcacggtaggaaggcgt

SEQ ID NO: 66138 - DNA, 13728 bp, Oryza sativa
  unsure (1)..(13728): unsure at all n locations
gtcgcaccaccccgcgctgccatgagctcagagtggtgtatccacccctcagaagttagaatccaggatggtcacgctgtctctcgtcacggtggcgctctcccttctatcggttcggtgcagaatgcgaagaacggcgtgccggcacggtggctcactggcaggggggttatcgacgagtggcttcttgtccgtggagtcatgtttctatgggcttttcatggaccgggcncagctaaataaaaaatgaaggaataagttcactatgggttcctcaaattatcgttgagtctgaaatttgtccctggaccgcaaaaccgcatacaatgtatcccccaactttacaaaaccaatgcaaacgaggtccctcaacaatattgtctccagatttgattgacatgacacatacgtggctcttttgattaggtttttgtctcacgtgacattgacatgacgcatacacgacagtttggtccaatctgaacatgttctttgggcatccacaatgtgcatgtaaaaatgaccttaggattaaagtaatatttatgttctcactttatgcattgggagaaaataaaaggagaaaaagttgctatggacaaccttaagcttaaggctacgccataaggaataaaaaaaaatcattttatacctttgtaacatccatattggtttttgaatcctgcatattaaaggttaaaaatatttttttatgtgggtcctaccttaaggttgagaaaagatcataaacattgtagcatatgttataagtgaaagaccatatgattgtgggtcccaccttatggtctatatctctactattataaaaattgaagatgtttttttatactttggtacgttattcgtgtatgagtcggtttctaagttcgttcgtttttggaaatacatatccgtatttgagtcggtttttaaattcattctcttttggaattacaaaaggagttgtataagaaatctcttaaaaaaactcgcatgctaacctgatatgatcagacttctaactgcagctcataattttctaaaagcatatatatgcgaattcccacagagaatttcactttaactaaaacgtataatgataatagattaaaatagcttgcaacgcacgggtatttgttctactgcacttaaacattgaggatgtccttaaggcaccaagatagtgctttttttttcattaatggaccgtgtaactgcggtaaataagtaattctgtcccgcgcggaggtggtgtggcgggagatgctggtggcgagttgagcccgtggcatagcagcctcacgacggaggctacgaggttggccttcatggccctcaccggcgctcgtgccgcagtgcacgggaacacaactttggcgatcaagcacctttgcggtggttcttcctggcaccggcgtggcgggatcttgttgcccattgactccatggaaaggttgcagttccgttactggttcaagtatatactgcctctttatttttattttaatgtatgatgccattgatttttttttcaactttgaccattcgtaattttcaaaagaatatgtaattatcatttattttattgtgacttgattcatcatcaaatgttatttaagcgtggtataaatattttcatatttacacaaaatttttaaataaaacgtatggtcaaacgataataaaaaagtcaacggtgtcatacattaaaatcggagggagtaacatgcatgtagggggagaaatcgtaaggtagaacccacatagcaaatcgagttaattagatcatgttattataaatttatctattttgaaaaatatcatcatcattcatttatttgaaaagatgccaccacaaacctcccaaaatcatatccatgccatgccatatgtctgagtgttttgaagcgttttttgtccatctttatttcatattttgaccaaattgcccccatgttcctccatccatttgcattcatgtcgaaacatgaattcggcaataataaaagggatagcgcacgagatctaaaagtggatggatgcggagacaaaggatttagacaggttcaggccctctcaatgagaggtaataccctactcctgattggggatttgaatccgccgggtgtattagatctgacgatcatatgtgctcatgccccctagagggcctcctgcccaccttatataggatgtggggcaagattacaagatacaaaccttaaccaatacggtatcggtttcctaaatctagtttacaatattatcaaaccaggactttaggccgttccataatatacaaggaaacgtaatacccaagtcatgatctgttacatattctatagatataagttatcccctatatctagtcggataaccatgccgtgtgggtatggggtacccataatctccacagtagcccctgagaccttcacagtcaaaaagataatcttctcttgaactagattattccaaagccaagtgctttaaccatctttgccataatctcccgaatacttttaccaaatccaaagattgtgaagggctgaaaaataattgaatgtaaatttatgtgcatcgagtagatgcacctaataggtgtagcccccgaccatgtggttagttgaacaaaccaagcatatagtcaaggaataaataatccaaccaaccgagtggtttttaataattatagtcaaccaagtgacttgatatcaatatatagcatatgcggtgcgaatccccaaataacatagcccagatgatataccgactgctttgtaaaaattgatgcgagcaacctaaagttgactacatcattgaaaattcacatagcaaaacagctataaaaaagcttgaatgctgtgaataaagaaatttccaaagtattgggcataagccatgcgcacactgcttcaacagatgtgcttaagtccctaaaagacacatggttttaccacgcctggaaatatacggcatatgtggtgtaaaatccgagtaaataaactcataaaggatttaccaaccgcctagaaaatgaccataatatataatcagcctaagccataatattggtcaataaaaatgcacacttacgtggcaaaaagcaatgatattgtatccaatcaattgcttaaaaacccaaacatcaccttgacttatataaaaaagtcagcggggcaactatataaagctttgctgtttgataccttttaagatgcattgtaccaactcctaaaaagttgagtaactgcggtataaaaggattttaaggtattgggcacttgatcacgcgcactttggcctaagcaaaaagtgcctaagtccttaaaagaacgtgataggccacacctgaaaatatgggctgcagacatattaggcctagaccaaaaaatatgccttcgacaccctttaaaggatgacgcatgtaacatgctcccgagtaataaatcttccgggtgatatagaccaagtgtagctcatatgaatagcttctgatctaagtgattatcccttatgggatactccaaaatagatataacaattgaatcccgactggcgcaagtattcggttgataacccttacagggaataataaatagtccagtctttgagcatagaaaatagacccatgattatgaattcatgttgcatgtatccggaacaagtccaaattggaggtatgatacttgtgtttgagctagtaagcccctgagcatatagcttgtccttctgtcgtagtcacaattgtccattgatggtagctggcgcagttggcatagagacaagacgaccaatatagagataatattgtctaccagaggtggcaaaaatattgatggtagtgaagatagtgataccaatctaaagtgatgaagttgcacagccgtggaggcgaagaaaccagtcggcagcagtcaggtcagccagcaatgaatatgaaggtgcccagtgataaagttgtgtagccatggcaacgaaataatcagtcggtgacagacgagacagctggtgaagaagataaagatgcccattagtggcgacataataagccatccgtgaaggcgaggataccagtcggtggtgacgaaagcaagccgacagtgaagatgtagacacgcatcaaaggcgatgacgaaatccaccaatcatgaagatgaagaaaatagtcggcgacgacaaacacaaccgacagtaatgatgataagcagcaacagagatgatcgactatgaggacgaagttgcccatcaaacagcagtagaataggctatgttgaagaggcttggcaggatattgataaagatgacgatgtcggtgatccagtcaatagcagtgtagcaaccaatgataatgacgaatacgctcaccagcgtttgcatagtaggtcaaccgtgaaggtgaaataacaagccggcaataacggaagcaaccggaggcgaagacgtagtcatccattagcaacggcagagatgtcagagccgatgaagtagaggtgttggtgatgaagtcagtgacaataatccatcaaactgttgagaagatatcaaagctcaagtaattttcttgatgtgtgtataacgaagattgatgtaacaccccttgatttgtaaagatggtagtagaacttggagttgtagctgttgcagatgcttcacttgaaggaaagtaaatgttgttgtccaactcatcgaaactgagctgattggttgataactctaaactcccggacatgtagatagaatctcaaacttgatacttgaaaattttggagtagattgtggcggcgtagagaagccaaaattaccagtgaaatcattggagttgctgaagtagaacacttgctctgaagcgaagacaaaacttataactctcgaagtagattccatagaactcgttggctgatttgagagtcttgtatttgtatagcccccgactctttggttagttgggaaataactgaacatagagtcgagaactgcagcttcttgtcatcgagtagtcattgcaatcaaaagtgaagatgcatgttgaagatgtccgagtaaaaatattgaagatttgaacaccacttgttgtagtaaaataatacggcatcatatttggtgacgtatgccgaggtgtcgaagctcttgtagacgtcgtggctggtgaagtagcaaaacttgcgaagtagcggcaattgagttggccggtgccgaagataataaagatgaagtccctccaccatggtgacaaagttgcaaaggcgtgatgaagtgaacacgagtcaacagcaacataagcaaaccggtagcgaagacgcgtggttgtgaagataaaaacaccagttggcggcggcataaccagtcggcaacggaagaagtagaatgatgatgaaaacgaagacgttctttaacagcggcaaaataggccagccatgaaagtgaagacaccatgggtggcgccgaaggcaaaccggcgatgatgatgacgccagtcaatgatgacgaagacgcgcagccgtggaggtgaacaagccagtaggcgtcaaacaaggcggccagcaatgaaaacgatgacgtccatcagtagtggtagcaatataaaccagcagtggaggcgacgacactaatcagcagcagatgagacgaccggcggtgaagacgataaggccaatcaacactggaagaatcatgcagccatggaagtgaagaaaccggtcggcagcagacgcagacaacttgtgttgaagatgatgacacctattagcggtggcagcgacatggctggccgtgaagatatatcaccagttgtcgtcatacgaaggcaagccggtctgtgaagatgtagacacccaacaacggcggcataataggccagccgtgcaggcggtgacaccagtcggcagcggcgaaggcaagccggcggtgaagatgtagacgtctaacgacggtggtgtgaccaaccaaccgtatagacgaagacaccagtcggcggtgacgactgcaagcctgtggtgatgttctgactaatccattcctggagtgtaagagataagcttaaagccatgaatcctttttatgcatatctggatctggatcctgcagaacaaatatataggatgagtagtatctgatgcaaatataatactcgaggaaaatttaagtattttaaaatgtttataaatatatatttctcctattgtcaattttgatttccccgagcagatgactccttacgtttaaacactctgcccgactagtcatagcccccaaacattgggagtcggcctaggcacttcccaaacatgcatatgagtgacatgagttcgtcattagtggaacaaagtttcatggatcagagtttactacttaggtacttttgcaattattaagagtagaaaataaattatcttatctctatgcttttgatttcttccgagtaatacttagcaccttgcgttactcggtccattcaacgagcccccgggtgctaggaatcggcccaaaggcaactatccatcgacaaaccaaacggaaagtataggaagatagaactccataactcgataggcacttttgtactcagattatgtcgcaagcaatcaagataaatattatgaaaattgtttaaaaaatatgatataacatctatagccctcgactcactagtcaacggcgaaccagttgatatagtgaggcagaggaaaagaaaaatatcatataaagaaaattaatgatgacttagctttgtaatattccccttgatgatggcagaggtggccaatgtgggaacaaagtcgtccgtcaataacaatgaagacaccagtcggcggcgaaagaaggcggtcgacggtgaaagcgaagatgcccaccaacggcgtcataatagaccagccatgtaggcagagacaccagtcggtggcggcaaaggcaaaccggttggtgaagacgtagatgcccatgaacggtggtgtgaccaaccaaccgtataggcgaggacaccagtcggtggcgacagagacaggccggtgaagtcgtagacgcccaacaatggcggcataataggccagccgtgtaggcagaaacaccagtcggtggcgatggaggtaggctggcggtgaggtcatggacgcccaataacgacggcataataggccagccatgtaggcggagacaccaatcagcggcggcgaaggcaagccggttggtgaatatgtggacgcccaccaacagcggcataataggccagccgtgtaggcggagacaccaatcggcggcggcgaaggcaagccggttggtgaggatgtggacgcccaacaacagcggcataataggccagccgtgtaggcggaaacaccagtcggcagcggacgagacggccgggcggtgaagacgtagacgcccatcaacagcggcataatagaccagccgtgtaggtcgaggcaccagtcggcggcggcgaaggcaagccggctgtgaagatgaagatgcctagcaatggttggaaaatgctaggatatgtcctcacacatgtttgctcccaatctgctcgcacgcgtgtatatatgtgcatacggcagagtgcaaattatgagtgtgagcagctcgctccagccagatcagggcgacgtcagccggatggataggccaacgatgatctcacatgcaaaaaatacccaatatattaatcagactgattaggaatagcaattagcaataacgtatagatattatatgctatatatattgatgtatgcatgcagcatatacgcatactaatttgcatgtccatgcatctgaaagtattgcactccactgtgcttgcatctgcccctgtaaccaacagtccttcagcatgatgccgtcgtcggaggtaatcatggagccgtcaaacgccagtatatgcacgcgagagaaaacgaagaatcaaagggcagatcaatctatgattaaaaaaatcataattataataatagattggaacgataaattagccgatgccggatagcagtttttatccatgcatgcatgtgtttatgcgtgtagatgcagagccgatccttgcgtgtccaagtgcatgtgcggacggatgattgctatcccggcgagtagctgtcttcacacggctgatagatggctgcggtggatgacgcactgctacacgcctccgccgaggcgccgagtccgcgtcgaactcgaagcgtccagtttgatctcagcaatcaatctcaccgagcataacagaaaacggcgatgacgacgacgactggatcggaggctcgattgctatccggtgcgtgtgaacatccatcgctccagcatgcctgtccagatagcagtggtgactcccgtggccgacctccatgcagagcagtacgatcaagcagggttgtgcaggctggtagctggagacgtggccgatgatctcttggatacagatgattttttttggctacggactgtatagcagctccagccggcatcttggcgagctgcatcttgaggattcaccaccattggtgacgtcggagattggagtgatccaacttgctgaggttgattttccttgctagattgaatctgattcggcgccttctaattggttccatctcacttctcgtagataactcgacgcacccctacctagcgcgccaactgtcgaaacatgaattcaacaataataaaagggggtagcgcacgagatctaaaagtggatggatgcggagacaaaggatttagacaggttcagtccctctcaatgagaggtaataccctactcatgtttggggatttgaatccaccgggtgtattagatctgacgatcatatgtgctcatgccccctagagggccagaactttaggccgttccataatatacaagaaaacgtaatacccaagtcatgatctgttacatattctatagatataagttatcccctatatccagtcggataaccatgccgtgtgggtatggggtacccataatctccacaattcatgaaaaataatacggaaaggtaaaattccaaacttttgcatacacgggcaaaaacatccgtacaattcgacaaactaatttgtttcaaattgcaaacaatacgcaccaaatctgggtaaaaattacacataggacaaaaaaaaaagaaaagaggaaaagaaaggagctggcatggaggtctgccatcgacgaccaccgcccgacctcgctgccgcaggacacaccatccccgacctggcaacctcgatattgctgaatctgttcacaccgttgccgaaccagcggcttgtcgtcgtccccactaccaggcgcacctcgcctgccggacttgcagaccatatgcaaacccagccttcgttgccgccgtcgtcgcacttgtagaaggaaacatgggtgttttggtctttacagaaatacggtagataaaaacgcatcaaaatgtcaaaatgtgttgcagccgtatggcatggcagggataggattttggaaggtttaggtcttgttcggtttagagcggattgaagagaattggaggggattgagaggaaataattccacaccgcaatagatgtggaataaattcccttcaatcctccctcacagggatcaaccgaacaaggcccaaataatttataatattattatcaaaacagacaaatttgcagtggcattagagcaagtttaatagtatagcccactactaactccaaatcatttatagccaatgtaatagccaattcatacaatagttgttcactatactattaatacctggtccacctgtcatacacacgttacgtctttgagtccatactgcagttggctacagatctgtagctcgctgctcttttctcactctttctttatctctttaaaatatgtttatagctggtttatagcatgctattgtatctgctcttagtgcaattaacccaagaagagatgggagagattagggatgaaaacggagcggatagtttccgtccattctggagagaaacgaatacggataccttcagatcggatagttcggatacaaatacggatatttcctcccggatacggatatgaatatgatatcggggttttcgtcggatacgaatagtaatttggatatccagtgaacagtgctattcggatatctatagaagtcatgagacatacctcatttgtttacaactctagaccttcaatatacctttttagattttaatagtagttcatctcttaacactagcccacaatattaatattatttaaattttaaaaatatttataaattatactatattttatataaaatgaggtaattatatattttgatatttgtttctattagaagttgagttggtcttcgtgttccgagaaaaaaattgtttccatattcgtgtccgatcatattcgattcttattcttattcgagataatccatatttgtttccgtattcgagctatccgtattcgtttttgtatccggtaaaaaaaatatgaaaacgaatacagtatgagcattatccgttcgtatccgctccgttttcatccctaggagagatgggggtgccagtgcccggccaaagaggagaaagcagagaagaccgtgacgtgattttcttgttatcgcattgcatcgtgggctggattagagcgagcgactgatgtgtaacactgaaattttcgaatataaaactttagaataactaaaaacctttttcaaaatttgaataatgctgatattcactggattttcctttttctcttcctattgtgctagtgccaaaaattaaaataaataaattcaaaagaaattaaatccaaattttaagttcaaatattaaattcaaacgtcatttattaaagcacccgttatttaaattaaaatcctttagggaaatattatacagataaaaacaaaactagtttcaaagtctaaaccacaccttgtccaaacccttagcctatctctagtctagccgagcacccttatcttcttcctccatttaggccggcccatctagcagcccaacctaccggtgggcctgctctgtctcggcccagcctaccaagccagcctggcgagctgcgagatgagccaacccggccagccaccgtcgtccttccgccgctgtcgcgctgccggagtccggggtgccgctgccgacggaatctacccaacccgttgtacctcgccaccgccgccacgcgcccttgcgaacggtagatgaccgtccctccaccttttcccctggccgactcgccatgccgcgtctcgacggcgtccatcttgctgcaccaggagcacatacggcagcgcaggaaccgtgccgcatcacctgccacacgaaacatcaatttggcataaaaagatcaaccacacgaaagtacgaaactgctgctaatgataagattagtgtcactgtagcatacgcacattattctgcagcctatcttctccttacacaatacagtttcaggtgcaggttggttatctgaagacaaagtcggtgctgataaggtaggttgcagtgagcaaggcctcatccgaaaagcgaacgagaagagttagccaagtctctacaatgttgcaatgtgcatgtgggaacacaaacgatgtgcaatgccaagtttcagaatgaatttttgcaaccttcaagtcaacatcaaaccaatcagtctgattgagcagattttattatttggatatcgttgaacatatgattgaaactgaatgaacaaatgctccagtcttcaagagaacgatatacccatgtgaatctgttaaaatcatcaataacaatatgtttgcccctttctgttttattgtccactgaagtaaacagtcagtcaattacgcctgtgtcccggtagcacaacagtgtcttgtttgaaaatactgtaagcaactcatcagagatccaggaattagcatcagagaaggtatgctgcagatgtgtacggagaaaatgctcttaacatctactactaaatactaatacctcaaggcatgctgcagtcagccttgacatcttgacaaagttactagcagccttgcaaaacttcagtgagtgaacagattctgaaaaaaaaaaatcagcaaaaggtggagttattgggacaagttcaaggaatggatgatcttcattctgtacatttgcaatttgaagatcaattcctttcttttccacaagtttctgcattttcacctccctgtttcatttcttcagtcccaattcaaattgatgcagcagctggcattcggtcagagactgcaattcaagacattggcacttattgataaatagattactctatttatcttagtaacatccaaattcagaaaacaaaaaagacactgctccttcagtttgattgccttccaaaattaacaatactttgcccatcattttcttcttcttacaaaaaaattccttcaaaaataagaatgagtaggacaagcaacagtttaaatttctgatcgaattataaaactgatcaaaacaagttccaaatcaagctcgaaacactagttatctgaaaaaactatcacaaaaaagaagccccgctgctcgcgcgggagcacgcgtgagacatacgctgtctcacgctgacgtcggcgcgtccaataaattcaaatcccaccttactggaaatatcccacgcgcgcatcctccactcatctcctctcgaccaagatttcccccaaaaccctagaaatccccaggcggcggcgcggcgcgcgatcgggggatcgagccggcgatggcgggcgcggatgggctccttcccggcctcaggttcgaccctagcgacgacgagctcgtctcccgctaccttctccggcgcatccagcagaagcccctcccgctcgacggcgtcatcgtggatgccgatcccctgagcgtgccgccatggacgcttctcgcggatcacacccgaggcgacgaggccttcttcttcgcggaggcacgcgccaagaatggcaagggcaagcgacagaagcgaaccgtggagggcggagggttctggcaggggcagaggatggccgtggatggcgagcggctggtcgtcccaggcgacgatggaggcggcggcggcgacgaaggcctggagatcacgtggcgcaagtatgtgttgagcttcttcgccgagggtgaacggggcagctcgggctgggttatgcacgagtacgccgtgacgtcgccggctgacctcgcctcgtcgcagctccggctgtaccgcgtcaggttcagcggccacggcaagaagcgcaagagggagccgcagtgtctggactcccacgacgacgacgacggcggggatcaagaaagcgcgactcaccggcgcgccgtggctgagaccactctgttcgacggatacgtgcctcgtcctgcagccgacggcaccgaccagggcacctatggcgtgatcgacggcgaatcttcgctggcgtcacattgtcttcccgatcagatcgttcccccagcagaagaagctgatgccactgctggtgtagagaatcctctgctcgatgaggagcgctggtcaccaccacagcccgctctggtgaagcagaactcctacgacctaatggccatttcgtcactgctgttttctgatcttcccgacagaatcgatgacgatgacctgtctgtgtcgcaaacagagggcaccgatctgttcgagcagggctcctccggcgtgatcgacgacgattattgtcgggtgttccatggactgtccgacctgatcgcgct

SEQ ID NO: 66139 - DNA, 18368 bp, Oryza sativa
  unsure (1)..(18368): unsure at all n locations
agcgaggcgcctcgcggagaagacggtgaggtgaagaagaacaagaagatggggggcccaatcaatgcgtctcctcctagcgaagaaatccatgggaagggcgcggacatgtcgagaagatgggggaatcccatggaaatgtcggccgacgtggacgatgcgaagaccaagacgacggcgacggcggcggcggcggaactgacggcgatggcgatctctccgattccgggattcacaggcagagggggcgcggaggcgtcgctgaggcggtctctcgcggcggcgtgcgcgagcatggactcgtcgagcctggcgcgcatcctgtgctcgtccggcagcagcagcagcagccacgccaccctcgccgcacgtcacttccgcccggcgcttctcgccgccgccgaacccgcggcgctcgtcgtccgcgccgtcagggacctgctggccgggacggcgcccatcagggacagcgcgtgggagagctgcgtggagctgctcagctgcgtgcccaagctcgccgtggcgccgtcgccgggcacgatggagcaggccaatcgcttggccgaggactggaaggagatgatcgggaggaccgaaagttgcagcatgaacctcggccggttggctgtatggggccttctcaactttcttgtctcctacaacattgtcctggagttcgacgcggaagaaatcatccatttctttggcactctcccggacgacaagaagcagtgttgcatctccctctgcaagtatcttggactgattgacaagatggctggtacagtttcaatgcctcttactcatactcattgctcaactataatttcatatgtttgtaggcaacttatgctacacatctagcgcaattgtcgcggatatggaaattcattgatttgtgcttgtgttcacattctttaatgataagcttgtttaactccatgtcccaagccttcttatgttatatttagtggccataaatttgtttatcatctaactgaatcagtagaaattatgttttacacttttagtcacagttaatacagagcattaatttgcatcctaaaatggtgacctcaacattatatttgcatttgctagtaaaaaagtaatctcatgaacattttctatatccaaaaagggttccatgtggacttatgattatctctcattatttcagattcagttggtcatttgattgaacatggacaacaacttgtcgctatcagattggcatgcactttgaatttgacagacaaatacactccactttccatcatggaagactatattcagaatgctaaggagactgctcaagagatactgagcatggaaagtgattcagagtcactggtatgtccctttttatgcagtagctatctcatttatattttctactcgtttttctaaccaaaatttcaaatccgtgtgaatatgaatggaagaatagttcattcatgtgctctagagcatgtagctcttcacgttgcagagttagaaaaaaaaaactatattcctttttctaatgtaaccctcttatgatttaaaggtaaacaactggtgtttccggctttgtaaaaactgtactgcacaacattctgaagcacgtaattaggatgttttcaatgtaatgatttatttaggatgtagtggagtagtgagtaatttcaaattatatattcatattgcttttagaaaatatcatattcaatttgtgaaaaatcactgcagatcatttggcatggtaaatgattgcttccacatactgatatacaaatatgcttattttaaaattggtttaacacacctgatgcatcttgtattgagcagaaactgtccatgtcaaagcaggtcaatgctctaatattgtcatggagggttgttggtgaatgcaatattgactctgtccattgtgatagaattaaggcagaaattacccagctgttgcataaatatgcaaacaagaggcacagcctagaagaacttccttctgatacttctagtccacatcagaaacatcaccaaatgtcgcaagagaagcaccactggcagcaaaagcatcgagaggaacaacagcagcagtttcaaaatcaatccaaggaacaagaacaagagagaaggatgcaaaagttacgagagctgaggaaaaagaaaaacaagagaactcagcgcaggaagcggaagcaaaatgcacaagtgatgaagcagcatcaatttgagaaacagcgaaaactatatcacgctggttcatttaccaattctcaaagctatgtcagatcagaaattcaccaccacctcagccagcatttttcaggaactataggaacacctgttgcaccatatacacctgttgcaccatataccggacctttttggtagctagggtccatatataatggaccgggttcatcctgcctacattcaactattcaagtcagagtagtagtacttgataccattactgtttgactgaactgaagataaagatagtagaagagaacggaaattgcgctggtcgcagaaaaacagaagtcaatgctgattggccagtgtagctttgcactgattcaaatttatcttgttgcactactactttctatatgcaatgtacaattagttactttcatggtgctgaattgttattaatcagcttccgtggaggctcctaatgcctccgctaggtcggttggttcatcttgtggtctaggttcactcccaaagtaagttttatcccttggatgcccttacatttttggctgatagatggttgtgaggtgggctatgccggttaaccagtgtgtgtggccccgaccagtctacctgtaggatgatcggacctccacgtcaggttagttggcctttggtcggccaggctaaggtggtcggtcgggcttggggtggctggttggcctagctagcccttaacctcctacctgaggaggtgttggctagtcagctagcccaccctctgatcggccggccagggcccttggcttggttaacacaattttctttgaatataatgcatttcacctttatttgaatgcaacttgcaaaataactaagacatgacaaaactaggaaaccattactctcaaccaaatcaatgcattgaacattattttacctgtttttgatgccgaatgttggtggccaaaatgagctttaatgatcgccaaccgccacaaaagaatcaacaaaggcctaaaggtcctgtttgtattttagtccctgtcacatcgaatgtttagacaccaattagaactattaaacgtagactaatgataaaacccattccataaccctggactaattcatgagatgaatctattttgggcctaattaatccatgattagcctatgtgatgctatagtaaacatgtgctaattatagattaattaggcttaaaaaatttgtctcacgaattagctatcatttatgcaattagttttattattagtctatgtttaaatatctgatgtgacagggactaaaatttagtccctcgatccaaacaccaccaaagttagatgatcaattgcctatcatgattatagaaaattatggaattgagacaaggaatattgttacagtctatcaaaagccttaccctgattatttttatacaatcccatatcctcctagttttcctgaatttgtgaaatttaatgatgaggataatagaaacgtataggaatatatagaccaatttctagcacaatgcggtgaagcgagcaatgccgatgttttcaagttatgcttgtttttctctttctttatccgacaatgcctttatttggtttatttctttacctgcaaattctatttatacttggacccagttagaacaaattaaatttctatgattatttctatactggggaaattgagcttacattatctgatttaacaatgattaggcaaaggtacaatgaatttgtgattgttttattcaagggatttagagatactaaaaaccgatgttttaacttgtctattactaaaagagatttggccgatcttgcattcaatggtttaattgctccggtcaaaacttcttgatggccacaacttcttgatgttggtcaagttttgcaaatggctctatcttaagaaagttgcgctagagaaataagaaatttattatatctattgacaaataacctagtgtgaatatatttgaacattttgatgatgaattcggatgaagaagaacctgacgtgtataaggccaaatggtcctggactaacaagaacaaaccatttgtttgctcaaattaaaatcggacacactacaaggatcaacaaactaaaatcaagtgtacttttgatgtgtccatgtgaaataaaatctttgattatatcttgcaagaaatattattttgcctaaaggccacataccattgcctaggagttaattaaaacactgtgcacactgtaaatggtatggttcttattcacatgctattaatgattgcaatgtttttcatcaataatttcaatcatccattgataaaggacaattgtagttcatagatggtccaaagatgaagtttgatcatgaattatgatcccttcttggtaaacaccatagagtttgttaatgcgaaagtgttgatttggtctagttatgttgaattcacaaatgggaagagtatgattgttggtgaaccttagccaaagatgatcaaaccaaaaggccgtgagattggagtttggaaagttaatacaaatgaagcctttagctctaatatggtgataaaggcaagatgaccttcaatatgtttataatatgagagatgaaaagtcggacaatgatcgagtggtcggcctaccgatgcaaagagactaagatcacctcctagggggtgatttgtccaagcacctaaacaattggagcaacggtttccatatgggcctcaaatcatggcatggaatccatgtccaacacttctgcctagttgtcactttccatacttcatgctatggggatgccagcaccggtgcatattccttatctaccatccctgccaatacaatttcatcaaggagtggaaaccaacgaattcagttcatgattgcttctccgctacaaccaaaagccagtttcaaacaaaagaatcggttgacgagttggaaggagagaagaagggcgaaaaacgctcaaaggtggagaccaagacaatggaggtgatcatcatcaaagtagggttcaatgatgtcccaatacccattggaggtatgatgaaggcaacctaaaccaaggagatcaaagcaggttttagagactctcttgactatacccgcaagtcactaggtgtatcccatgttggccgaaaaacacgtcaacaacataaatgaagaaaatgtcgtatttgcatgctaccagttgtactactttatttcttgatgactagagcaaattaattcagctaacctggcattacatatatatcacggaagcagtggtgtggagccacccataaggctgtatggtctgctgaccccacaacttttccacaaacgcccttatgattctgcatctttatatgtaaatccattaaaatatattaaaataatcccactaaaatgtgaagcaattatatttgaccgcataataaaattcctggctctaccacttaatagaagcacttattacgtaccaaccttgaggaggctaaaagtggtatttacccgttagcaaaagtgtattaaaactcaccagttttcaccggaccaatgacagttagagttttaagcagatatttaacaattagcatcattggtaagactaaagctataataatagcccacaaaccaattccttacaaaccagtttgaaactttgagttgttaaaattgtttatataagaagtgataatttgttattagaaaccatccagatatatgcatcatggttttgagtttttgcagtattttaattaagttgctatcataattttcacttttgtagtcactttaaagctgattttattggccttagcacaagatttgagatgtgcccgcgacttacgttgattcaatggttataaagtctgttctacttaccaaatcaagatgtgaacatcactacagcttgatgagtacatgagaaaattcatgaggttcatggtttatctgtcattttttttattaaactccaaataaaaaaaaacggaattgctgtatatctgtcgacagattttttgttaaaaatctgtcgatttcttcaccgtatgatttactttgagatttgtgcgtgtgccttcgagtgaaaaaaaaatgacgctagagcagggaatcgaccacatgatgtcgggatgccatgacgtgcatcgtaccaactgagcaagaagcgactgattattttgctgctatacctaacgtttttaaaactttcaccgcagtttcatagttaattacagtgtaatttttaatagatgcaggtgtaatttttgttttacatggatggtaatttttttactcatggttgttttgttatactgtagttaacctaattgtttgaggtgtgatttgatattttcggactatatatgccgtcatatttttcataaaaaaataatcggcacgtatttacatcgtaaatcttcaaatttacatatgtaattttaatatatttacgctataagttttaaaattacatatgtaattttaatatatttatagcgtaagtttcaaaattacatatgtaacccctaaaattacatgcgtaagttgatgtaagttgcttgtttttccttttctttttagcagcatcactgacgtgattaatgtccagtgactgacgtacattgatacgttttcatttgagcagcacatggtggtggcttgaaaattcgactgattttctaaagaaaatctgtcgaatgattgttagacagtcccaaaaaaaaatcctacctagcacataatgtctgacatcgctacatcactacagcttgatgatctaagcaaattcggcaaggccttttacatcttttttttggggtcaaagtagcaaattattatggtccatttagtactttccaacttgcaaattgcagaagtttcttgtcatgattgaaatagcctctcaaaaaaaaaaaacaatggtctatatctactactcctttgtgtacatccttaaatttaaatggtgatactgtatttacttggctaactttctagattgccctcttttaaagttgcatagatgtggttcttcctagctcagtcttccctattaatcataattcagcatacaaaattgcacattgattgtctccaattttggtgagttttcggcaaaccaaacccaaggaggtgtgaaatggttcttaacaaatcgtcctatcttaacaaaacattttaaattttcagaacatacgtcgtactactaacttcccaaaactggaaggagtactatgtttatcttgtccttttacacaaaccaccctagacagcttcgcgttccccatttggtcctccgctccgcagcccacgcgagccacgctgacgcgtaggccccaccgctagcgagagagcaagcgggccccacaccctcgtacttcgcttgctgtaaactgagctaattaagcttccaactctgcctcgccctcgctctcctcgtttcacacttctccgctctcgccctcgccctcgccatggctgacaaccaagcgccgccgccgccgccgccgcccgccccggagagccccaccgcgccgcagaccgccgttcaccggccggatcttatcccggacttgaaccgcccgtcgttggagtcgatcctgatggcgaacgtggaggaggccgtcgcggcgttccccggcagggtggactctctgcggcaatcgtacgaccgcctcgtcgcctcctcccccttcctgatacccttcttctgggggaacatggagggctacgtcggctcggcgcagggctacctctcgcgcgggctcgcctcgctccacgggcagggccaggtccggcacggcgacggcgacggcgccggcccctccggtcatgctggtatcgccgtcgccgccgtcgaggcgggcggcgagggcatggaaggaggagcatcttctgttgccgatgaacagggcggcggagatggcgccgccatggaggaggaggcggttgcgccggttgaggaggagagggagatcaaggcggtggccgtgggagaggttgctgctgatgacaaggacagcggcgaggtcgctgtcaagaaggagaggaaagaagccatggatttgtttcctcaccaaggtgatgatgacgcatcggtggagccgaaggtggacgccctccacctgctcgccaccgccaccgccgccaacgccgacgccgacgnnnncnnnnnnnnnnnnnnnnnnnnntnnnnnnnngtcgggatggaaagcaagggtaagggcaagtctcctgacctggacatcaaggtcgaggccatggatccgtcgcccgagcagggtgctgacatgcaggccgtggtgaccatggcggagacagaggatgcggcgaagaaggcgttcgacgccatcgacaaggtggggatccctttgatggacaggactgaggaggaagaagaagaaggagaagcatacctggaggtgcctcttgaccaagccatggagatggaggtgcatcctgaccaagccaatgaagaagcagtaatggaggaggtgtctgttcaagaagatgatgctcaagaagcggacatggagatctgtaatgacgaagaaaaaatgcaggtcaagaagatggaggaggaggcagatgacggcgccaagcgagcctctccagaacgtagcagcggtgagatcgtcgccgcggggaagaagaaagcagccatgtacgtgcctcgcaaccaagacggcggcgctatcaccgacgcgttggtcggagagatcaaggcggaggccaagggcaagacgaagagagcatctcgcgaggaggaagaagacggtaaggtggtccgcgaccgtggtggtgcggcgaatgcaggggcggagcggcggcggcgccgggagcgtgagccggcgccgcggcgtcagctcgtggcggcgtgcgagcggatggactcgttcgacatggcggagctcgtcctcaggtccggccgcggcatcgcgggcgagttcctcccggcgctccgccgcgcgccggacgcgcccgcgctcgcgctccacgccgccgggtacgtcctctccgcggggccgcgcgacgtcgactccacaagctgggacaacctcgcggcgctcctccgcggcgtgcgcaggctcgccaccagcggcagagccgcgccaccgctggaggccagggcgaaggaggccacggcgatggccaagaagtggatcgccatggtcgccggcgaggcggagcgcgagcaccagcgggtggcctgggcccgttcggccacctgggcgctcctccagttcgtcgccgcctacgccatcgccggcaacctggaggtgaaggagatgatggtgttcaaaaccgtcggcgacagggacggcggcgccgagctgatcaagagccttggcctgcctgacagggctactggtaaaaataatctatagctttaattacagttcattccattttctcaattaatttatccgcgtaaccattgtctatcgaatcgcaaatgtttgtgaatttttacttaatttccacagaaaaaaaactgttacgtactgtgatcattacatgctagtactgcagtgcatggtgatgtttttggttatgttttcctttgtttgttagagttagtatctccttttggagtcttccattttttccttcggcagttgttgctctaagattagagattctgatagtatcccagtaaagcgtagagttgatacacaagctgagtatattcttagttcaatcttttgtccttttgaagctttctggcaaaaaaaaaaaatcccatttgaatccttctggaaataaggtcctttgagctctgccaatttggacactttagtgaagtttaatttgggaatttgctgaaattatcatgggaatttaacacattttttagatatattagttttataatttctatcaataatttatttctttcattcattcaaataatagtcataacttggcttccaaggggcaaatggagttagtgacacgcaagtaaactgaaaatatattttctatttatctgcaattggtgcatgtattagttgcatcttactcttttaagtctcaattaggtttgcactcattgttcttgtcatatatgcataattctattttttttcctatcaaatgttatgttttcaatgatcaaactgagtcttggtcaactcatgggcttgtctattacattgggttttcttttgtggtatgcaacccaatatctgctactagatttatttttgctaattaagtatgtactcccttgggtttataatgtatgacgctattgactttcggatatacgtttgatcatttgtattattaaaaaaattatgcaaatataaaaaatgcaagtcatgcttaaaatacatctaatagtaaaacaaatcacaagaaattaaaaaaataattatgcaatttttttaataagatatgtcaaacttatgtgcaaaaagtgaacggcatcatatgttaaagaaccgagatatattgagatgcatcattgttcctagccattgtttgccaactctcccatgttagcattatcttttccattttttcccttggatgaaggcagttatgttgtgctgctgggtatgcattagtgccatgatgatttgggtatgatcaagattaaactgatgcaaaatcatgttatgattatcttctagtggatgaacacatttgctatattgtttaattcataaaaaaaggtgactaggcatcagttggctgacattgcgttaagtgtcagtcaattgcaatcaactcccacatattcaatccaattgacgaagaatacatttcttctgtctctagcactttctgccacagtttctatcttctacctgattcatcttatcgaagagctcccttgtcccagatccactggcaccagtcaccactcaccacctgctaagaccagcaccataggtcttcaactcctcatcacccacagctctggtggtgccaccattgcttcaccgtactactctcaccaccaacctgccacctcccaaggcctccctctatagcccagcctcgatgaagcaaatgcttcctgattcccattcatgccttctcctggccaagttttggtccttctttaatcatgttgttctagttggtaaaacaaatcattgaaggaatctttagctacaaaaaaaaaacctaatgcatatgtccatttgctcttctaggagtaagaccatgaaagttccctacataggagaaatggtagcattagcattgcactctatggaggtgcaatacaatttgtaactgaaatgtcaatttatcgatgtgaatgtcccgtcaaatccactgtatgttaggtgattatccaagatgggttaatggcaaggaatatcccctacagtatgaatggtgtccatgaagattggatcacctagatgctttgttcgcatacaaggtttcatttgcaactacaaaaagaaaatccattgacttagccaatgacatggtgtaaggggtgtgatttgttagggccacctagttctcatactaagggggtacccaggactgagccaaggcctgagccatcccaccctagtataggaggaataagtcctcaaatataggtccaatctaatttgtatcccttgaccgcaataccagatatcttttaccccctcccccaactatcaatactgatgcaatttgacccctttagtggttttgagactagttttcactgacatggcacgttgacttggtccagctgtgctgacgtggcagctcaatcacaaattagtagtgaggcccacatgtaagtgactagggggaaaaaataaaaaaaatgtagagcccacttgtcagcccccttcttccctctctatcttttccccaagctcaagtttggccccaacagcctcgccctggcatcgccgcagctagaggagtggaagggtctgcaacgggacggatgatggggttggctggtgaaaacggatggagacaacgatgacacatagaaggagagtggaggcacgcgagtgcagacgggttcaagaagagggcactgagctctggtcgaagtgggagtaggaagaagggggtagcttccatgggtcatggcggccaccaccagacaacatcgcggcaacgaggctactgaacattgtgctggcaactgccgcaatagtgccgccagacaaaactgtggccgagaggatgtccaaggagctgtcagccacgagcccaatgtgtgtgtcaccgccatcaagactaaggtgcaggagcaagatctcactaccacactatcgggaagctactgcgggggcatcatgcgaggacccctaatgtcgcctagctccctcgagctcgtctgccccgttgccttgccttggtattgtagattcttcgctactatcgccttgctgctactagccactacccaccgagaagaagacacgggatcccatcggcctctctacgctgccatagtaaggagaggagagaaagaaagagagaagagaagagggagaggaaggtggctggcaagtgggccccaattttttttactttttccctagtcacttacatgtgagccccacttctaatttgcgacaaggctgccatgtcagcacaaatgaaccaagtcaacctgccacgtcagtggaaaccactcttataaccgctgagagtcaaattgcaccattttaaatagttggggaggagggggggggggtcaaaatatccgatattgcggttgagggatacgaatcatattagaactatattgagggagtcaaagtggacttattctagtttacaatgcatttgtgcaattgtgcaagcgtgctaaaaatatatccaatggatcttaagtcctaggtgctgggatatggcccaggtttcttagggcctagtccacccttggtccttatgacataagtcataatttcttccaccatcttttggaggcgaagtggattccagttgcgaagtctctgacgagccgcaaaagacaatgagctgaaagaactaattgtttgagtatgcattctgtcagaatttctattttaaatcattttgagctttaggacataagcagcaaacatgattcataaatggtttgctatgcctgtttttttttcgttttttgaattcacatctctactctgttgagcattattctctatttttcaggaagtgactggtggcattgctgatactttacgatgttcactgtcttatttgcagagtcaattaatcgtctgatgaagagaagggaacacatcgatgctgtcaaagtggctcgtgctttcaatttgattgataagttccctccagtttctgttatcaaagcatatgttgaaaaagtaaaagaggctgctcaagacatggttagcaaggacgcagtttcactgcaggcattggtatacctttcatctggttaactgggacaatgggggatttgtttcctaatttacttctttaactaattatgccatctagatttaattatgctagatatatgcacacatgtttgctatagacaaaaaagaattccacatgctctaatgttctttgaatcaaatgatttttcttttttttttcattcaacacatcttcagtattttgttaatttttgttacaggtagcacttggtgacttttacattactctaattatagatttagcatttatatatgtgacaatttcatcataagacctttatgtgataaacatatatttgagaacaaataagattcactacaaccaacacaactgttgcattcttttacaaggagtatagatatgaattgtgttactcttttgcagccaggaaatccttttacattgcaaaggagtaatataatcatgatacatacagctgtattgtcatgaacagaaaatgattaattcatcatgtttcatgaaagaaaattaatctcttttccagatatttggtaatttctaaattggtataatgtactgtatgccatcaggatcgcgctatgcaagaggatgttgctgctctgagatctgctaaggaagcaattgaagcgcatgacagtggatctgactaccgctacactataatgcaagaagtccacaagttgatgagatcttatgagaagaagaaacggagtttatcttttggttccacctcaagttcacatgagcacaagaacaagaggcacaggagcaatcaggctatgcctcgttgggaaaaccaaaccataccaggtcctcctgtatattttccagtccctcctccatattttggtcactacaatccttatcacccctttggtccacaacctcgtcgtaattaagttgtggtgatgctgctgctgtggtggattgactagagtgatgaatggattggatgaacagaaaaaagaaagaaagtgcactttcataattttgcagtaatttgttacttctccagcttggctgcaataactcttttggttgtagcatgcagatgcaccgttgttgtacatgattcaagctggcaacttgaattcaaaccttaaataagtttcttagttgtttatctttaattttatctgtttgtctgtaaattactttgtgggagaatgtttagaatgatagcaattttacggtacttgagaaagtaccaagaaatactaaatctgtagcgtttgatttctgatacctagaaggtatgaataggtaaatgctagagaatgtgatatatctcttagaatgaatgatgatctgtcaccggttcttctttgactgccacatgctgtgggaaaaattaggccctgattagttcgcgagacgaaaagttttggcgtgtcacatcagatatacagagacacatttgaagtattaaacgtagactaataacaaaacaaattacagattccgcctataaactacgtgacgaatttattaagcctaattaatccgtcattagcaaatgtttactgtagcaccatattatgaaatcatggagcaattaggcttaaaagatttgtctctcaatttacacataatctgtaattagtttttttctatatttaatactccatacatatgtccaaccattcgatgtgacagggtgaaaagtttttgtgtgggaactaaacagggtcttaatggaactgaagactacggtgtctgaactgtacatcagtacatatgttagctagttgcggatgcagggtccagatagttgtgggacttcaagacaatcaatctcaccgacaacaagaggtcagacctgcgaaatgaccagccagtccctgagcattgtagaaacaaacccccaagctgccgttacttttgtcggatgaactacagtacgataaattgtgctagccaggcttgctctatcgcatcaagcgatcaagtcacggccaatttttaataagcgtgcatactatgtagaggcagtataaaagttctcctactgcgtactcaataagctcatttttttctcctctcttttgtcctaaactaagtttattttctagctatcattagagcggagtttgtgaaagtaggagtaaatgcattgggagtataaagtgaagaataattatattgggatttgataaagtgggggtattctaatcttagttcgacaatgcaagctgaagccttggcatgtttggaaggtatccagctagctactgaatgggtgaatatgccacttatcttagaatcagataatgcaagtgtcgtcgctgagttaaacgcgaccaatgtctcaagagcagattggagtggcataattttagatgttaaagcggcaatgttatgtttagttcaggtgcaagtgcacaagataaagagagattctaataagatagctcatgccttagcccaactggtaatagaatcaggaactaatgcggtctggagattatgctcccctgcagaaattcttgacctcctgaaccaagaatgtaaccctctgttttctcattaatgaaatctctctttactttcaaaaaaaaaataataatctttttggtttttttatatgtgtgggatgagtgaaaaataaacttatttttaggacggaggagaagtaaataaagacctaaggatggatagcatgcggacacaatatgccacgtatgaagtgtgctagtgtgttccctactgcatggaaatgtataagaaagtatcatatcctttgcctatgccttctctcccgaatgggagggagccactcacaccgccaatgaggaaattgcatggcaaaatttgctaaaggacacccaaaaaatatgtaattagctgtgggacatcgcaaagatgtgaatttgcctgaagacactcaaaaaaagtggtaatttgctgcaagacactggtcgcattaaaatataatatctccatgtaaaatgacagttttgcccttatcttctccgttgtcccttttccccatcttcttcaacgtcgagcgcgcacccagcggccacggcagggatgacggacgtgtttgaccaacacggcgacctcctcctccctgatgcagcggaagaagagcacgcaaatgcggcactcctagctctagtactcaccgtagggcgcgaacgcgacgtcacagccgtagagcagctgctcggccatagcgctcttgggccggctcgtcgcggcgaacgacgacaaccaccaccggcatgcgttcgagctagagtagtagcaccaggccatgtgccgtggtaagggatggaatgcctggtgcagcggcgcgctgagtaggtggaggtatctgagcagcgggagcctccgcggctatggcggcagcctctgccaaccatcgttgtcctcccacctctcaggcctattactcctattcacatctggaagcagtacgaggtacatgagtgctacaatgatgtcaaggactaacaagacaacaacatctctgcagaatgaaggatccactgaagcaatctgtttataattggttacaaactttataggatcattttcattttattttgtttcttcttgtaaatatttactgtaattattctttcaataaatgaaaatcacactgctgggcaaagacctggcactactttcagtcaaaaaaaaacaagacaacagcaatgtaagagggccattatacgcacagcaaagcatttgtttgcttggttgtagccgcatgcggtagcagggtggatggatggatgggggcaacaccttacacatgtattacattatggcctggcaactccagcaaatgggagcgacaactgaggagcgtttgaagaacattggaacaaagaagaagataagggtaaaagtgtcattatatatggtttctctctcatcaattgagtagaaattatattttaatgcgttcagtgtcctacagcaaattaccacacttttagagtgtcctcgggaaaattcacgtttttacagtgtcccacagctaattacatattttttgagtgtcctgtagcaaattttgccaaattgcattgatgatgagatatgaaaggaggaatgggaagggatgactgaaatgtagggaagctcatagacccatgggagggtatatcagaatgtataggtagccaatggagatgatgtagaattaggctgagttctggagtgggttaggaacctttactcccagcatgaaaaacggaacggtccattagtacgtgatttatttatttattttataaaaatagatcaatattattatttttaaagcaacttttctatcgaaaaattttgctaaaaacacaacggttagcaatttgaaaagcgtgcgtgcggaaaacgatggagatgagttggaaaagatggctgtcaaacacagcctaaaggtagcttggagggtgatgtaggataatggaaaaatggggggatgcagatcctctgcagtacagctgatgcaaggagagacgcgcggggagaacgtgaaagagaagcaatgactggagtgagttgaggttcctcggctcgagctgaactccagggcaccagcaacggggctggtcttcgaaggggatgtgcaccacgagtccacgatgactccgtcccctggtctctcgatgacattccatcggctccgtgctagtcaatgttgtcgtcgccctccatggttgctccttccatgggatgactcatctttgatgtcaccgtcgctagggcaccatcttccacggttccttccccgttgtcatccacctctgcctcttcacggatcccgttgccctccatcggtcctcattac
